United States Patent 6,812,339 (POLYMORPHISMS IN KNOWN GENES ASSOCIATED WITH HUMAN DISEASE, METHODS OF DETECTION AND USES THEREOF) - sequence listing, part 92

SEQ ID NO: 69772 - DNA, 601 bp, Human
gagaggaaaaatgggagggaaagatgaaatgagggtcaaaagagggtgagggtgaaagtaagagagagaagggggagaggggagtagatttttaaaatctatcacattgtgaaaatctgactcttgtattcataaggcaacataaacaatattgaaaaattttagtatcttcttagtaaagatatatctaagttcaatacaagttaaatatacgatttcatctaaatattttctatccttggttatcaaaagtagttattctaagaagatttacactttaaagattgcccaaaatatgttrtgatcctttaaaggtgatgtaatttctctttttgtttatttatagttaattagtctttgtcagtgttgcacattagttacactcctgcatttcaaggtctgtttgctttctgattcataaagattagcctgtatcctttagttatattaaaagacttgtatttaattaggaacatgtcatatcagatttatggaatgggctacaaccttgccaatttctacattactgccggagagacaatcagttatttagggaagcacattcactgttgagctacagtggagttccaaactattgttc

SEQ ID NO: 69773 - DNA, 601 bp, Human
ttatgtcacaccaataaatgtacttactgggtaatatatagcactctgatggcattgttgggtctaaaacttgcttctaatatagaaaacaatggatcatagatattctagatcatgagaaatcacacaaatcatcagtttgaaattatattactgaatataattttcaaacacaaataatttaatgaccctttctcaacaactcaggaggcaataaatctaccaccatcagtagaaatcaacaaagctcaattgagattcttcccctgggttttggggatggtttgacttattgaccacstaaatccctagactcacaaatgcaaatgcaacacttacagtggaataattcaaatttgattttcagataaaaaacttttaagttgttctatcttgttttaattttttcatgctgcataacaaattgccataaacttagtaaagctatacccatttttttagcccacagtttctgtaggtcagaagttcaggcctgatctgactggcttctctcccaagggtctcacaaggtcaaagtcaaggtgatgactagggctgtggtctcatgcagagctcagagttccttgtgtctgtaggcctg

SEQ ID NO: 69774 - DNA, 601 bp, Human
gcaaccattttatgtcacaccaataaatgtacttactgggtaatatatagcactctgatggcattgttgggtctaaaacttgcttctaatatagaaaacaatggatcatagatattctagatcatgagaaatcacacaaatcatcagtttgaaattatattactgaatataattttcaaacacaaataatttaatgaccctttctcaacaactcaggaggcaataaatctaccaccatcagtagaaatcaacaaagctcaattgagattcttcccctgggttttggggatggtttgacttrttgaccacctaaatccctagactcacaaatgcaaatgcaacacttacagtggaataattcaaatttgattttcagataaaaaacttttaagttgttctatcttgttttaattttttcatgctgcataacaaattgccataaacttagtaaagctatacccatttttttagcccacagtttctgtaggtcagaagttcaggcctgatctgactggcttctctcccaagggtctcacaaggtcaaagtcaaggtgatgactagggctgtggtctcatgcagagctcagagttccttgtgtct

SEQ ID NO: 69775 - DNA, 601 bp, Human
tatatgtaatatgactagaacagtacctagcacataataaatgctcacttaaggttagctgtagtttatcagaaagcaaaaagtctacattttgatcatatagcctacaacccattcctattcacagcactagagtaaaatgaaagtgcagtaaaagctgcaaccattttatgtcacaccaataaatgtacttactgggtaatatatagcactctgatggcattgttgggtctaaaacttgcttctaatatagaaaacaatggatcatagatattctagatcatgagaaatcacacaaatmatcagtttgaaattatattactgaatataattttcaaacacaaataatttaatgaccctttctcaacaactcaggaggcaataaatctaccaccatcagtagaaatcaacaaagctcaattgagattcttcccctgggttttggggatggtttgacttattgaccacctaaatccctagactcacaaatgcaaatgcaacacttacagtggaataattcaaatttgattttcagataaaaaacttttaagttgttctatcttgttttaattttttcatgctgcataacaaattgccataa

SEQ ID NO: 69776 - DNA, 601 bp, Human
tatattttcatctttttatgttaatttgtgtgcatattatagcatttattcatgtaagtaaccttaaatactgttaagaaaaggtgatggataaatgagtaaatactttatatctcagattagctgccagatttaaaactaataacagattcaagtacatcatttctcagcatatgtattttgtgagtgaactcataaaaacttacattccaatagatagctacagatctcgcatacatatatcttatatgtgtctttttaaacttcctctattgtgctgaaaatacttataagactactrgactgagaatgccaaggcacaggaagagatttggtctaatttgccttcccgaattcttggctctcagcaaaagattggtaagtggatctaatgtgaacccaagcacgatggggttagccttcatcatagcccaaatcgaatcccttcctttaaggcatctgtgatcatcagcacataagcttcagtggcttttaattgagtgagtgattcaatggtaaagttacttgcatttattaaacatttgctatgtaccaggttctgtattaaacagctaacatgtttatcttacttaatcctcaa

SEQ ID NO: 69777 - DNA, 601 bp, Human
attcatgcctatatgtgtacacattaaccaacaaagggtaagtttctctgtccctggaaaactcaagacagggtttactagaatttgccctaggagtgagaatgagaaacgtggaattagggaagatccaatgaaaattatgcatattaatggagggctaggcaggacaataacaagtgaagtcccaattctggcttagaaattagtctgatgggacaacatatccaattaagaatatccaactcagaaatgtgaagatttccaaaatgttttggacagtgttacttttagcagattcataagttactgatttatgaaatgtagtgaactatgcctgaaaatgaaggtgtggaacagaaagaaaataaaaaataacttaaaaagaaagttctttttctagatgacacagtactagagaagtaaagagataaaattaagaagcatattaattttttaaaaacaactgcatgtgacactgaaaatatagatgaggaaagtcaaacaccaaacctgggtctcatccacaaatcattccaatttcagtagtccagggtatggcttaggcactgggattttaaaaagctctagagctgattcaaat

SEQ ID NO: 69778 - DNA, 601 bp, Human
aaattatcttaaacaagttcaaagaccacattaaacctaaaggttaaccttcatcctcttagtgccaccacattctctgtaggtagtcccacttgggaagctaattatagtcaaaagattgttgatgaccatagaacaagtacaaaggataaatcagctccataatagcataaggcaaaagaaggactcttttccaagggatcgaactctttaaatatattagctctcatgagtttttgcagtcattagcatgataaaaaaacaccctgccaaaagatgactgctgaatagtgatttattrgacttgacaacattaccctctgggatattctttttttctctctacttccaaaatttactgatcctcttcaatgtccattctatccttttatacattacagattcagtgtagttatcgtagaataaactattttatcttaaatggcctagatttaatttctttcaattttatgtctttaatcagagttttgatattataactctagagagaacacgctgaaaaaaagattttatccagtctcaatattttttagatatatttctttgttcttctcaaacgtgccaaggaatggagtatata

SEQ ID NO: 69779 - DNA, 601 bp, Human
aaatttgggattgcttgttacacagcaaaagctaactgatacagttttttatgttgtatctgtgagtatttgattaatctctccccatgaggataaatactacatatttcttttttttccccattatactcccagctgctactccagtatgcctagcaattattaggcctcctgaaaaatacagttgaatcagtatgggtaaatcatggcaatttttgatacattaaatgattgttttgtgtataagagtaagaaaatattataaaatggttaaagttgcatgagagtgacagagcaggartatcaccatcttggacaagcactgtcattttaaaatttaccttgatcaaaaatgcctaaattcaaagggtatcaacctaatggctaaggtcagcataaccataaaccacaataacatctctgaccagaaacattccaaacccctccccaaccacagacatgctagccctgagataacctcccctccgcccagagacattccaaccacaccataaaatttcccccacacagaaacattccaagcttgtgatgggccctgtcaccctaaaaccaatatatactcttagtctgtaagggagaa

SEQ ID NO: 69780 - DNA, 601 bp, Human
aaacaagctggggccagcctgttggaagatgagagagcacacggtggaggggaggggaaagccacttcagctgaggccaagctagtccagccagcactgtaccaacctagcatatacctgagtcaacccagtgcaaaccagcagcacatcggaacccatatatctgaactacaggactatgagctgaataaatggttattttaagtaaccaaaatttgggattgcttgttacacagcaaaagctaactgatacagttttttatgttgtatctgtgagtatttgattaatctctccccatgrggataaatactacatatttcttttttttccccattatactcccagctgctactccagtatgcctagcaattattaggcctcctgaaaaatacagttgaatcagtatgggtaaatcatggcaatttttgatacattaaatgattgttttgtgtataagagtaagaaaatattataaaatggttaaagttgcatgagagtgacagagcaggagtatcaccatcttggacaagcactgtcattttaaaatttaccttgatcaaaaatgcctaaattcaaagggtatcaacctaatggctaagg

SEQ ID NO: 69781 - DNA, 601 bp, Human
tcatttgtcctctatgaaccctatttaataaccatataaacaagctggggccagcctgttggaagatgagagagcacacggtggaggggaggggaaagccacttcagctgaggccaagctagtccagccagcactgtaccaacctagcatatacctgagtcaacccagtgcaaaccagcagcacatcggaacccatatatctgaactacaggactatgagctgaataaatggttattttaagtaaccaaaatttgggattgcttgttacacagcaaaagctaactgatacagttttttatrttgtatctgtgagtatttgattaatctctccccatgaggataaatactacatatttcttttttttccccattatactcccagctgctactccagtatgcctagcaattattaggcctcctgaaaaatacagttgaatcagtatgggtaaatcatggcaatttttgatacattaaatgattgttttgtgtataagagtaagaaaatattataaaatggttaaagttgcatgagagtgacagagcaggagtatcaccatcttggacaagcactgtcattttaaaatttaccttgatcaaaaa

SEQ ID NO: 69782 - DNA, 601 bp, Human
ggtacttagtaaatgtctacttctctgacggtctcgtaagcttgggctgaaaatttgctccaggcaattgggatggcgacatccaggacccactttttgtggcccagtgtccttgtggtatccccagaaatcccagactttcccttaaccacaccaatatggccttttgcttttttccacccttctttatttgctttcattaagaaagtaaagaaacacataaattatttctggattacttaataccaagtgatctgcaaactattcctttcatctataacacaggtatattttcagaccwggtattttctaggtgtttgagtaaccaaaaaattttaggaatacacttatgatttaatatcacttataatagatttaaaagcattgcaaatcacaaatgaaaattattctttttaaggaacactaaactttcttttatcagtttatatttctgaattgtgcatccttctgtgcttccatagagtctctctatttcagccttttctgtgctgtattacattggttccatttgttttctgcatttccaagcctgctggatggtaaagtatgtcatgtcttttatctgtgtacctctaggctg

SEQ ID NO: 69783 - DNA, 601 bp, Human
aaattgatacatattatcttgtcctttcaatccttgatttcctaggttcaaatattctgttccttaccaatgacttatactgtctctaatggcattttactgaaaagtatcctttatactaaaataaaatatatagtgacataaaaactatgatttgattgtgatatgccatttctcatgtgttttcaatattattaaaataacaaatattgtaatgatatctaggtatgttaaaatggacttctttgagaacgttgacactaggaggcagttataaaattacaaaattattcaaaggttwttttttatattatattttagattacaactgctttgctcttatctaacttgtacattttaagtaatagaatcattgcttttaagaatactgtttggatttaggagaaatcttctctttcagatttcttcccttgtctgaatgtctatttctttgtggtacttagtaaatgtctacttctctgacggtctcgtaagcttgggctgaaaatttgctccaggcaattgggatggcgacatccaggacccactttttgtggcccagtgtccttgtggtatccccagaaatcccagactttccctt

SEQ ID NO: 69784 - DNA, 601 bp, Human
aaaaattttgtttcatatccacgtatttgtgaatttcttaaattttattttttgttgatttctaatgcaatttcattggaatcagaaaacatactttgtataattttaattattttcaatttactaatacttgttttgtggcctagtatgtggtctacctgggaaatgttccttgtgcacttgagaaaaatgtgtattttgaaattgttgggtggaatgttctgtcgatgactgttatgccaaattggttttcagtgttgtccaagttttctatttacttagtgatcttatagatagttgytctatccattattgaagcaaggccaggtgcggtggctcatgccagtaatcccagcactttgggaggccaattcaggaggatcacttgaggccaggagttcaagaccagcctgggcaacatggtgagacctggtctctaaaaaatttaaaaagtagccaggcatgatggttcacacctaaagttctagctacttgggagactagggtggaaaattgcttgagcccaggtgtttgaggctgtggtaagctatgatcatactactgcattctagcctgggtgacagagcaagaccctttctat

SEQ ID NO: 69785 - DNA, 601 bp, Human
gaaggctaggttatagatttgagatcttcttttttaatatacgtatttacagctgaaaatttccctttaagtgctgctttagctccatcccatacatttcaatgtgttttatttttgtttttatttatctctgattttttttaactttcttgagatttctattttggcccattagtgattaagaaaaattttgtttcatatccacgtatttgtgaatttcttaaattttattttttgttgatttctaatgcaatttcattggaatcagaaaacatactttgtataattttaattattttcwatttactaatacttgttttgtggcctagtatgtggtctacctgggaaatgttccttgtgcacttgagaaaaatgtgtattttgaaattgttgggtggaatgttctgtcgatgactgttatgccaaattggttttcagtgttgtccaagttttctatttacttagtgatcttatagatagttgctctatccattattgaagcaaggccaggtgcggtggctcatgccagtaatcccagcactttgggaggccaattcaggaggatcacttgaggccaggagttcaagaccagcctgggcaa

SEQ ID NO: 69786 - DNA, 601 bp, Human
ttataacctataacattgctgaacttatttattagttcaaatactttagtggattccttagaattttctatacctaagatttatagattaatttggggaccatttccaccttagtcgtaagtcttctgattcatgaatatggaattatgttttctttatttagatcttaatttcaacaatgtgttgtagatttaagtatacagagcttgtactgcctttgttaaatttcttttagatacctttaaaattttgtgactattataaacagaattgttttcttaattttttttcagattgttcmttgctagtgtatagatatcctgcatacaattgatatttgtatattgattttgtaacctgccacattgctgaactcatttattagttcaactagtttttagtggattccttaatattttttatatgcaagattatgtcatctgaaaatagaagaatgaccttatttccaatttggaaactatttatttactatattttatgtatttatttttcctaatagtcctagctataactgccaggctcaatactgaatagaagtggtgagacaaacaattttagtcttgtttctgttcttagaaag

SEQ ID NO: 69787 - DNA, 601 bp, Human
tattgaaacataattgatagtttatattgattttataacctataacattgctgaacttatttattagttcaaatactttagtggattccttagaattttctatacctaagatttatagattaatttggggaccatttccaccttagtcgtaagtcttctgattcatgaatatggaattatgttttctttatttagatcttaatttcaacaatgtgttgtagatttaagtatacagagcttgtactgcctttgttaaatttcttttagatacctttaaaattttgtgactattataaacagrattgttttcttaattttttttcagattgttccttgctagtgtatagatatcctgcatacaattgatatttgtatattgattttgtaacctgccacattgctgaactcatttattagttcaactagtttttagtggattccttaatattttttatatgcaagattatgtcatctgaaaatagaagaatgaccttatttccaatttggaaactatttatttactatattttatgtatttatttttcctaatagtcctagctataactgccaggctcaatactgaatagaagtggtgagacaa

SEQ ID NO: 69788 - DNA, 601 bp, Human
cttctaattgtctcttttattttagccaaataagtgagtatgagttggtatctcactgtgtttttgttcattgttagtgtattgaaacataattgatagtttatattgattttataacctataacattgctgaacttatttattagttcaaatactttagtggattccttagaattttctatacctaagatttatagattaatttggggaccatttccaccttagtcgtaagtcttctgattcatgaatatggaattatgttttctttatttagatcttaatttcaacaatgtgttgtagmtttaagtatacagagcttgtactgcctttgttaaatttcttttagatacctttaaaattttgtgactattataaacagaattgttttcttaattttttttcagattgttccttgctagtgtatagatatcctgcatacaattgatatttgtatattgattttgtaacctgccacattgctgaactcatttattagttcaactagtttttagtggattccttaatattttttatatgcaagattatgtcatctgaaaatagaagaatgaccttatttccaatttggaaactatttatttac

SEQ ID NO: 69789 - DNA, 601 bp, Human
gacgaggtagacacatgtatgcttgaggagttttgctgagattaatagggtttccatccaatcgaatgtcctctagtgccttacgaatataagtcaaatttttaacattgcagaacgtatcttcgtgcatttccagaatgttgttattctaaaaaagatgaaaataaattatgacaagatataacacattcttagtattgattgatagcgcagcccactgtgcttcacccttgtttttattcttttgttattttcctcaatcaaaattacttaatgtatatgccaagcactttctaagcartgggggtaaattaggaaatagacatgctcctgtttttaaggagcttatacttcagtaagagaaatacaatttgaggtgagaaaactactgaaagaaaaacaagttatttccaaaaatgatgagtattgtgaagaaaataggatgactatgaaaagttatctttagaggtaacaattgaactgagaatggattgacaagaagaaaaaggcatggaaaaaaaacaagggaagaacattctaggcacagagaacatcaggtttagagtcctgaggaatcaacatggaatgctcctccctcaac

SEQ ID NO: 69790 - DNA, 601 bp, Human
tggaagagagcagtaagaatggtttatttatagtagccatcgtaatgctaaccattatctgaaattagacaaggctcccaacaggcagacgaggtagacacatgtatgcttgaggagttttgctgagattaatagggtttccatccaatcgaatgtcctctagtgccttacgaatataagtcaaatttttaacattgcagaacgtatcttcgtgcatttccagaatgttgttattctaaaaaagatgaaaataaattatgacaagatataacacattcttagtattgattgatagcgcagyccactgtgcttcacccttgtttttattcttttgttattttcctcaatcaaaattacttaatgtatatgccaagcactttctaagcagtgggggtaaattaggaaatagacatgctcctgtttttaaggagcttatacttcagtaagagaaatacaatttgaggtgagaaaactactgaaagaaaaacaagttatttccaaaaatgatgagtattgtgaagaaaataggatgactatgaaaagttatctttagaggtaacaattgaactgagaatggattgacaagaagaaaaaggcatgg

SEQ ID NO: 69791 - DNA, 601 bp, Human; identical to SEQ ID NO: 23617

SEQ ID NO: 69792 - DNA, 601 bp, Human; identical to SEQ ID NO: 23618

SEQ ID NO: 69793 - DNA, 601 bp, Human; identical to SEQ ID NO: 23619

SEQ ID NO: 69794 - DNA, 601 bp, Human
tcagacccagtaatatgctgtacctgtaaggggtagataaggcattggagtgttaactagcttgctcaaagacaagagacagagtataatgaagaatttactctagttattatgagttctctgaatgtcacaaagggaagggtccttaaatatcagctaatctatggttcccaaatgctgattaggtagactctatgatgaggtttttagcaatccatatcaaaataaaaaaaaaacaataaaagcagtgtggttagttttaatgtaaattatctcagacacacacacacagacagacagccacacacacacacacacacacacacaatttctgagaccatctgagaccatttcctgccttcacttccatttctacttttaaatacaccttctttaaaaaatgattatgatagcagatggcaggctcttcttttgttaggtttggtattgactttaatgagaaattaactcgttcaacattcaaaattttacttatcccagaaatcagagaattttaaggcagtctaatcttctcatttcataggtaaggaaacagaaacccaaagaagttaaatagcttatctaaggtgcctcatggcta

SEQ ID NO: 69795 - DNA, 601 bp, Human
catttcttccatgaaagttacagaaaacgtacctgaagctacctatttctgagtcttttccaaatatttttttatttataatatcactgctccattgatagttggggttgcaggtggaatcttgttcttaattcagtgaccacctatctttataagtttaagtatcaaaatacaagtaattctgaacttacataaatatgttacataaatgtgtaactcttatagacacagttcccatagaaataacaagagttaagtgttttcagtgatgaacggtaaaacaccagaacagctaccttgyaggaggttgcttaatgacactgtacagttgtaatcactgccattttcggaaatgtcaatttgctaatttcatgcaattaggaatggtagatttctgccaaatctttgttaattggtgttctccaacccagaaaagacaaacttcttttcatttggaacgtagttactacattttatcattccttcttgggcaccttcatcacagtcctaatttccacttacgcttgcttttattcattggcgaacttaaattctagtgactctcaacattttgtcaatgcgaaactgcagataaaatttc

SEQ ID NO: 69796 - DNA, 601 bp, Human
attactctagccaaatcatcagtaataaagatctttttgatacacctaaccctgtcacagatctacagttaaaatcatataaacatataatcaacttgtggcaggatcttgaaaatttatccaacattttgggataacggttcttttagttttcattggaatgccaaaacaatatccatttcagttgatattttatgaccaatagatatatggctagttagaatgaaataaattgggtagtatgacatatctgaaattaattttatgaagcattacttttggactttagattttggtctarctgagtgtattattgtttttagtttgtaaatgtaaattcattgaattaccaaatggtcctggtattaaaaaatattttagtagtcattcagctagtcatataaggatgaaccagaattatacaaaaggcagttatttttgaataaatcatcatgaatcataatagagaaaattattaaataaggccttttgcctttctttttttcattgtttcatattgaagtaggacatcaagtaaaaatttgatattctattaactcaaattaatgtgatcatttctgtattttaagactgcataaca

SEQ ID NO: 69797 - DNA, 601 bp, Human; identical to SEQ ID NO: 23620

SEQ ID NO: 69798 - DNA, 601 bp, Human; identical to SEQ ID NO: 23621

SEQ ID NO: 69799 - DNA, 601 bp, Human; identical to SEQ ID NO: 23622

SEQ ID NO: 69800 - DNA, 601 bp, Human; identical to SEQ ID NO: 23623

SEQ ID NO: 69801 - DNA, 601 bp, Human; identical to SEQ ID NO: 23624

SEQ ID NO: 69802 - DNA, 601 bp, Human; identical to SEQ ID NO: 23625

SEQ ID NO: 69803 - DNA, 601 bp, Human; identical to SEQ ID NO: 23626

SEQ ID NO: 69804 - DNA, 601 bp, Human; identical to SEQ ID NO: 23627

SEQ ID NO: 69805 - DNA, 601 bp, Human; identical to SEQ ID NO: 24259

SEQ ID NO: 69806 - DNA, 601 bp, Human; identical to SEQ ID NO: 24260

SEQ ID NO: 69807 - DNA, 601 bp, Human; identical to SEQ ID NO: 24261

SEQ ID NO: 69808 - DNA, 601 bp, Human
aatccctatgaaaatcctagcaggataaacttcaaaaacattatttgatgtgaaagaaaacagataaaaaaggtgacatattatatgacatcatttatatgacatttcaagaaaaggcaaaattatagtgacagaaagcagatcaatagttgcttgggggtgggtctgcaaatgggcataaaggaaattttgaggatgacaagggtgttctaaagctggattgtgatgatggtttcacaactgtatatatttactacactcatcaaactgcacagctgcaatatgtgaatttatggcacaktaattatgtctcaataagggagttttttaaaaagtaaagattcacttaccattgtagccttcaagtacagaatcaataataggtcttgcagttaagttataaacatcaagttgtttactctctggtccaaaaacagtatcaaaagtaaatgtctttggaggttcattggaagaatcagtcttatgtacagtgatagttcccctcatctcatccacactgacagcctgtttgtagcacattgatttctctctctcattgaggggccggcacctaacaacaaccttcacattatcgcagctt

SEQ ID NO: 69809 - DNA, 601 bp, Human
attgctgatgggaatataaaatggtgtagctactgtagaaaagtttggcagctcctcaaaacattaaacaaagttaccatgtgacctagtaattccactcttaggtatatacccaagagaaactaaacatatgttcacacaaaaatctgtaaaagaatgttcaaagtaacattatctgtaatagctaaaaagtagaaacaacaaatgttcaccaactaataaatggataaacaaaatatgatatatctatacaatattattcagacataaaaaataatgaattgctggcctagtgcaatgrctcacgcctgtaatctcagcactttgggaggccgaggcgggtggatcacaagatcaggagttcaaaaccagcctggccaatatggtgaaaccccgtctctactaaaaatacaaaaatcagccaggtgcagtggctcacgcctgtaatcccagcactttcagaggctgagacaggcggatcacaaggtcaggagatcaagaccatcctggctaacacggtgaaaccccgtctctactaaaaacacaaaaaattagctgggtgtgttggcgggcgcctgtagtcccagctactcaggaggct

SEQ ID NO: 69810 - DNA, 601 bp, Human
agggaacttcctcaaacctacaaaggatatctgttaaaatttacagacatcatcatactggtgaaagaatgaatgcattttccctaagatcaggaacaagaccaaaatgtccactctcaccacttctaatttactggaggttctagcctccaggtgctatcaggtaacaaaaataaattaaaggagattggaaaggacaaagtaaaaactgtctttacttgcaaacaacatttttttttttttttgagacagagtcttgccctgtcacccaggctggagtgcaatggcacgatcttggttsactgcaacctccgcctccgaggttcaggcgattctcctgccccagcctcccgagtagctgggattacaggcacgtgccaccatgcctggctaatttttttatttttagtagagacagggtttcaccatgttggtcaggctagtctcgaactcccgacctcgtgatctgcctgcctcggcctccaatgtgctgggattacaggcgtgagccactgtgcctggccaacatattcttacaagtagaaaatcctacaaaatttacaaaaaacccaaaacataaaaaaactactagaattaataa

SEQ ID NO: 69811 - DNA, 601 bp, Human
acattgggtacagtgtacactgcttgggtgatgggtgcaccaaaatctcagaaatcaccactgaagaacttattcatgtaactaaacaccacctgttccccaaaaacttattgaaattaaaactaaatttaaaaaaaaattagccagacatggtgggatgctcctgtagtctcagctactgggaaggctgaagcgagagaatcacttgagtccaggaggctgaggctgcaatgagccgttatagtgccactgcaccccagcctgggtgacagggtgagaccttgtcttgaaaaaaacaaaacaaacagaaaacaacaacaacaacaaaactatattctgggtcataaaacaagtcttaataaatttaaaaacattcaagccataaaaaatatgttctctaaattgagattaaattagaaaccaataaccaaaaatctctagagaatttaaaaatatttggaaactaaataacacatttctaaataacccaggatcaaagaataaatcaggaggtaaaatagtattttgaactacatgaaaatgaaaacatagtatgtcaaaatctgtgggatgacactaaaacagtactcagtggcaattt

SEQ ID NO: 69812 - DNA, 601 bp, Human
ttttaaaatgtcaacagatactgttaacaatgcccttcaaataggctgcaccaatttatattccatcctcagtgcccatttcttcaaagtctcaccaacctacatatccttcatctaatctgatgggtgaaacatctctctctatcttgttttagcattttcctgattagttgtgaagttaaacagcctttcacatacttattgctgtgcttagttcttctacgaataacatacatattttttgctaatttttctattaagatttggtctttttctattaattggttcataagaatgtaaytgatttttgaagttttgttgtttgatttccttgggtttgatatatctatcatcaagtcacagaaacttataaaaatttttcatttcctatttctcatcttttacctctaatccctctttttttcttttttttttggttgctgtgttgcccaagttggagtgcagtggcgcgatctcggctcactgcaacttctgccttcctggttaaaacgattctcctgccacagcctcccgagtaactgggattacaggcacccaccaccactcccagctaatttttgtatttttagtagagacgggg

SEQ ID NO: 69813 - DNA, 601 bp, Human
ctgatacattctacaacacggatgacccttgaaggcattatactaaatgaaataagccagtcacaaaaagacaaatgctgtatttcactttctttttttttttttttttttttttttgagatgggagtctcactctgccacccaggctggagtgcagtggcataatctcggctcattgccacctccaccttccaggttcaagtgatcctcctgcctcagcctcccaagtagctgggattacaggcgagagccaccatgcccagctaatttttgtattttcagtaaagatggggtttcaccrtgttggccaggctggtctcgaactcctgacctcaactgatccacccgcctcggcctcacaaagtgctgggattacaagcgtgagccactgcgccccaccaattccgctttcgtaagatacccagagcagtcaaattcatagacaaagcagaatggttgttggccaggaactaggggaagggaggaatgggtacatactgtttttaatgagtacaaagtttcaattttgcaagaagaaaactgaagacggataactgcagaacaatgtgaatgtaatgccacagaaatgtagacttaaatg

SEQ ID NO: 69814 - DNA, 601 bp, Human
gcactggaaggaaaactggccaaatttgaataaagtccacagattagttaataagactatatcaatgtaaatttcctggtttcaataactgttgtatgcttataaaagatgttaacatgaggtgaagctgggtgaagggtagataggaactctccatatcatgtttgcaagttgcatatagcctacaataatttttaagtttaaaaattattattttaatgctattgcctacttttttattgttgatatgatcaactccattaactagattataaaaagaaatgtcataagagcaaaaatraactgaaatgtattaacaacagtattatcatagaatccagcaattccattgctgggtacataccccaaaaatggtaaaacaagaattcaaacaggtattagtatacccacgttcatagcagcattattcacaatagccaaaaggtggaaagaaccaactgtccattggtggatgaatggataacaaaatgtagtatatacacaatggaatgttattcagaattaaaaagaagtcctgatacattctacaacacggatgacccttgaaggcattatactaaatgaaataagccagtcacaa

SEQ ID NO: 69815 - DNA, 601 bp, Human
tccagcctggcaacagagcgagactctgtctcaaaacaaaaaacaaacaacaacaacaacaacaacaacaaaacaaagaaagcatgacaaataaatgcagtgtgtgatcctggattgtatcctggaccaggaaaaagaggcactggaaggaaaactggccaaatttgaataaagtccacagattagttaataagactatatcaatgtaaatttcctggtttcaataactgttgtatgcttataaaagatgttaacatgaggtgaagctgggtgaagggtagataggaactctccatatcaygtttgcaagttgcatatagcctacaataatttttaagtttaaaaattattattttaatgctattgcctacttttttattgttgatatgatcaactccattaactagattataaaaagaaatgtcataagagcaaaaataaactgaaatgtattaacaacagtattatcatagaatccagcaattccattgctgggtacataccccaaaaatggtaaaacaagaattcaaacaggtattagtatacccacgttcatagcagcattattcacaatagccaaaaggtggaaagaaccaactgt

SEQ ID NO: 69816 - DNA, 601 bp, Human
atcgcttgaacagggaggcagaggttgcagtaagctgagactgtgccactgaattccagcctggcaacagagcgagactctgtctcaaaacaaaaaacaaacaacaacaacaacaacaacaacaaaacaaagaaagcatgacaaataaatgcagtgtgtgatcctggattgtatcctggaccaggaaaaagaggcactggaaggaaaactggccaaatttgaataaagtccacagattagttaataagactatatcaatgtaaatttcctggtttcaataactgttgtatgcttataaaaratgttaacatgaggtgaagctgggtgaagggtagataggaactctccatatcatgtttgcaagttgcatatagcctacaataatttttaagtttaaaaattattattttaatgctattgcctacttttttattgttgatatgatcaactccattaactagattataaaaagaaatgtcataagagcaaaaataaactgaaatgtattaacaacagtattatcatagaatccagcaattccattgctgggtacataccccaaaaatggtaaaacaagaattcaaacaggtattagtatacc

SEQ ID NO: 69817 - DNA, 601 bp, Human
gtagtcccagctactcaggaggttgaggcaggagaatcgcttgaacagggaggcagaggttgcagtaagctgagactgtgccactgaattccagcctggcaacagagcgagactctgtctcaaaacaaaaaacaaacaacaacaacaacaacaacaacaaaacaaagaaagcatgacaaataaatgcagtgtgtgatcctggattgtatcctggaccaggaaaaagaggcactggaaggaaaactggccaaatttgaataaagtccacagattagttaataagactatatcaatgtaaatytcctggtttcaataactgttgtatgcttataaaagatgttaacatgaggtgaagctgggtgaagggtagataggaactctccatatcatgtttgcaagttgcatatagcctacaataatttttaagtttaaaaattattattttaatgctattgcctacttttttattgttgatatgatcaactccattaactagattataaaaagaaatgtcataagagcaaaaataaactgaaatgtattaacaacagtattatcatagaatccagcaattccattgctgggtacataccccaaaaat

SEQ ID NO: 69818 - DNA, 601 bp, Human
caaaccattctggctaggcaaggtggcgcacgcctgtaatcccagcactttaagaggctgaggcaggcagatcacttgaggccaagagtttgagaccagcctggccaacatggcaaaaccccatctctactaaaaatacaaaaattagctgggcttggtggcatgcacctgtaatcccagctacttgggaggctgaggcaggagaatcacttgaacccaggaggcagaggttgcagtgagccgagatggcaccactgcactccagcctcaacaacagagtgactctgtctcaaaaaaaaaataaaaatattcaaatcatttctttatgtataattttaaatatatatataaattatgtggtagagttactaattcagtcttttaaaaatgtgatcacttttgaggaacaatttcttctaaaacagcttcctgtttaagatttcaaataattcattcaatctgtatttttaagagacacagaactgtcatgtaacaatgatcccacttttaggactgtatcacaagatattttcaaaaaaagaagtgcttatttgtacaaagacagtgttaactacacattaacttaaagataaaaaacaaa

SEQ ID NO: 69819 - DNA, 601 bp, Human
acaggagaaaaaatgcaaagttaaccaggtaaatggcatacatcttctgttctaattgttatctaatatattaaacagataacggcaaaataaaagtcatgcactctaccaccttgtgaaaccacctaatttctacaaatcagattactaaacagaacttaccccttctttttttccttttctctccatcttctccaacctcaccctcttcatcatcatcttcctctgacccactgatatcagagcctgatatttcttctccttggacagaaatttaatacaatgttttttatcctgtacsaagtcattagctatttaggaaatacctatatcagctttcttcctcagatttttgttactgcaaacaacaaatttaaatactatttaaatgctcctagaaagtataacagatatgccaatctcagacacagatgagatatccaaaaagactttatttttaaagtctctaaagagaagttaaattctgacccacttaaaatttcaaaccattctggctaggcaaggtggcgcacgcctgtaatcccagcactttaagaggctgaggcaggcagatcacttgaggccaagagtttgagaccag

SEQ ID NO: 69820 - DNA, 601 bp, Human
aacaggtggtgagctggatttagccagcagacattttgccaatttttgccataaatcattatttttctgtcttttgaagttacaaaatctttatagtttttaaatttgggactcctaatcaagcagtgatgggtttatttttagcacaatcattttaataagacaaacaaaatatgcaccagcttgaaaacaatgaccacattaatggaagagagttctgaaataaatatttatggtaaaaaggtttgaaatgtaggccattataatatgtccatttcatttgcatattatctatattctkatcataataaacagtcttaattcacacgtggcaacaaatcccccacaacagagtgagaatgagaatacattttataaagaaaaagaactaaatttaaaaatggaattcctcatacaaatttactatttaaaaattcaatgacttttaaagactaatcttgtttgtggaaaaactccacattatcctaatttccttaaaatacttaggttccagccaggcatggtggctcacgcctgtagtcccagcactttgggaggccgaggcagatggatcatgaggtcaggagatcaagaccagcct

SEQ ID NO: 69821 - DNA, 601 bp, Human
atgaaagggggtggaggaatcatcacatgctttgttctactgaggaatccaacatgtattctttaggtaatgacagggagtggtgcagcattgctcaaatgaagcccatgggttatggaaaagccaaagctctgttagagaatgtaagagctaccactcactaggcaagaacttatccagaggtttctctatgacagaacatgtggagtctgaactactgctgctgctactgcctggaaaacaaagaaatgagcccaacaggaaccaaagaaagaggaaacaagaaaatgaacacacacasagagaaaaattcagttttcagagaaaaaaattttaaaggacaatcaagctttgtattaaagaaccaaaatttactttcctaaaaaccaatcttggtagtttatccaatattctctactttacaaagccatacagaggaattagaaagtgtactgctttaagcaactactgtgggcagatcctactggtcacctaaagcctaatcattcaaagggttgaaatgacaagaataaaaaataaagaagtcatttggtgagattttagtctactgaaactatttaggttgataagttaaaggaat

SEQ ID NO: 69822 - DNA, 601 bp, Human
ccacgtgattctgcattctctaatcataccttagaaaatctcttaaaatcagccgggcgcagtggctcacgcctataatcccagcactttgggaggccgaggcgggcagatcatgaggtcaggagatcgggaccatcctggctaacacggtgaaaccccgtctctactaaaaatacaaaaattagccaggagtggtggcgggcacctgtagtcctagctactcgggaagctgaggcaggagaatggcgtgaacccgggaggcggagcttgcagtaagccaagactgcgccactgcactccrgcctaggcaaaagagcaagactccgtctcaaaaaaaaaaaaaaaaaaagaaagaacttttcttaaaatctatcaggtaatacagaaatatggataaatgtccatttgaaataaaacactattcaattcatctttacttgcttcaagctttatgtttttctttatttgggagcctttaatcttaagctaccactaagaataggacaccaaagtgtaaaaaatttgtaattgtacgacatgttataatgggcactggtgtacttcaaatataatttgtacttttagaaatacaagatttgat

SEQ ID NO: 69823 - DNA, 601 bp, Human
tctagatggatcctgcataaaatccacgtgattctgcattctctaatcataccttagaaaatctcttaaaatcagccgggcgcagtggctcacgcctataatcccagcactttgggaggccgaggcgggcagatcatgaggtcaggagatcgggaccatcctggctaacacggtgaaaccccgtctctactaaaaatacaaaaattagccaggagtggtggcgggcacctgtagtcctagctactcgggaagctgaggcaggagaatggcgtgaacccgggaggcggagcttgcagtaagycaagactgcgccactgcactccagcctaggcaaaagagcaagactccgtctcaaaaaaaaaaaaaaaaaaagaaagaacttttcttaaaatctatcaggtaatacagaaatatggataaatgtccatttgaaataaaacactattcaattcatctttacttgcttcaagctttatgtttttctttatttgggagcctttaatcttaagctaccactaagaataggacaccaaagtgtaaaaaatttgtaattgtacgacatgttataatgggcactggtgtacttcaaatataatttgta

SEQ ID NO: 69824 - DNA, 601 bp, Human
aagtctagatggatcctgcataaaatccacgtgattctgcattctctaatcataccttagaaaatctcttaaaatcagccgggcgcagtggctcacgcctataatcccagcactttgggaggccgaggcgggcagatcatgaggtcaggagatcgggaccatcctggctaacacggtgaaaccccgtctctactaaaaatacaaaaattagccaggagtggtggcgggcacctgtagtcctagctactcgggaagctgaggcaggagaatggcgtgaacccgggaggcggagcttgcagtragccaagactgcgccactgcactccagcctaggcaaaagagcaagactccgtctcaaaaaaaaaaaaaaaaaaagaaagaacttttcttaaaatctatcaggtaatacagaaatatggataaatgtccatttgaaataaaacactattcaattcatctttacttgcttcaagctttatgtttttctttatttgggagcctttaatcttaagctaccactaagaataggacaccaaagtgtaaaaaatttgtaattgtacgacatgttataatgggcactggtgtacttcaaatataattt

SEQ ID NO: 69825 - DNA, 601 bp, Human
caaattgtcaatagagaaggagatttctaatattcttggaattattcttctagaaagctaaaagcataagaacaataagcaattatttttgtcattagttttgaaagggtaagtatatagataatgctttaaaagacagtaagctgcaggctggtacaagaaagcaacactactcccctttcttctgaaaataaaatataaataaattaaattaaataacacttttcaacttaattaaattgttttaacaaaagcctttaagtttgaaataagtctagatggatcctgcataaaatccacrtgattctgcattctctaatcataccttagaaaatctcttaaaatcagccgggcgcagtggctcacgcctataatcccagcactttgggaggccgaggcgggcagatcatgaggtcaggagatcgggaccatcctggctaacacggtgaaaccccgtctctactaaaaatacaaaaattagccaggagtggtggcgggcacctgtagtcctagctactcgggaagctgaggcaggagaatggcgtgaacccgggaggcggagcttgcagtaagccaagactgcgccactgcactccagcct

SEQ ID NO: 69826 - DNA, 601 bp, Human
actcagatcctggtcaaagaaaagccctcttgggttttacttagctttggcatagtgcctggaacgtaggaggcactcaataaatgcctgttgaatgagagaatttttctggcccatacatttctgaaaaaccaaatactctcacagaaacagatattgagatgacaggttgagggagctttcattttgtctaagagacttcctatggcaacagaaaaggtatcgccagagcccctcctcttccacagcctggccacctaacagccctctgggttccggggctggccgtccagagctcctyagcttgctctggccggccgaactcccctccagctcggtctggaaccatcctgctgggcagcgtccagcacatccctgcttcgggctgcctgggcacctcgcctctctgcctcctgtgctgcctcacccccacccctctatctgtagtgggaggagatagatttgacagctgatagtgcattttctctgacaaacacatgactacagccgtatcaatagttttgtgcatttcagttcctgttttcatggaaacacacggctgagaatgaaagccccaaagcctcaatttcacagtggtctc

SEQ ID NO: 69827 - DNA, 601 bp, Human
ctacaaaggtggtatgcagaggaaaaggtacttctttgtgttcccaaagaaaacatctttccaaaatccagcctattgattttatttcttcgggggaacaagaattttagtatctctaagttgggtagcattctactcttggcagttgctggaaagaaggcactggtctaggtcctgggcttcacaggtaacacctgtcagggtgtctatgaagtcaaggctgtctgaggaacagcaaagtgggaagaagcaagctggctggctgatgaagggtttcttgggtggacaagtagttggagckatttcctatttaccaaagagagctaaagttcataattctacagagagttccataatgaacctcaaatacctctgttttttgaaggagtttctcatatacagcactagctgactatcctgggcaggatgggagataatgaatgcagtgccaatcgggctggatttatatggtcctcagtgaggctggtcaagaaccgagttagaactctcacagagtcactgccacagaagaaatctcccaagtggctgtttcctgacattcccgggagggacaggcctccttctgagtcactccctaagc

SEQ ID NO: 69828 - DNA, 601 bp, Human
gcccccagagcccaaagatactgacacactcttacatttccaactagaatcaggaacgaggagtgactctcagtcagttcattaagtaaatgtctttctaaccgctctgcccatgggacatcacgccccacaggggaaaggggaagcttctgtagcctgggattctggtgcctcagtctgggtctagactttcctgaaaaaacgttaaaatatgaactgcattcctagaatttagcctacataaataagagatgaacacaaagatttctatagtttactcactgccgcttatttacagaascaaaaatctgccacgataggggcctgacaaatgacagtaccactgtgcaatgcgtttctacgcagctctcaatcccatgttctctaataccaccgaagggcttaggaaatgcttatggtatatgtaaagagtaaagaagttacaaaacagtatcaacagttgacccctattttaaaaagtatttttaaaagtgtgacgatatttaccaaaatattaacagcaatagttacctctggctggtgggatgagtgaatgtatttttgttgaatatatgttacctttatagtaaatatatgttat

SEQ ID NO: 69829 - DNA, 601 bp, Human
ttcattaagtaaatgtctttctaaccgctctgcccatgggacatcacgccccacaggggaaaggggaagcttctgtagcctgggattctggtgcctcagtctgggtctagactttcctgaaaaaacgttaaaatatgaactgcattcctagaatttagcctacataaataagagatgaacacaaagatttctatagtttactcactgccgcttatttacagaagcaaaaatctgccacgataggggcctgacaaatgacagtaccactgtgcaatgcgtttctacgcagctctcaatcccmtgttctctaataccaccgaagggcttaggaaatgcttatggtatatgtaaagagtaaagaagttacaaaacagtatcaacagttgacccctattttaaaaagtatttttaaaagtgtgacgatatttaccaaaatattaacagcaatagttacctctggctggtgggatgagtgaatgtatttttgttgaatatatgttacctttatagtaaatatatgttatcttgatcatcagaaaaaaaaatatgtaagaacttgaaagctgcttggacagcgctgctgatagaaacccctgagcat

SEQ ID NO: 69830 - DNA, 601 bp, Human
cctagaatttagcctacataaataagagatgaacacaaagatttctatagtttactcactgccgcttatttacagaagcaaaaatctgccacgataggggcctgacaaatgacagtaccactgtgcaatgcgtttctacgcagctctcaatcccatgttctctaataccaccgaagggcttaggaaatgcttatggtatatgtaaagagtaaagaagttacaaaacagtatcaacagttgacccctattttaaaaagtatttttaaaagtgtgacgatatttaccaaaatattaacagcartagttacctctggctggtgggatgagtgaatgtatttttgttgaatatatgttacctttatagtaaatatatgttatcttgatcatcagaaaaaaaaatatgtaagaacttgaaagctgcttggacagcgctgctgatagaaacccctgagcatcttgtcactgttcttctgattcagagggtctgggtggggcaggggtggtctgagattctgtatttctaagaagctcccagtgatgtccatgctgctggtccatggaccacactttgagtatcaagggaccagagcatgtcggggga

SEQ ID NO: 69831 - DNA, 601 bp, Human; identical to SEQ ID NO: 26459

SEQ ID NO: 69832 - DNA, 601 bp, Human; identical to SEQ ID NO: 26460

SEQ ID NO: 69833 - DNA, 601 bp, Human; identical to SEQ ID NO: 26461

SEQ ID NO: 69834 - DNA, 601 bp, Human; identical to SEQ ID NO: 26462

SEQ ID NO: 69835 - DNA, 601 bp, Human; identical to SEQ ID NO: 26463

SEQ ID NO: 69836 - DNA, 601 bp, Human; identical to SEQ ID NO: 26464

SEQ ID NO: 69837 - DNA, 601 bp, Human; identical to SEQ ID NO: 26465

SEQ ID NO: 69838 - DNA, 601 bp, Human; identical to SEQ ID NO: 26466

SEQ ID NO: 69839 - DNA, 601 bp, Human; identical to SEQ ID NO: 26467

SEQ ID NO: 69840 - DNA, 601 bp, Human; identical to SEQ ID NO: 26468

SEQ ID NO: 69841 - DNA, 601 bp, Human; identical to SEQ ID NO: 26469

SEQ ID NO: 69842 - DNA, 601 bp, Human; identical to SEQ ID NO: 26470

SEQ ID NO: 69843 - DNA, 601 bp, Human; identical to SEQ ID NO: 26471

SEQ ID NO: 69844 - DNA, 601 bp, Human; identical to SEQ ID NO: 26472

SEQ ID NO: 69845 - DNA, 601 bp, Human; identical to SEQ ID NO: 26473

SEQ ID NO: 69846 - DNA, 601 bp, Human; identical to SEQ ID NO: 26474

SEQ ID NO: 69847 - DNA, 601 bp, Human; identical to SEQ ID NO: 26475

SEQ ID NO: 69848 - DNA, 601 bp, Human; identical to SEQ ID NO: 26476

SEQ ID NO: 69849 - DNA, 601 bp, Human; identical to SEQ ID NO: 26477

SEQ ID NO: 69850 - DNA, 601 bp, Human; identical to SEQ ID NO: 26478

SEQ ID NO: 69851 - DNA, 601 bp, Human; identical to SEQ ID NO: 26479

SEQ ID NO: 69852 - DNA, 601 bp, Human; identical to SEQ ID NO: 26480

SEQ ID NO: 69853 - DNA, 601 bp, Human; identical to SEQ ID NO: 26481

SEQ ID NO: 69854 - DNA, 601 bp, Human; identical to SEQ ID NO: 26482

SEQ ID NO: 69855 - DNA, 601 bp, Human; identical to SEQ ID NO: 26483

SEQ ID NO: 69856 - DNA, 601 bp, Human; identical to SEQ ID NO: 26484

SEQ ID NO: 69857 - DNA, 601 bp, Human; identical to SEQ ID NO: 26485

SEQ ID NO: 69858 - DNA, 601 bp, Human; identical to SEQ ID NO: 26486

SEQ ID NO: 69859 - DNA, 601 bp, Human; identical to SEQ ID NO: 26487

SEQ ID NO: 69860 - DNA, 601 bp, Human; identical to SEQ ID NO: 26488

SEQ ID NO: 69861 - DNA, 601 bp, Human; identical to SEQ ID NO: 26489

SEQ ID NO: 69862 - DNA, 601 bp, Human; identical to SEQ ID NO: 26490

SEQ ID NO: 69863 - DNA, 601 bp, Human; identical to SEQ ID NO: 26491

SEQ ID NO: 69864 - DNA, 601 bp, Human; identical to SEQ ID NO: 26492

SEQ ID NO: 69865 - DNA, 601 bp, Human; identical to SEQ ID NO: 26493

SEQ ID NO: 69866 - DNA, 601 bp, Human; identical to SEQ ID NO: 26494

SEQ ID NO: 69867 - DNA, 601 bp, Human; identical to SEQ ID NO: 26495

SEQ ID NO: 69868 - DNA, 601 bp, Human; identical to SEQ ID NO: 26496

SEQ ID NO: 69869 - DNA, 601 bp, Human; identical to SEQ ID NO: 26497

SEQ ID NO: 69870 - DNA, 601 bp, Human; identical to SEQ ID NO: 26498

SEQ ID NO: 69871 - DNA, 601 bp, Human; identical to SEQ ID NO: 26499

SEQ ID NO: 69872 - DNA, 601 bp, Human; identical to SEQ ID NO: 26500

SEQ ID NO: 69873 - DNA, 601 bp, Human; identical to SEQ ID NO: 26501

SEQ ID NO: 69874 - DNA, 601 bp, Human; identical to SEQ ID NO: 26502

SEQ ID NO: 69875 - DNA, 601 bp, Human; identical to SEQ ID NO: 26503

SEQ ID NO: 69876 - DNA, 601 bp, Human; identical to SEQ ID NO: 24262

SEQ ID NO: 69877 - DNA, 601 bp, Human; identical to SEQ ID NO: 24263

SEQ ID NO: 69878 - DNA, 601 bp, Human; identical to SEQ ID NO: 24264

SEQ ID NO: 69879 - DNA, 601 bp, Human; identical to SEQ ID NO: 24265

SEQ ID NO: 69880 - DNA, 601 bp, Human; identical to SEQ ID NO: 24266

SEQ ID NO: 69881 - DNA, 601 bp, Human; identical to SEQ ID NO: 24267

SEQ ID NO: 69882 - DNA, 601 bp, Human; identical to SEQ ID NO: 24268

SEQ ID NO: 69883 - DNA, 601 bp, Human; identical to SEQ ID NO: 24269

SEQ ID NO: 69884 - DNA, 601 bp, Human; identical to SEQ ID NO: 24270

SEQ ID NO: 69885 - DNA, 601 bp, Human; identical to SEQ ID NO: 24271

SEQ ID NO: 69886 - DNA, 601 bp, Human; identical to SEQ ID NO: 24272

SEQ ID NO: 69887 - DNA, 601 bp, Human; identical to SEQ ID NO: 24273

SEQ ID NO: 69888 - DNA, 601 bp, Human; identical to SEQ ID NO: 24274

SEQ ID NO: 69889 - DNA, 601 bp, Human; identical to SEQ ID NO: 24275

SEQ ID NO: 69890 - DNA, 601 bp, Human; identical to SEQ ID NO: 24276

SEQ ID NO: 69891 - DNA, 601 bp, Human; identical to SEQ ID NO: 24277

SEQ ID NO: 69892 - DNA, 601 bp, Human; identical to SEQ ID NO: 24278

SEQ ID NO: 69893 - DNA, 601 bp, Human; identical to SEQ ID NO: 24279

SEQ ID NO: 69894 - DNA, 601 bp, Human; identical to SEQ ID NO: 24280

SEQ ID NO: 69895 - DNA, 601 bp, Human; identical to SEQ ID NO: 24281

SEQ ID NO: 69896 - DNA, 601 bp, Human; identical to SEQ ID NO: 24282

SEQ ID NO: 69897 - DNA, 601 bp, Human; identical to SEQ ID NO: 24283

SEQ ID NO: 69898 - DNA, 601 bp, Human; identical to SEQ ID NO: 24284

SEQ ID NO: 69899 - DNA, 601 bp, Human; identical to SEQ ID NO: 24285

SEQ ID NO: 69900 - DNA, 601 bp, Human
ccaaacattctgtgagtggggagaagcaaccagagagactgggcgctgaggcccagaaccacagtgagaggctgcaccttggacacctcaggggcagtttaagtacaagccaaaggaaatcctagttcatttaacagagactaaattatggaacctaatgtcagatgagacacaggctgagaacaagcagcagaccccaaaaacatcctataaattcttaggtggacaatggatctccacaaagtctgggacatttaagaatgccccaagctacaacgtaacggactccagcccttgctcytaggacaggatttcctacaagagggctggggctgtgaggccccaggtagtctattatcaagaagcacaaatctcgggtgtcactctacagcaaaagacaacagtcacagtcttgggagggatcccaatgctctcctgcaccatctctcttttttattttttttttaagatggagtctcgctctgtctcccaggctggagtgcagtggcacgatcttggctcactgcaacctctgcctcccaggttcaagcgattctcctgccttagcctcccgagtagctgggactacaggcgcgcgcca

SEQ ID NO: 69901 - DNA, 601 bp, Human
tagagtaccccaatgcagagctttcgacaggatacaagggcctatcacatgccacagacaatgcctcagctaagctgtcaccaagtctgcctgctgagctctcagagaactagggtgatccagtatgacagcatctttgggatgaggcccccagccaactcactccatccttgctacgtggcttcattggctgggccacacagtggacactcggctgtgtaagaacaaggaggccctaaaagaaaagaattcaaagaccaaacattctgtgagtggggagaagcaaccagagagactgggygctgaggcccagaaccacagtgagaggctgcaccttggacacctcaggggcagtttaagtacaagccaaaggaaatcctagttcatttaacagagactaaattatggaacctaatgtcagatgagacacaggctgagaacaagcagcagaccccaaaaacatcctataaattcttaggtggacaatggatctccacaaagtctgggacatttaagaatgccccaagctacaacgtaacggactccagcccttgctcttaggacaggatttcctacaagagggctggggctgtgaggcccc

SEQ ID NO: 69902 - DNA, 601 bp, Human
gggattataggcatgagccatcgcacaggcctgcacctcacttttgttttccctcaccctggctgccctgcaattacaccttccaataaagcattaagtacttaagctctgtctcaggctgtttcctgggaacatagtctgagataagcactatttgtttccaaaaatctttcatttctactatctaattctcacccaaaccttctaagctagataactacctccatttcagatataagatagatacaaatgacaaacagctgaggctgagagaaggtttcctacatatctgacatctgayagcaaatcaatgacagaaccaagagtcaaacccaaaacacactctgctagatattgcagctatccagtcctactcaataatctgttaccttaaagtgcaatggactcccaaacagggaagccacactttgcccaggaagaacatgcctgcccaggttaaggactttatcatgggttacaccaaaggttcataaagcaggtccatgacacgcctggctggatctcaccagagggaggaacgcaacatggacccagaaaacagcaacatggtcccttaagttcagatgggcagtcactccta

SEQ ID NO: 69903 - DNA, 601 bp, Human
tccatctcgacctcccaaagtgctgggattataggcatgagccatcgcacaggcctgcacctcacttttgttttccctcaccctggctgccctgcaattacaccttccaataaagcattaagtacttaagctctgtctcaggctgtttcctgggaacatagtctgagataagcactatttgtttccaaaaatctttcatttctactatctaattctcacccaaaccttctaagctagataactacctccatttcagatataagatagatacaaatgacaaacagctgaggctgagagaagktttcctacatatctgacatctgacagcaaatcaatgacagaaccaagagtcaaacccaaaacacactctgctagatattgcagctatccagtcctactcaataatctgttaccttaaagtgcaatggactcccaaacagggaagccacactttgcccaggaagaacatgcctgcccaggttaaggactttatcatgggttacaccaaaggttcataaagcaggtccatgacacgcctggctggatctcaccagagggaggaacgcaacatggacccagaaaacagcaacatggtccctta

SEQ ID NO: 69904 - DNA, 601 bp, Human
ccttactatactgtcttctctatcccaggatttcagaaggcttctctcttgcttacacaagccccttatacctaagggattgggtgtctgtttcttgttcctcaaaaggcttgactggctcaggctcagcaccttctgtatgtatgtagggaggggacagtgaaaacatagagctgggaggatgtatctgtgatcagaaagggaccagctgactgctcctcagagctggggtggtgggagaacagggcccaggcaggttccaaaccagacatggttggaagtggggaacccagcatctctmcccaggtgtgtctccagttgcagttgcatacctttttagaggccagataaattccagggaggaagtctgtccattcctttcaaatcattctgctcctatcatctacggttcatacctcacaacactcagggaaagccaggtttcttcattacatgaataccagctgtgatttctctggaatgtgcgatctggcttagactgagcccattcttgaatctcagcctggaggcagagcctcaaagaatcacagatagggtttgggcagagcctcaaagaatcacagatggggtttgggcagag

SEQ ID NO: 69905 - DNA, 601 bp, Human
ctggttctagccacaggtctgctccaaggccttactatactgtcttctctatcccaggatttcagaaggcttctctcttgcttacacaagccccttatacctaagggattgggtgtctgtttcttgttcctcaaaaggcttgactggctcaggctcagcaccttctgtatgtatgtagggaggggacagtgaaaacatagagctgggaggatgtatctgtgatcagaaagggaccagctgactgctcctcagagctggggtggtgggagaacagggcccaggcaggttccaaaccagacayggttggaagtggggaacccagcatctctacccaggtgtgtctccagttgcagttgcatacctttttagaggccagataaattccagggaggaagtctgtccattcctttcaaatcattctgctcctatcatctacggttcatacctcacaacactcagggaaagccaggtttcttcattacatgaataccagctgtgatttctctggaatgtgcgatctggcttagactgagcccattcttgaatctcagcctggaggcagagcctcaaagaatcacagatagggtttgggcagagcctc

SEQ ID NO: 69906 - DNA, 601 bp, Human
agctgtggaaccagaggaaaaggaagactaatgcgtccacccacataggtcttgacctgtgacaattttcctagtgagaattccctggtgccaggttctggggcccttttcatcaagaggcaatgaaaaatgaatacagtaactccccacagatacttctagccccttaatctagataacagctgggacccccaatgtaagggaaaaggtcttaaatagaaaataaacagtgactccttagcccatgtacttagctcctctcaagcactggcatgaagtaaccaggccagccccacatcamcctctcaaaggtttcctcttataggcaccctggatggcttccttgttccttgaggggcagaagggaaggaaggccaactaaggatggttggggacttaggacacctcttaatcttggaaagcttggcttcctccacaaggatgtactctttcagagactgcaccagctctttctctgcataaatcaggtcagtcatgtgccctgcaagggagagaagaaagacaccagtgagaaacagatgagggatgtccagcctccttccttggggcacagaataccagcacagaagcaagtcccctg

SEQ ID NO: 69907 - DNA, 601 bp, Human
gtaatcagaagtatacaccaagaaatatgtaaaaaggtgctgataattcagaaaaaatcccatatccaatgacttgacccatttgacagtattatcagtatgacagattatcaccatctgacaggtaatcaccatccagccattaaaatcatgttgcagaagaacattgaatggcatataaagaagctgagaaattcacagaattttttcttctgtcacaaatctaccaacagatatgctttgtttgtaaaacatatgaataggaatgaatttagatcagacctatgctccccaacttgcsctggccccaccatccagcccacttgacacttgtaaattcattgtccctccaagcaactgagtttgcatgccctggtatgtatgtatagttccattttttaaatgtatatgcataggtagaaaaactacaattttaataatgctcaccactgggcaactggattaagaattataattctcttgtttttgtgttttccgacttttctataaacatgtatcactaaagtataattggaaaaatgtcattagcaaaaaataagaaaagacagacactaaaaaaaagacgctaaaaaaagaactg

SEQ ID NO: 69908 - DNA, 601 bp, Human
ccatatgagtctagaggatggaaaaattagctgaatataaaaaacataaatttaggtggcaaccaagccatgggtgaggaaaatagcttgcaggaactctgaggaaagaatggagaagatgactaaggccagagctccagggagcacctacccagaaagaacagacaatgaataaccctgagaatgaactaaagataggagaaacagagggagcgggagtggtgtgagagacaccaagggaggccaagagccaaggttgcagtgccagctttggctgttaagtggcagggaccttgctgartatcagttcagtgggtcttatgaccaaaggtcatctgctgtagagggagtgctggaaagtgaccatgaagatagtttcaagccaatatgaagaagcagctatagggagatgcaggatttagggtgagctcaagatgggaaagactatgtgtgtggttcctcagagaataatgagaaagcagataccatggaggggaagtgggggctgtgactctccctggaaagcaaggaagactccccacagccccattaacagcaacctgggcatggctgacacaaaagaactcagagaaggctcttt

SEQ ID NO: 69909 - DNA, 601 bp, Human
tgacacagtgagcacagacagatggcccagccctgccctggactggggttcacagccacctcttagcctcagattccccatctcccaagtgggaaggggcctttttagggggagccccagaaacccaccaggaagcattgttgaggacagtgggaaggtcctgtggaccacagagaagaagatgtctggtgggcagtttgccatatgagtctagaggatggaaaaattagctgaatataaaaaacataaatttaggtggcaaccaagccatgggtgaggaaaatagcttgcaggaactctraggaaagaatggagaagatgactaaggccagagctccagggagcacctacccagaaagaacagacaatgaataaccctgagaatgaactaaagataggagaaacagagggagcgggagtggtgtgagagacaccaagggaggccaagagccaaggttgcagtgccagctttggctgttaagtggcagggaccttgctgagtatcagttcagtgggtcttatgaccaaaggtcatctgctgtagagggagtgctggaaagtgaccatgaagatagtttcaagccaatatgaagaagcagct

SEQ ID NO: 69910 - DNA, 601 bp, Human
gggagagcaggcggcgggtgagctccagggcacggtgcagatcacccaactggaagacagcatagctgaggtagtccagcacctgtgacttggttgtggtggcctcctccccggcatcaagctgctttagcacctgctccatccacaacaccgtatgataatagtccccttcattgtaggccgagcggcccatcccaaagcagtcatccacactcagcattgcctggtacttggttcctacagcaggggaagtaaattgtcaggctccaaagagcctctggattagggaaagagattcccrcttcaaggaaagcctgagccactggatagggggcatcaccaagcagaactccatcggacatttagactgcatatcctaaagggccactgacacagtgagcacagacagatggcccagccctgccctggactggggttcacagccacctcttagcctcagattccccatctcccaagtgggaaggggcctttttagggggagccccagaaacccaccaggaagcattgttgaggacagtgggaaggtcctgtggaccacagagaagaagatgtctggtgggcagtttgccatatgagtcta

SEQ ID NO: 69911 - DNA, 601 bp, Human
aaattattctgtaagggtttctctcccagcagctcacctgcatgctgcattctaccttccacagcatctaaccagagtacgctggtcgtaactggaaaaccaacagaggccaggtgcggtggctcatacctgcaatcccagcactttgggaggccgaggcgggtggatcacgtgaggtcacgagttcgagaccagcctgaccaacatggtaaaacctcatctctactaaagaaaatacaacatggggcatgtgcctctgtaatcccagccacctgggaggctgaggcaggaaaatctcatsaacccgggaggcggaggttacagtgagctgagatcgtgccactgctctccaggctggatgagtgagactctgtctcaaaaaaaaaaaaaaaaaaaggtagatgagttttaaaggcacagtgcttttggccttcttcagtccaacagcacaaggcacacaaagtatcaatgccatatgaagtcctactattagacctcaggcctctaatagcaccgctactgtttgtcactgtaacaatcctaaagtacaacctgactcctgagctgctcctgatgtagtaaaggttccaccctgtgtagt

SEQ ID NO: 69912 - DNA, 601 bp, Human
catttagagaaattattctgtaagggtttctctcccagcagctcacctgcatgctgcattctaccttccacagcatctaaccagagtacgctggtcgtaactggaaaaccaacagaggccaggtgcggtggctcatacctgcaatcccagcactttgggaggccgaggcgggtggatcacgtgaggtcacgagttcgagaccagcctgaccaacatggtaaaacctcatctctactaaagaaaatacaacatggggcatgtgcctctgtaatcccagccacctgggaggctgaggcaggaraatctcatcaacccgggaggcggaggttacagtgagctgagatcgtgccactgctctccaggctggatgagtgagactctgtctcaaaaaaaaaaaaaaaaaaaggtagatgagttttaaaggcacagtgcttttggccttcttcagtccaacagcacaaggcacacaaagtatcaatgccatatgaagtcctactattagacctcaggcctctaatagcaccgctactgtttgtcactgtaacaatcctaaagtacaacctgactcctgagctgctcctgatgtagtaaaggttccacc

SEQ ID NO: 69913 - DNA, 601 bp, Human
agagccacaggtcctgtctactcagcctcttggtccagggtatgaaatcagccaagcagactgtggtctttgatcaggaccatgaaagtcctgaagactggctctaacacagaggaagcagtggcagatgtctttaaaaacaaaaacaaaaacctgctccaagaagatatgaatcaagacaatgccaacagggactcatctagcacatcaagagtgcctatcactcttgaaatggtggtgctcttacacatacgcagcaagtgggagatgaggcagaagtcctccatggatgtgcttatckgcagaatttatttaaaaattacaaaacactaagttgagctgaactgaaaaaaaaattaaaatttcacagtactatttgcaaggtaatcagtatgctttttaaaactctggtagacttcacaccaatccataaagatgaccttcaaaattgattttccaattgctgatgcagctacacagaaaaaacaacaaaaagaaggctgatttgcttaggcgtgtccaagcaaaagttcaaaaaatcttttccaaatgatctttaatcaatattctaatgagatctatggtagatcagacccaaatg

SEQ ID NO: 69914 - DNA, 601 bp, Human
aggcagtgaaagaagctgcattgcgagagctggctcatcttttaggtttggagaattatatttgattatggttctgaagccaccgtacctactttctttaatacagttcccaaataagtacaaaatgcataggaccatctagatttgcagcagtaagattccctatccaggcatactcaagtccccaggctcacgcctttaataacaagaaactgtacgtcaagaccgattcatgtgaggaggtattcacttaaatctttagacttactattgtaagagtggggtcagttatttgaaagaygtgggtatttacaatgctaaggacagagtaaaggcaaaattaaaaaggtcagaaatcacttttctggtgaggctgagacatcatgcagccaaagtcttcaatctttagaatcctagaggtgtagcatctcttcctctctatcagataagccctcatccaattcaccagaaagcctcaattacctttttccttcaaatgatctacagcaaacatgtgagctacagctgaaagaatgtcaacagatagaagaaccagctcctttccagaggcctgcagcatttcctaaaggacctggtgtga

SEQ ID NO: 69915 - DNA, 601 bp, Human
tggagctgcaaagtatgactgcattttccaatacttccacttgttaaatggattgcttaaatttacaaatcccaggcagtgaaagaagctgcattgcgagagctggctcatcttttaggtttggagaattatatttgattatggttctgaagccaccgtacctactttctttaatacagttcccaaataagtacaaaatgcataggaccatctagatttgcagcagtaagattccctatccaggcatactcaagtccccaggctcacgcctttaataacaagaaactgtacgtcaagaccrattcatgtgaggaggtattcacttaaatctttagacttactattgtaagagtggggtcagttatttgaaagatgtgggtatttacaatgctaaggacagagtaaaggcaaaattaaaaaggtcagaaatcacttttctggtgaggctgagacatcatgcagccaaagtcttcaatctttagaatcctagaggtgtagcatctcttcctctctatcagataagccctcatccaattcaccagaaagcctcaattacctttttccttcaaatgatctacagcaaacatgtgagctacagctg

SEQ ID NO: 69916 - DNA, 601 bp, Human
atgctacaaaactagcaataacagagacctataaaaacgtgggacagaagccaggcgtgttggctcacgcctgtaatcccagcactttgggaggctgaagtgagaggactgcttgagctcagaagtttgagaccagcctgggcaacatagcaagaccccatctgtctctactaatgaaaaaattagctgggcacagtggcgtgcacctgtagtcccagctactcaggaagctgaggcaggaggattgcttgagcacaggagttcaaggttgcactgagctatgactgtgccactgcactcyagcctgggcaacagagtgagaccctgtttcacatacacacaaaaaaagaaatgcaagaaagaaagggacagtggactttataagagatgaaatcctcttattagagcacaaaatgttggcagtatcattttccatgtctacaaaaataaaaattttaatacaaagcatggatgaaaacatgttgtcatccattgcttcagcctttaagattcctgtaccaaaaatacctggaaatcctgtcaacagcacaaggaagcctggttcagcaggtggccctaaggctggagatgcatctaagga

SEQ ID NO: 69917 - DNA, 601 bp, Human
taaggctgcggcacaaatgtggtttcccaaacaaaacaagatgggtgaactgcatatgatcactgaggaaaagcaccagcccttcatggacactcagacagcagcaaagggaacactgcttgaggcgggccctggcctggacccagtttgtttgggacatattaagaaagtaatccagaggaaagtgagtaacaaatttaagacgaggattttcttttttaaactagttttggaggtactcagcacctggcactgttcctaccacctctgctattcctggtgagactgagtggggcagackcccacagtggtctactgcatggagtgaaacagcacaacatgggtggccagctgccaggcagtcaagaattaccgtgctacatcagcaaccccagtgtgaccctggacctgaagtaacatctgagcaactaccaggtgtcataaattggattagaaattgtaaatgcctttgtggacagcttatcagcacaatgggaagtcctaaatcacaattattgtctcagcgtcagtagacagaatgagagacaaggttaaagatgaagcacagaatctgacatggaagctgatggatcaagtagca

SEQ ID NO: 69918 - DNA, 601 bp, Human
ccaaagctgcaaagtaaattctggctagggcatggagtagacggggaagaggaaaagggacaagaacagttttcacaaagacctagtgaggctctttgctttagaatcagggcaaagggtgacagaattagggcaggggacgaacgccccacatctacaggggagacagccaggctccactgcattctgcaggacccttggttccagatttgggattcaccagtaacgaagagtttcccctggtgatgcagaggtggagggaggacaaggggtgggggtactgatgtggaggctgaaatgytcctagaagctccacccttctcaaatcagctagagcagggccctttgaaagcacctgtgatttaggccttaccctagagaagtcgaagtgcggttcatactgtcctcccactccataatttgcaacctgtgggaaataacagcattagaccttgtaagcagcatgaacagctctgtagcagccaatcactctagggataccatcttcccaggcctgaaaacaaccagaactcccaagagcagcctctctaaggtggaagacaaccatgccctggcagcacaggcagagcaaacatcacaa

SEQ ID NO: 69919 - DNA, 601 bp, Human
agacaacaactttcacccaagtttacaacaggcttcatccaccacccacaagactaggaccaaaagggtcagggaaaagtaataagtgtgtgttccataaatcagcctggaatatgtgccaaagctgcaaagtaaattctggctagggcatggagtagacggggaagaggaaaagggacaagaacagttttcacaaagacctagtgaggctctttgctttagaatcagggcaaagggtgacagaattagggcaggggacgaacgccccacatctacaggggagacagccaggctccactgyattctgcaggacccttggttccagatttgggattcaccagtaacgaagagtttcccctggtgatgcagaggtggagggaggacaaggggtgggggtactgatgtggaggctgaaatgctcctagaagctccacccttctcaaatcagctagagcagggccctttgaaagcacctgtgatttaggccttaccctagagaagtcgaagtgcggttcatactgtcctcccactccataatttgcaacctgtgggaaataacagcattagaccttgtaagcagcatgaacagctctgtagcagc

SEQ ID NO: 69920 - DNA, 601 bp, Human
cttgaggtcaggagcttgagaccagtctggccaagatggtgaaacctcatctctactaaaaatacaaaaattagctgggcatggtggtgcacgcctataatcccagctacttgggaggctgaggcaggagaatcgcttgaacctgggaggcagagtttgcagtaagctgagatagcgccactgcactccagcctgggcaacagagggagagtctgtctcaaaaaaaaaaaaaaaaaaaagataaagaagaatctctctgatgtttaaaataagtctctcatattggacctcaagcacaagrgagaccacatatgttctgctcaccagcatgtacacagcacaatccccagcatgtaataaccacacaataaaagcataaagggaaaaaatggacacaggcttctgtctccaagttactttactgcctctatgcctctttagagctggctctcagcagaggggagaggaaactgctcctcatgtgaaagataaaccctacaacctatggataaaacagaggcaagaggtgggaatcaggccattaagccttggagaacacaaaggcagctctcatctagagagagctaaggctatctcctca

SEQ ID NO: 69921 - DNA, 601 bp, Human
gctgggcatggtggctcacgcctgtaatgccagcactttgggaggccaaggcgggtggatcacttgaggtcaggagcttgagaccagtctggccaagatggtgaaacctcatctctactaaaaatacaaaaattagctgggcatggtggtgcacgcctataatcccagctacttgggaggctgaggcaggagaatcgcttgaacctgggaggcagagtttgcagtaagctgagatagcgccactgcactccagcctgggcaacagagggagagtctgtctcaaaaaaaaaaaaaaaaaaaagataaagaagaatctctctgatgtttaaaataagtctctcatattggacctcaagcacaagggagaccacatatgttctgctcaccagcatgtacacagcacaatccccagcatgtaataaccacacaataaaagcataaagggaaaaaatggacacaggcttctgtctccaagttactttactgcctctatgcctctttagagctggctctcagcagaggggagaggaaactgctcctcatgtgaaagataaaccctacaacctatggataaaacagaggcaagaggtgggaatcaggc

SEQ ID NO: 69922 - DNA, 601 bp, Human
tgcagtttggtcccagcctccagcctcatcttctggcccctgtgccacaggcctccctttcttcaagtgacaagggagccagcccccacacccgtatgctggttttagcctgtgcctccatccatatgggccttgtttgcctgagacactctttcccctcactgcttccagctctccactctgctccctcagaagccttgccagagggtcctggacctatggtgcttatgcagctattcgtcctcaggccttcttcagcttcctgtgtatctctgagtgtttccaaccagctgccttggcrtttaccagctgcatggacattacatggctggatggtaataacagcagaaaaaaacctaagaagggagacagtctcagcaaatttggcagcagttgcctcccagctcagaatctaaggccaataagcaaagcccaagctgaggccaccaacaccaacactaccccttaagacactcaccccacttgcagcccacaagcacagggcaggcagcatgtcttgttcggtagtcaccttccccgctccgcaagaggttgtaccagaacacagctgtaccctgggaaagagatggcctttcagaac

SEQ ID NO: 69923 - DNA, 601 bp, Human
ctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggtgagtagcttggataagactggcctgcagcagtgaggggtggtggctgcctaaggccaaaaggcctcatgggcctttctctcccttcacccccacaggacttcaacaacctcaatggggaagaccaagacattctgatggtaagagytcagcccgtggatcccgatccacttcctgcctgggtgacttcagccatgtcattccatcttacctagccttgctttcttcatctgtaaaatagggttaatagcacctatctcagtgggattgttatgacaatcaaatggcacaatgtgcatgttctggcccagcatctggcacttaagagttcaatacatggccacagccatggctataataatgaaaatgacttttaaattagaaaatgaaaaggcagttctaggtgaggaataccaagggccttaaggtcagtgtttggtagggcaga

SEQ ID NO: 69924 - DNA, 601 bp, Human
caataaggttactcccaaaactcctgtactccatgatccatcctcaaagagtggaaggaacagcaaagtagaaggaacaaagcactgacgtcaattacgagattaaccccaagcacaggcagctggaggaaaggcctaaacatcaatatccacgcacaagctactgggataactaggtaacagaccgattcagaagttgtaggggagggtattcgagtattatacccccacgttcccatttttagtcaatccccttcgcaagtcgaaggcggaaatttttccttcttttttttttttttttgcgggggtgggggtgtgggagaggtgcgcaggatcgcgagaaggaaagcgagaactagctgggtaatgttagccagaatctgggcctattttctctttaattagacataatttgaaattgaggaggatatgaaaaagtaacaaatcagccgatggaacgtctgaggaaagaaagaggaaaggagaaacactaaacggatggatttctgggaatttttgttaggattgggttagctttttttattttcttatctttgcgggaaggtggtggggtgggacgcgcagatgagaggaggggtga

SEQ ID NO: 69925 - DNA, 601 bp, Human
gatccgccagcctcagcctcccaaagtgctgggattacaggcataagccactgcgcctggccagtaggagcgcttttcttaaaccaaaggaaaaagcagcaaggtaacaggtcaggttagctttaggcagtctttagtcactacaccttctttcacaataactgagactagctaacaccctcccagaaatcaaatagaattgttccaacttatcagaggaaatgaataagggaatgggtaaaacataataaggatgcaggagagctgggaacctttatatcatatagaaaagtcttcataktgagatatctgtagaataaagctaaagtaaaaaaaaatctaagtcatcaattttttatagtacatgctgtacttctgggtcattgtccaggtgtgctctcaatacttaagaatacctctttgattttattaaaaataccacaaagaaaagtcctcatagattttgaactccattctaaaccagtggatggccacaaaggaagaaatacctgttttatttgttcctctcaggtacacataaaactacggcatttaccttaccttctcaaaaaaggcaaaatatataacttttagaaagctt

SEQ ID NO: 69926 - DNA, 601 bp, Human
cctcgtgatccgccagcctcagcctcccaaagtgctgggattacaggcataagccactgcgcctggccagtaggagcgcttttcttaaaccaaaggaaaaagcagcaaggtaacaggtcaggttagctttaggcagtctttagtcactacaccttctttcacaataactgagactagctaacaccctcccagaaatcaaatagaattgttccaacttatcagaggaaatgaataagggaatgggtaaaacataataaggatgcaggagagctgggaacctttatatcatatagaaaagtcwtcatagtgagatatctgtagaataaagctaaagtaaaaaaaaatctaagtcatcaattttttatagtacatgctgtacttctgggtcattgtccaggtgtgctctcaatacttaagaatacctctttgattttattaaaaataccacaaagaaaagtcctcatagattttgaactccattctaaaccagtggatggccacaaaggaagaaatacctgttttatttgttcctctcaggtacacataaaactacggcatttaccttaccttctcaaaaaaggcaaaatatataacttttaga

SEQ ID NO: 69927 - DNA, 601 bp, Human
caacaagtaggagtgcttttctttttttttttttttttttttttttgagacggagtctcgctctgttgcccaggctggagtgcagtggtgcgatctcgactcactgcaagctccgcctcctgggttcacgccattctgctgcctcagcctcccaagtagctgggactacaggcgcctgccaccacacccagctaattttttgtattcttttagtagagacgtgttagccaggatggtctcgatctcctgacctcgtgatccgccagcctcagcctcccaaagtgctgggattacaggcatragccactgcgcctggccagtaggagcgcttttcttaaaccaaaggaaaaagcagcaaggtaacaggtcaggttagctttaggcagtctttagtcactacaccttctttcacaataactgagactagctaacaccctcccagaaatcaaatagaattgttccaacttatcagaggaaatgaataagggaatgggtaaaacataataaggatgcaggagagctgggaacctttatatcatatagaaaagtcttcatagtgagatatctgtagaataaagctaaagtaaaaaaaaatctaagt

SEQ ID NO: 69928 - DNA, 601 bp, Human
ttaactattaaaatttacagaaaggacgggtgcagtggctcatacgtataatcccagcactttgggaggccgaggcaggcagatcacctgaggtcaggagttcgagatcagcctggtcaacatggcaaaaccctgtctctactaaaaatacaaaaattggctgggcatggtggcaggcgcctgtagaccccagctactcaggaggctggggcaggactgcttgaaatccaggaagcggaggttgcagtgagttgagatcatgccactgtactctagcctgggtgacagtgcaagactccawctcaaataatagaaataaaaaaaataaaataaacaaaatttacagaaaatacaagggacaaaagaacatattacatgaaaccactgggatctcatcaacacaatctagattctgagaagtatcatagggcaaagacctggcttcttcaacaaaccaattgtatgggaataaccacaataaaaagatagaggaaaacttatagattaaaagaaaaaagtatcgattacctaaacccaatgtaatatttacagaccttatttggatcctaattcacaaaaattgtaaaaacaatacaaaaac

SEQ ID NO: 69929 - DNA, 601 bp, Human
tcctagcactttcgcaggctgaggcaggcggatcatctgaggtcaggagtttgagactagcctgaccaacatggaaaaaccccgtctctactaaaaatacaaaattagccaggcgtggtggcgcaagcctgtaatcccagctactcgggaggatgaggcaggagaattgcttgaacccgggacgcggaggttgtggtgagccacgattgcaccattgcactccagcctgggcaacaagagcaaaactctgtctcaaaaaaaataaattaataaacaagtaaagtttagtgaaagaaaaaaacccacaatatcactccacacccattaggatggctatgataaaaacaaaaacacaaaataacacgtgttggtgaggatgcagacaaattgtaacctttgtgcactgctggtgggaatatgcaatggtgcagctgctatggattggcagttcctcaaaaactttaacaaataattaccataggatccagcaattttactcctaggaatatatccaaaagaaccgaaagcagagactcaaacagatccatgtacaccaatgttcatagcagcattgttcacaatagcgaaaagatggaaacaa

SEQ ID NO: 69930 - DNA, 601 bp, Human
gcagtgagccaacactgcaccactgcactgcactccagcctgggcgacagaacaagactccatctcaaaataaaaataaaaataaacaggccgggcacggtggctcgcgcctgtaatcctagcactttcgcaggctgaggcaggcggatcatctgaggtcaggagtttgagactagcctgaccaacatggaaaaaccccgtctctactaaaaatacaaaattagccaggcgtggtggcgcaagcctgtaatcccagctactcgggaggatgaggcaggagaattgcttgaacccgggacgyggaggttgtggtgagccacgattgcaccattgcactccagcctgggcaacaagagcaaaactctgtctcaaaaaaaataaattaataaacaagtaaagtttagtgaaagaaaaaaacccacaatatcactccacacccattaggatggctatgataaaaacaaaaacacaaaataacacgtgttggtgaggatgcagacaaattgtaacctttgtgcactgctggtgggaatatgcaatggtgcagctgctatggattggcagttcctcaaaaactttaacaaataattaccataggatc

SEQ ID NO: 69931 - DNA, 601 bp, Human
gagatcaggagttcgagaccagcctggccaacatagtgaaaccccgtctccactaaaaatacaaaaattagctgggcatggtggtgggcacctgtaatcccagctacttgggaggctgagacaggagaattgcttgaacctgggaggtggaggttgcagtgagccaacactgcaccactgcactgcactccagcctgggcgacagaacaagactccatctcaaaataaaaataaaaataaacaggccgggcacggtggctcgcgcctgtaatcctagcactttcgcaggctgaggcaggcrgatcatctgaggtcaggagtttgagactagcctgaccaacatggaaaaaccccgtctctactaaaaatacaaaattagccaggcgtggtggcgcaagcctgtaatcccagctactcgggaggatgaggcaggagaattgcttgaacccgggacgcggaggttgtggtgagccacgattgcaccattgcactccagcctgggcaacaagagcaaaactctgtctcaaaaaaaataaattaataaacaagtaaagtttagtgaaagaaaaaaacccacaatatcactccacacccattagga

SEQ ID NO: 69932 - DNA, 601 bp, Human
tgctgtgagtgtcatcaaaacagaggataagcctgtaatcccagcactttgggaggctgaggagggcagatcacaaggtcaggagatcaagaccatcctggctaacacggtgaaaccccatctctactaaaaatacaaaaaattagccaggtgtaatggcgggcgcctgtagtcccagctactcgggaggctgaggcaggagaatggcgtgaacccaggaggcggagcttgcagtgagccgagatcgtgccgctgcactccagcctgggcgacagcgcgagactctgtctccaaaaaaaaacagaggataaggccagaaggtcaggcacggtggttcacacctgtaatcccagcactttggaagccatggcaggagaatcactcaagctcaggagtttgagaccaccctgggcaacatggtgaaactccatctctacaaaaaatacaaaaaattagctgggtgtggtggcatgcgtctgtggtcccagctactcaggaaactgaggtctggggaatgcttgagcctgagaggtggaagttcaaatgagtcaaggtagtatcactgcactccagcctgagtgacagagtgagactctctctc

SEQ ID NO: 69933 - DNA, 601 bp, Human
tctgactatccttctttgggttgttttgttgttcataatgtaagacaaacagttgctgtgagtgtcatcaaaacagaggataagcctgtaatcccagcactttgggaggctgaggagggcagatcacaaggtcaggagatcaagaccatcctggctaacacggtgaaaccccatctctactaaaaatacaaaaaattagccaggtgtaatggcgggcgcctgtagtcccagctactcgggaggctgaggcaggagaatggcgtgaacccaggaggcggagcttgcagtgagccgagatcgygccgctgcactccagcctgggcgacagcgcgagactctgtctccaaaaaaaaacagaggataaggccagaaggtcaggcacggtggttcacacctgtaatcccagcactttggaagccatggcaggagaatcactcaagctcaggagtttgagaccaccctgggcaacatggtgaaactccatctctacaaaaaatacaaaaaattagctgggtgtggtggcatgcgtctgtggtcccagctactcaggaaactgaggtctggggaatgcttgagcctgagaggtggaagttcaaatgag

SEQ ID NO: 69934 - DNA, 601 bp, Human
aataattaggtcgggtgctgtggctcactcctgtaatcccagcactttgggaggccgaggcaggcggatgacctgaggtcaagaattcaagaccagcctggccaacacggtgaaaccccatctccaccaaaaatacaaaaattagccaggcatggtggcaggtgcctgtaatcccagctactcaggaggctgatgcaggagaaaagcttgaactcaggaggcggaggttgcagtgagctgagattgcatcactgaactccagcctgggtgacaaaacgaaactacatctcaaaaaaaaaaagaaagaaaagaaaaaattaatataccagttatagtgcttattctctatttttttctgatctttttgtatcaaatatattggttcgattttttttgcctcctgtgtctcttaccatcactatctctggctaagatgaaataagttttctccaaaagcaataattccagtaatttcaactcctccaacgttaacatgaaatttaaatgagtcaatctgaagtatatctttgtcaaacgggcaaaactattttatagctatgagaatacaggaataaacaagctcagtttcttttcttttctt

SEQ ID NO: 69935 - DNA, 601 bp, Human
ttttatagattgagcagcactgaaataatcattcaagaagtatttctatatctcttgtaaaaataggtgattcctataataaaattctttctgtaattcaatgtcaaagaaactggttttttaaacaatcaaagtcacacaagtgaacacttataaggctaccaggaagctaagaactaaattaactcactgtaataattaggtcgggtgctgtggctcactcctgtaatcccagcactttgggaggccgaggcaggcggatgacctgaggtcaagaattcaagaccagcctggccaacayggtgaaaccccatctccaccaaaaatacaaaaattagccaggcatggtggcaggtgcctgtaatcccagctactcaggaggctgatgcaggagaaaagcttgaactcaggaggcggaggttgcagtgagctgagattgcatcactgaactccagcctgggtgacaaaacgaaactacatctcaaaaaaaaaaagaaagaaaagaaaaaattaatataccagttatagtgcttattctctatttttttctgatctttttgtatcaaatatattggttcgattttttttgcctcctgtgtct

SEQ ID NO: 69936 - DNA, 601 bp, Human
tttaaacatcgcaataagtacaggtggtcatagctcacatgtgcatagtaaacgatcctgggattacagagcttgttcacgacatactggaatgataggttaggagcggtggctgactgactctaattcaagcactttgagaggccaaggcgggcggatcaactggaggtaaggagttcaagaccagcctggccaatgcagtgaaaccccatctctactacaaaatacaaaaaagtagcctgccgtggtagcaggtgcctataatcccagctactcaggaggctgaggcaggagaactgcrtgaacctgggaggcggaggttgcagtgagtcaagatcgcaccactggactccagcctgggtgacaagagcaagactccatctcaaaaaaataaaaataaaggccgggtgcggtggctcacgcctgtaatcctagcaatttgggtggcggaggcgggcagatcacaaggtcaggagattgagatatcctggctaacacagtgaaaccccatctctactaaaaatataaaaagaaattatccgggcgtggcggtgggcgcctgaagtcccagctactcgggaggctgaggcaggagaatggc

SEQ ID NO: 69937 - DNA, 601 bp, Human
tcagtgatagaatcaaaaattaacttggattagtaacagcaactaaacttgtattgaaaaaggaagtctttggagtgaggggaaaatggaagtcccatctctataatcaggacagtttgtcttattttcactagaacaaaccaagagaaatacagccaatttatagcagcaaggattttgattaaacagacaatggtagtaaaggctggcaaactctggcactagggattaccagggaatctgcaacactcttccctggagacagattaaataatcagacctggttttgtttttttttttwaaaaaaaaggctcactggagcccagaaagaaacaatcaggttatatgtgtggagcatttctggcctataattcataaatcaaatcagaaaattaaagttcatcagaaactataattataaaattagaattagtaacaaagcagtattatactcttttttttttttttgaaacagagtcttgctctatcatccaggctggagtgcggtggtgcgatctcccagctcaccacaacctatgcctcccgggttcaagcgattctcctacctcagcctcctgagtagctgggattacaggtgcat

SEQ ID NO: 69938 - DNA, 601 bp, Human
agggtccagttcttttctctactttgcatctaccttatcttgatttctttttgtcccaaacacagcttccttggtgtccatccttacggtagtttgacctcagctttgctgttgctctagattccctaaaaaacgacatttctgctctaaatatattaatatttcaattaacacctcaataaatggcaaaacccaggttttcagtgatagaatcaaaaattaacttggattagtaacagcaactaaacttgtattgaaaaaggaagtctttggagtgaggggaaaatggaagtcccatctstataatcaggacagtttgtcttattttcactagaacaaaccaagagaaatacagccaatttatagcagcaaggattttgattaaacagacaatggtagtaaaggctggcaaactctggcactagggattaccagggaatctgcaacactcttccctggagacagattaaataatcagacctggttttgtttttttttttaaaaaaaaaggctcactggagcccagaaagaaacaatcaggttatatgtgtggagcatttctggcctataattcataaatcaaatcagaaaattaaagttc

SEQ ID NO: 69939 - DNA, 601 bp, Human
gtttgaagtactctgttagctaaaagcaaaaacttgtacattcagagggaacgtagtatttgaacacaaatcctcagtatttccttttgggccctcctcttcagaaatctgcctattctttgcccttagaagcatataacccactcccaactaccacccttccccccagggtccagttcttttctctactttgcatctaccttatcttgatttctttttgtcccaaacacagcttccttggtgtccatccttacggtagtttgacctcagctttgctgttgctctagattccctaaaaaaygacatttctgctctaaatatattaatatttcaattaacacctcaataaatggcaaaacccaggttttcagtgatagaatcaaaaattaacttggattagtaacagcaactaaacttgtattgaaaaaggaagtctttggagtgaggggaaaatggaagtcccatctctataatcaggacagtttgtcttattttcactagaacaaaccaagagaaatacagccaatttatagcagcaaggattttgattaaacagacaatggtagtaaaggctggcaaactctggcactagggattacca

SEQ ID NO: 69940 - DNA, 601 bp, Human
aaagaaacacaatctttgtatcacagaaataaaaggaaaaattaaatattctgtacagattttgtcagcttaacacttcaatcacagattcccttttgacctccaagtaataacaggcattagtgctgaagctgggtttcggtaatggttttatcaacaaataccaatagtgtcttccacaactattccaaggaaacactagcccagaatattagaacccaccccaacaaaacacttaaccttatcaatgtttgaagtactctgttagctaaaagcaaaaacttgtacattcagagggaaygtagtatttgaacacaaatcctcagtatttccttttgggccctcctcttcagaaatctgcctattctttgcccttagaagcatataacccactcccaactaccacccttccccccagggtccagttcttttctctactttgcatctaccttatcttgatttctttttgtcccaaacacagcttccttggtgtccatccttacggtagtttgacctcagctttgctgttgctctagattccctaaaaaacgacatttctgctctaaatatattaatatttcaattaacacctcaataaatg

SEQ ID NO: 69941 - DNA, 601 bp, Human
aaaaaacattcacagaagggcaacttacaactttgtatggctctgcaaagagaggagagctaggtgggaaggcgtcttcgccctgctgaatttcctgattccgcctttcccgttctttcatacgcagcacattccggtcttcacggttcatgttgctatgaaaagaaacacaatctttgtatcacagaaataaaaggaaaaattaaatattctgtacagattttgtcagcttaacacttcaatcacagattcccttttgacctccaagtaataacaggcattagtgctgaagctgggtttyggtaatggttttatcaacaaataccaatagtgtcttccacaactattccaaggaaacactagcccagaatattagaacccaccccaacaaaacacttaaccttatcaatgtttgaagtactctgttagctaaaagcaaaaacttgtacattcagagggaacgtagtatttgaacacaaatcctcagtatttccttttgggccctcctcttcagaaatctgcctattctttgcccttagaagcatataacccactcccaactaccacccttccccccagggtccagttcttttctctactt

SEQ ID NO: 69942 - DNA, 601 bp, Human
ataactcaatgttatagttagaagcagaaacaaaaatttaatgaaaaaagtgatacccaaatgactgtctataacaacagaaaaagaaatcagactgatactgaagacacatttattcaaacatactaataatctctgaaactttgtaaactaagtagcaaatggcagtgagaagaaacaaaagcatctatgaaatattcattttttattgatatcacacttaaagaacacctaggaaaaatcaaacaatgcaaattgagttacaaaattctaatttaattcaaaattcagaatggtgaartacccgccgatggttagtagcacaactaggaaaatagaggtaaatgtatgagccaactcagaccacatttttaagaacacaggacagcaataggaggtgggttggaaaacgacttttagggtgctggtaatgctctatttcttgatctgagttgtatgaagctgttgatgctgtgaaaattcttcaagccataatacctatgttgtgtatttttctgtaagcataatatactccaaagaaaagtttatccccaaaaaatatcttctatgtaaaggacaggaaaaaaatgttaagtggtat

SEQ ID NO: 69943 - DNA, 601 bp, Human
gaaaagtaatctgcctttataaaattaagttccagctgggcacagtggctcaggcctgtaatcccagcactttgggaggctgaggcgggcggatcatgaggtcaagagatcgagaccatcctggctaacatggtgaaaccctgtctctactaaaaatacaaaaaattagccgggcatggtggcaggcgcctgtagtcccagctactctggaggcttaggcaggagaatggcgtgaacccgggaggcggagcttgcagtgagcccagatcgcgccactgcactccaacctgggcgacagagsaagactccgtctcaaaaaaaaaaaaaaaaaaaaaaaaaaaattaacttccacagtccagcagattagctaacattcgtattttggcagtttatgaaaatattatattcctcataactcaatgttatagttagaagcagaaacaaaaatttaatgaaaaaagtgatacccaaatgactgtctataacaacagaaaaagaaatcagactgatactgaagacacatttattcaaacatactaataatctctgaaactttgtaaactaagtagcaaatggcagtgagaagaaacaaaagcatct

SEQ ID NO: 69944 - DNA, 601 bp, Human
cgggtgtctgtaatcccagctactcaggaggctgaggcaggagaatcgcttgaacccgggaagcagaggttgcagtgagcagagattgcgtcattgcactccagtaagactccatctccgaaaaaaaaaaaaaaactagcccggcaaggtggtgcacgcctgtaatcccagctactcgagaggctgaggcaggagaatcacttgaacccagaagtcagtggtggcaatgagccgagatcatgacatggcactccagcctagacgaaagaacaagattccttctcataaaaaaaaaaaaaawcttttgaagaacagaaaagtaatctgcctttataaaattaagttccagctgggcacagtggctcaggcctgtaatcccagcactttgggaggctgaggcgggcggatcatgaggtcaagagatcgagaccatcctggctaacatggtgaaaccctgtctctactaaaaatacaaaaaattagccgggcatggtggcaggcgcctgtagtcccagctactctggaggcttaggcaggagaatggcgtgaacccgggaggcggagcttgcagtgagcccagatcgcgccactgcactccaac

SEQ ID NO: 69945 - DNA, 601 bp, Human
aggccaagacggacagatcacctgatgtcaggagttccagaccagcctggccaacatggtgaaaacccatttctagcaaaaatacaaacgttagccgggtgtggccagacatggtggctcacacctataattccagcactttgggaggccaaggtgggcggatcacctgacatcaggagttggagaccagcctggccaacatggtgaaaccccgtttctattaaaaatacaaaaataagctaggcgtggtggcgggtgtctgtaatcccagctactcaggaggctgaggcaggagaatcgyttgaacccgggaagcagaggttgcagtgagcagagattgcgtcattgcactccagtaagactccatctccgaaaaaaaaaaaaaaactagcccggcaaggtggtgcacgcctgtaatcccagctactcgagaggctgaggcaggagaatcacttgaacccagaagtcagtggtggcaatgagccgagatcatgacatggcactccagcctagacgaaagaacaagattccttctcataaaaaaaaaaaaaatcttttgaagaacagaaaagtaatctgcctttataaaattaagttccag

SEQ ID NO: 69946 - DNA, 601 bp, Human
gagcaactgcactccagcatgggtaacatagcaagactgtcttttaaatacacaaagtattttgaaaggccaggtgcagtggctcacacctgtaatcccagcactttgggaggccaagacggacagatcacctgatgtcaggagttccagaccagcctggccaacatggtgaaaacccatttctagcaaaaatacaaacgttagccgggtgtggccagacatggtggctcacacctataattccagcactttgggaggccaaggtgggcggatcacctgacatcaggagttggagaccagsctggccaacatggtgaaaccccgtttctattaaaaatacaaaaataagctaggcgtggtggcgggtgtctgtaatcccagctactcaggaggctgaggcaggagaatcgcttgaacccgggaagcagaggttgcagtgagcagagattgcgtcattgcactccagtaagactccatctccgaaaaaaaaaaaaaaactagcccggcaaggtggtgcacgcctgtaatcccagctactcgagaggctgaggcaggagaatcacttgaacccagaagtcagtggtggcaatgagccgagatc

SEQ ID NO: 69947 - DNA, 601 bp, Human
ataatccgagcacagtggcacgtgcctgtactcccagctactctgggcagctgaggcaggtttgctcaattccaagattttgaggctccagtgcactatgatttcacctgtgaagagcaactgcactccagcatgggtaacatagcaagactgtcttttaaatacacaaagtattttgaaaggccaggtgcagtggctcacacctgtaatcccagcactttgggaggccaagacggacagatcacctgatgtcaggagttccagaccagcctggccaacatggtgaaaacccatttctagyaaaaatacaaacgttagccgggtgtggccagacatggtggctcacacctataattccagcactttgggaggccaaggtgggcggatcacctgacatcaggagttggagaccagcctggccaacatggtgaaaccccgtttctattaaaaatacaaaaataagctaggcgtggtggcgggtgtctgtaatcccagctactcaggaggctgaggcaggagaatcgcttgaacccgggaagcagaggttgcagtgagcagagattgcgtcattgcactccagtaagactccatctccgaaaaa

SEQ ID NO: 69948 - DNA, 601 bp, Human
aatcattgaaaagtgcctaaaaataaccatagtaaaatataatccgagcacagtggcacgtgcctgtactcccagctactctgggcagctgaggcaggtttgctcaattccaagattttgaggctccagtgcactatgatttcacctgtgaagagcaactgcactccagcatgggtaacatagcaagactgtcttttaaatacacaaagtattttgaaaggccaggtgcagtggctcacacctgtaatcccagcactttgggaggccaagacggacagatcacctgatgtcaggagttccmgaccagcctggccaacatggtgaaaacccatttctagcaaaaatacaaacgttagccgggtgtggccagacatggtggctcacacctataattccagcactttgggaggccaaggtgggcggatcacctgacatcaggagttggagaccagcctggccaacatggtgaaaccccgtttctattaaaaatacaaaaataagctaggcgtggtggcgggtgtctgtaatcccagctactcaggaggctgaggcaggagaatcgcttgaacccgggaagcagaggttgcagtgagcagagatt

SEQ ID NO: 69949 - DNA, 601 bp, Human
tatgtccactctgtaagcctgaggaccgtttctgagactgagaagtgctgggtgcgggtcctactggagtccatttgctactctgatgagagcctccatgtctctgttcaaagaaatttgggttagatttttcatctgctgatggtggtactgtaggcttgggaattgcaacaagctttggtatagatctgtctcctatgaaatccttcatttcatcgtagtttccaagcatactctgaatacgacttgataacttatcttctttgctagtctacaaaaaaataaaataaaataaaattawaaaatgagcataatcagaaataaaatataattctgaactaattttccaaacttcgaatggaaaggggcttttcaaagggaggctttacctcatatcttaacgttaataccttgaagcaaactccaaatatatcatttctgtagtgaaaaaaaaaatcattgaaaagtgcctaaaaataaccatagtaaaatataatccgagcacagtggcacgtgcctgtactcccagctactctgggcagctgaggcaggtttgctcaattccaagattttgaggctccagtgcactatgatttcacct

SEQ ID NO: 69950 - DNA, 601 bp, Human
aggccactggaaagatgttttaaatgtttgcaaaacagcattttacattacgcagattcttccttccaccattttgagctaagagttgtaattttttggctactgacgtcactttccaaatttttttttattgcacaaactacattaaaagataaaatttggggccaggcgcggtggctcacgcctgtaatcccagcactttgcgaggccgaggcgggcggatcacgtgaggtcaggagttcaagaccagcctgaccaacatggtgaaaccccatctctactaaaaatacaaaattagccrggcatggtggcacatgcctgtaatcccagctactcgggaggctgaggcaggagaatcgcttgaacctgggaggtagaggttgcagtgagccgaaatcgtgccgttgcactctagcatgggcaacaagagcgaaactccaactcaaaaaaaaaaaaagagagagataaaatttgggccaggcatgatggtcatgtctgtaaccttagcactttgaaggccaagatgagaggatcgcttgaggccaggagttccagaccagcctgggcaacattatgagacacccatcttgaaaaaaaaaga

SEQ ID NO: 69951 - DNA, 601 bp, Human
gtttaaggaaagaacaaattaccattttactgttctcttgagaggagtaatcagataacaaatgccactcaaaatgagtttcccaaggccactggaaagatgttttaaatgtttgcaaaacagcattttacattacgcagattcttccttccaccattttgagctaagagttgtaattttttggctactgacgtcactttccaaatttttttttattgcacaaactacattaaaagataaaatttggggccaggcgcggtggctcacgcctgtaatcccagcactttgcgaggccgaggcrggcggatcacgtgaggtcaggagttcaagaccagcctgaccaacatggtgaaaccccatctctactaaaaatacaaaattagccgggcatggtggcacatgcctgtaatcccagctactcgggaggctgaggcaggagaatcgcttgaacctgggaggtagaggttgcagtgagccgaaatcgtgccgttgcactctagcatgggcaacaagagcgaaactccaactcaaaaaaaaaaaaagagagagataaaatttgggccaggcatgatggtcatgtctgtaaccttagcactttgaa

SEQ ID NO: 69952 - DNA, 601 bp, Human
ccatatcaagaaaaaataaatgtgcaaaactggaaggaaatctattactgtaagatttgaccagtatgtacaagatgaaccaaagcaaggtattttgatcataatggtttgactgataactactgagttttttgcacttcaaattattaacagttaagcatgagaaagtacagttataattggcttgttaatgttttccaggcaaagtaagtgttaagattaaaatttattttacttaaaagcaaagaacgcggccaggcgcggtgactcacacctgtaatcccagcactctgggaggccraagcaggtggatcacctgaggtcaggagttccaggccagcctggccaccccaactccgcaaaaatacaaaaatcagccgggcatgatggcgggagcctgtaatcccacctactcaggaggctaaggttaaagaattgcttgaacctgggaggtggaggttgcagtgagccaagatcgcgccactgcactccaggctgggcgacagagtgagacttcatctcaaaaaacaaacaaacaacaacaacaaaaaaaaacacaaagaacaaaactagctctctgaaggcaaatggtaaacaaaga

SEQ ID NO: 69953 - DNA, 601 bp, Human
ttaaatacccaaaatgttggctgggcgtggtggctcatacctataatcccagcactttgggaggccaaggcaggcagacaggagttccagaccagcctggccaacatggtgaaaccctatctctactaaaaaaaaaaaaaaaaaaaaaaaattagccaggcatggtggcagatgcctataatcccagctactcaggaggctgaggcagaagaatcacttgaacctgtgaggcggaggttgcagtgagctgagatcacgccactgcactccaacctgggtgacagagtaaaactctggctcaaaaaaaaaaaaaaaaatgtgtaaagcagccgggtgcagtggctcaggctataatcccggcactttgggaggccgggcaggaggatgggggagtggggagtaactggaggtcagaagttcaagaccagcccggacaaagtggtgaaaccccatctctactaaaaatacaaaaattagctggacatggtggtgggcacctgtaatcccagctactcaggaggctgaggcacaagaattgcttgaacccaggagacagaggtagcagtgagcctagataatgccactgtactccagactgggt

SEQ ID NO: 69954 - DNA, 601 bp, Human
aattcactggactttctctttttccaatagagtaatgtactttttggtcatgtgtcaattttaaacatgtgtcattaaatacccaaaatgttggctgggcgtggtggctcatacctataatcccagcactttgggaggccaaggcaggcagacaggagttccagaccagcctggccaacatggtgaaaccctatctctactaaaaaaaaaaaaaaaaaaaaaaaattagccaggcatggtggcagatgcctataatcccagctactcaggaggctgaggcagaagaatcacttgaacctgygaggcggaggttgcagtgagctgagatcacgccactgcactccaacctgggtgacagagtaaaactctggctcaaaaaaaaaaaaaaaaatgtgtaaagcagccgggtgcagtggctcaggctataatcccggcactttgggaggccgggcaggaggatgggggagtggggagtaactggaggtcagaagttcaagaccagcccggacaaagtggtgaaaccccatctctactaaaaatacaaaaattagctggacatggtggtgggcacctgtaatcccagctactcaggaggctgagg

SEQ ID NO: 69955 - DNA, 601 bp, Human
caaattttggtgtttccatataataaaatactgattgggaataaaaaaagaaaaactgggccaggcgtggtggctcacgcctgtgatcccagcactttgggaggctaacgcaggtggatcacgaggtcgggagtttgagaccagcctgaccagcatgatgaaaccccgtctctactaaaaatacaaaaatcagccaggcgtggtggtgcatgcctgtaatcccagctacttaggaggctgaggcaggagaatcgcttgaacccaggaggcggaggttgcagtgagccgagatcatgccacygcactctggcctgggcaacagactgagactctgtctcaaaaaaaagaaaaagaaaaagagaaaccatggatataatcaagaacatggaagaattacaaaactaaatactgagcaaaagaaagtaaatatataaaagaagcacatgatgtactgattccatttacatgaaattctagaaaaagcaaaacttatctagagtgacataaaatagatcagaaattgcatagggacagtggtggaggcgagggagactacaaaggaacatgaagaaatttgggggtgatggaaatgttctaattc

SEQ ID NO: 69956 - DNA, 601 bp, Human
tcatcctcccaagtagctgggactataggtcatgccaccacgcctggctaatatttacattttttgtagaggtggggtcttgccttgttgaccaggctagtctcacactcctgacctcaagtgatctacccaccttggcctcccaaagtgctaggattacaggcaagagccacctcacccagccaggcaaagatttcatagacaccaaaatcatgacccgtaaaagaaaacactgaagaagtggactttataaaagttaacatgtgttcttagagggacactattaagagaatgaaaaggkagtccacagagcaagaaaacaaaattttcaaatcacatatatgataatggcagtaagaatcttagcccatttcaggccgggcgcagtggctcacgcctataatcccagcactttgggaggccggggtgggcagatcataaggtcaggagatcgagaccatcctgactaacacggtgaaatcccgtctctactaaaaatacaaaaaattagtcaggcatggtggcaggcgcctgcagtcccagctactcgagaggccgaggcaggagaatggtgtgaactcgggaggcggagcttgcagtg

SEQ ID NO: 69957 - DNA, 601 bp, Human
agagtgacactctttcaaaaaacaaaaagataactctaacaaaagatgtccaaaatctacatattgaaaactacaaaacaatactgaaagaaattaaattagaccaaaatagagagaaataaggactcatgggtcagaagattcaatattgctaagacgtcaattctccccaaattgatctatagatccaacacaatccctgtcaaaatcccacaagacttttatgttgaaattgacaaggtgttgtttgtttgtttttttttttttttgagacagagtcttgctctgtcacgcaggctgragcacacgcaatggcatcatcttagctgactgcaacctctgcctcccagagactcctgcctcagcctcctgagtagctgggattacaggtgtgcaccaccatgccccgtgcccaactaatttttgtgtttttagtagagacggggtttcaccatgttggccaggctagactcaaactcctccttaggtgatccacccacctcggcctcccaaattgctgggattacaggtgtgagccactgtgcccagcctaaaattcttatgaaaatgcaaagagcctagaaaagtcaaatctactttg

SEQ ID NO: 69958 - DNA, 601 bp, Human
gaggcggaggttgcactgagcaccactgtactccagcctgggtgacagagtgacactctttcaaaaaacaaaaagataactctaacaaaagatgtccaaaatctacatattgaaaactacaaaacaatactgaaagaaattaaattagaccaaaatagagagaaataaggactcatgggtcagaagattcaatattgctaagacgtcaattctccccaaattgatctatagatccaacacaatccctgtcaaaatcccacaagacttttatgttgaaattgacaaggtgttgtttgtttgtttttttttttttttgagacagagtcttgctctgtcacgcaggctggagcacacgcaatggcatcatcttagctgactgcaacctctgcctcccagagactcctgcctcagcctcctgagtagctgggattacaggtgtgcaccaccatgccccgtgcccaactaatttttgtgtttttagtagagacggggtttcaccatgttggccaggctagactcaaactcctccttaggtgatccacccacctcggcctcccaaattgctgggattacaggtgtgagccactgtgcccagcctaaa

SEQ ID NO: 69959 - DNA, 601 bp, Human
acacttaataatgaaagactggatactttctcctctatgataaaaaataaggcaagaatgtctaatctcactactggcattcaacatcatactagagattctacctagtgcaataaagcaagaatataaaataaggcatccatttgaaacaaacattataaaatctttattcacaggtgaaatgattgtctaggaaatatatggtatctacaaaaatgctattaagtaaatttagcaaaattacaagatgaaacataaaattatacatgaaaggtatttctttttcttttcttttcttttctttttttttttttttttttgagacagagactcaccttgtcgcccaggctggagtgcaatggcgcaatctcggctcactgcaacctccacctcccaggttcaaggaatcctcttgcctcagcctcccaagtagcttggattacaggtgtgtgccaccgcacacagctaatttttgtatttttttagcagagatggggtttctactaaaccatcttggccaggctggtcttgaactcccgacctcaggtgatcctccttcagcctcccaaagtgctgggattacaggcatgagcgcacgatc

SEQ ID NO: 69960 - DNA, 601 bp, Human
tgtgagccattgcgcccagcctaaaagataatatattgtttaaataaaaaatagtaacaatattgtgccatttatactttatgtggaagtaaaacataaacaacaatcatacagattctacgacgggagaaatgcaagtataatgacaatagggtcttatacagcagaaaaggatggtataaaatcacttgaagatagaggctgacacacacacaacacacacacacacacacacacacacacacaaaagggctgatgagacagagaaatcaaaaagcaagatagtagatttaagcccaaytgtataaataatcacattaaatgtaagtggtctgaacaccctaattaaagagcagagtgtcagattatatttaaaaagcacaacaaaatcatatactacctacaagaaatgcattttaagtataagaacataaacaggttaaaagcaaaaggttggaaaaaactataccatgctaacattaaataaaagaaagctggagctgatcatattaatataaaagtaaattttacagcaaagaatattataagatttaaaaggggttgtttcatagtaataaagactcaactcattaagaggtaa

SEQ ID NO: 69961 - DNA, 601 bp, Human
aacatttagcagggcgtggtggcaggcacttgtaatcccagctactccagagactgaggcagaattgcttgaaccagggaggtggaggttgcagtgagccaagattgcaccactgcactccagcctgggtgacagagcaatactctgtctcaaaaaaaagtaaagataacaaactgtgtttacttattttgagacagggtctcactaccacccagactggagtgcagtggagtgatgatggctcactgcagccaagacctccggggctcaagctattttcccacctcggcctcctgagcarctgggaccacaggtacgtatcaccacactcaggtaatttttttattttttgtagagacagggtctcactatgttgccaaggctggtctcaaactcctggactcaagtgatcctccttcctcggactcccaaagtgctaggattataggtgtgagccattgcgcccagcctaaaagataatatattgtttaaataaaaaatagtaacaatattgtgccatttatactttatgtggaagtaaaacataaacaacaatcatacagattctacgacgggagaaatgcaagtataatgacaatag

SEQ ID NO: 69962 - DNA, 601 bp, Human
gttagtgcacatggagagtaagtacctattaaagtatcacacagagcttttaggtatattacacatgaagttgtacccacttaaatttggagaatgagataagctatcggtaagaagcaacccaccttagcaacagtcagtcagtagctgaggtgtctcacaaacaccaaaatctaaacactgttacttgagtatatacatccaaattcagttaacaaacattcattgaacagctactttgtgccagaactattctaagcattggcacagcgttttcctatgttctttaaatacccatctyagagcaagaacatttaaattgtacagcgttctatctccagtgtcaagaacactgctggaggttgttccaaacatggtgagtaagtgcaaaggcaatcaaaatctttaatattctccaaactatcactggaaaatctcccaagctatccccaactatacccatattctctgcttccctctggtgccaatgaagtagtggtgttctattctaaagctactgtcctctacttgggcactgaatctcaatcactcttgtgaagatttcctaaggttacctcttctctttcccatggatcatttg

SEQ ID NO: 69963 - DNA, 601 bp, Human
gaagcggttacttcattcattgttaaaacatcatcttttttttttttttttttgagatggagtttcacactcctgtaggatgtttcatacttgttgctcaggctggagtgcaatggcatgatctctgctcactgcaacctccatctcttgggctcaaatgactctccagctcagcctcccaagtagctgggattataggcgcatgccaccacgcccagctaatttctgtatttttagtagagatggggccgccatggtggccaggctggtcttgaactcctgatctcaggtgatccacccrcctcagcctccccaggtgctgggattacaggcatgagccaccacaataggccaacatcatctttactctgaagagagaagggggtttaattattttttaaaaatacattacgaaaagatacatatagcatatttcgtggtggtgtgcgtgtgtgtgtgtgtatctgtgtgtgagatagagagattaaaaagagagaggtgtctaactcatttttaagtgggataactgatatcatgaaacaatttctatgttagtgtaaaaaatattcagattcactcctcatttcattacagaatatat

SEQ ID NO: 69964 - DNA, 601 bp, Human
gaattagatttccatgttccttgttgtaaatcatttagaaaaataaattagaaggatgcattttattatttttagcaaataggttcaaaccactgattagaaattttttttcagctctttacagtattcatattagaactgtggttttttggtaacaaaaaactaaaaatacataaacaatgacaatattattgttattttcctagcttgaatgtatgtatatgtatatacacacacactcatatataatctatacactatatatatacatatatatatatatatatttttttttttttttgagacggaatctagctctgtcacccagactggagtgcagtggtgcgatttcggctctctgccacctccagctcccaggttcaagcgattctcctgcctcagccttccaagtagctgggattacaggcacctgccaccacgcccagttaatttttatatttttagtagagacagggtttcactgtgttggccacgctggtctcgaactcctgacctcgtgatccacccaccttggcctctcaaagtgctgggattataagcatgaggcaccgcacccagccgctcaagcatatcttttagg

SEQ ID NO: 69965 - DNA, 601 bp, Human
attgtgaggatcatctcgcctactaagtggagaacagttttaagaaagctagaatggagttaaggatacaaaatgaggttactggagtagtaccagtaggagataactacagcttaaacaagtttgtcttccagcttttttttttttaatcatatactccattactaagaaatttttccatttgtatctccaaaatatgtatagaatatgcattactacttatgtataagattaaaatactgcaatttcaaaagcataacaaaaattaaataccatttttagagtaatttttaaatatatktatgaatgacaacaaaacctttcttacacacaaaaatataatgcttcaaaggtatgacgctaagatggacttatttttgatatctggtttcactggatgccacaaagatatagttatactcatggaagaaataccatgcttattaaatcacagtaacaaaatttcagtcctatacattaattatgtaaagaattctattgaagttgaattagatttccatgttccttgttgtaaatcatttagaaaaataaattagaaggatgcattttattatttttagcaaataggttcaaaccactg

SEQ ID NO: 69966 - DNA, 601 bp, Human
cacagagaggaaaaagtaaaggtggaagagtggtgagatatgagactgaagacctaaaatgctagatcacacagtttacagacttatagaccatattaaagacctgtgtgtgtgcagcttattaagtaggagagttacacaactacatctgcacattgtgaggatcatctcgcctactaagtggagaacagttttaagaaagctagaatggagttaaggatacaaaatgaggttactggagtagtaccagtaggagataactacagcttaaacaagtttgtcttccagcttttttttttttaatcatatactccattactaagaaatttttccatttgtatctccaaaatatgtatagaatatgcattactacttatgtataagattaaaatactgcaatttcaaaagcataacaaaaattaaataccatttttagagtaatttttaaatatatttatgaatgacaacaaaacctttcttacacacaaaaatataatgcttcaaaggtatgacgctaagatggacttatttttgatatctggtttcactggatgccacaaagatatagttatactcatggaagaaataccatgcttattaa

SEQ ID NO: 69967 - DNA, 601 bp, Human
tttgaatgtcaataattactacctttgcaagtactcacgcaaatcaaagtaaaatggcaactgtaataaacacaatgaagggcaaatacacataattatattgagtttgtaattgtgcatgcatgtgtacctgtgtgcttgtatgcatgtgtgcatatgtgtgtgtgtgtgtatgatctagccaggaagatgagcaaaggcttccctgaggaactgccattcagattgaaatttgaaggatatataggaaataaactgggaaaggaagagataggctaagtgccatagggagagagaaaatgtgtaaagtccagcttaaagggaagagcatggcttgtacaaggaacttaaaggcagcccacagagaggaaaaagtaaaggtggaagagtggtgagatatgagactgaagacctaaaatgctagatcacacagtttacagacttatagaccatattaaagacctgtgtgtgtgcagcttattaagtaggagagttacacaactacatctgcacattgtgaggatcatctcgcctactaagtggagaacagttttaagaaagctagaatggagttaaggatacaaaatgaggttactggagt

SEQ ID NO: 69968 - DNA, 601 bp, Human
aggcaggaggatcacttgagccctggagatcgaggctgcagtgagctacgaccacaccactacactccagaaaaaaaaaaaaagaaaacaaaaatgaaaaaggatatgacatgtaaaggtattactaaagttatatatggtgtgaccatgaaaactgaatgttcaataaatagcttaatttgaaaacaaagagggaaagaaatactcactttgttctccagtgccaaaattggactgctgagactcctaagaaaaaggaacataaaattatacaaagttacactaaaaaagaaagattagygaaaaatgcttaaattacataaaaacacttcaagtacttgaaaaagcacagaaagaatgtaatgatcctgtctgatcagccttggcaattttgggatcaataatggactttcccagagattaatacaaaaagcattaagccacctaataatctttatcattcaattctttcagcagcatccattgtagtcatatccttatttagagccctttataaaataactaatttcaatttaaaattcttggtcttaagaaaacacttcatttaaaactaaaggtaataccgaagacagtgtaccag

SEQ ID NO: 69969 - DNA, 601 bp, Human
ctacccattagatcataaaaattaggatacgagggcatggtggctcacaccagtaatcccaacactttgggaggcgaggcaggtggatcacttgagctcaggagttcgagaccagcctgtgcaacatagtgagaccctatctctactaaaaatttaaaaaatcagccaggcatagtggcatgtgcccacagtcccagctactcagtaggctgaggcaggaggatcacttgagccctggagatcgaggctgcagtgagctacgaccacaccactacactccagaaaaaaaaaaaaagaaaasaaaaatgaaaaaggatatgacatgtaaaggtattactaaagttatatatggtgtgaccatgaaaactgaatgttcaataaatagcttaatttgaaaacaaagagggaaagaaatactcactttgttctccagtgccaaaattggactgctgagactcctaagaaaaaggaacataaaattatacaaagttacactaaaaaagaaagattagtgaaaaatgcttaaattacataaaaacacttcaagtacttgaaaaagcacagaaagaatgtaatgatcctgtctgatcagccttggcaa

SEQ ID NO: 69970 - DNA, 601 bp, Human
agttagctattttctgcattttaacattttctgcataattaacaatgtcaaatccctttttcctgtaagctacggcctttaaggtggaactaagaaattgatagacagataaagaaagcataacatcaaaagaggtattcttctagttttatccctgcattaagatcactgaagataaactaaggatcaaaaagttccacattttcatttccaaaataccttatgactagtacaaatctaccttaattaagaagttactgctcttggcaaaaagaatacctgttttgttacagaggtatayggtaaagcccagacatttgcattggttcctgatcttaccactctcaatctacacaaccacaatctcttgggaccataagactatcttccctagaattcttctgacaggccaagagagtaagggtaaaggtgagggtatagcaggcagcagattttctacccagatcagaaaaccaaggaagaaaaaacagggactgtacaaatataagaagaaaagggccatggtcagctaaataaaatgacccttcttgtgcggagttttatcatcatagagccaagtatcttcatgaagtaagttaaa

SEQ ID NO: 69971 - DNA, 601 bp, Human
aaatgtccatcgataggggactagtgaaataaattaagatattttcatattataacataattttaaggttaaacaatgagctagagctttatgctgatatagaaatagctctaaaacaaagtgaaaaacacaaataatgagtagaggcagcttatgatcccatttgtgaacagctttcagaaaagagaatgagagaagagtagaaggatgaagcattcttaaaagatgacgactagggaaaacaagctgagaaaaaaaaggaaacaaaaagaagagagaaaatgtaaattctctggcctayagttagctattttctgcattttaacattttctgcataattaacaatgtcaaatccctttttcctgtaagctacggcctttaaggtggaactaagaaattgatagacagataaagaaagcataacatcaaaagaggtattcttctagttttatccctgcattaagatcactgaagataaactaaggatcaaaaagttccacattttcatttccaaaataccttatgactagtacaaatctaccttaattaagaagttactgctcttggcaaaaagaatacctgttttgttacagaggtata

SEQ ID NO: 69972 - DNA, 601 bp, Human
cttattaaatataaattaggaatatacacacaaaaacatacacatacaactctcagatgagaaaaaaccatgatctcagagcaaaggtgggcaaactgtggcccacaagccaaatccaacctaccacattgttttaaagagtgtggctggaatactgccacacttagggtctacagctgctttcatactacagatggcagagctgagcagtcaaaacacagactatgtggctctgaaagcctaaatatttcactatctgaccctttacataaaaatttgcatgctcatgccttaaatatttcttttattttttaatttttctgagatcaagtctcgctctgtggcccaggctggagtgaagtggcacgatctcggctccctacaacctccacctcccaggttcaagtaattctcctgcctcagccttccaagtagctgggattacaggcgctcgccaccacgcctggctaatttttttatttttagtagagaaggggtttcaccacgttggccaggctggtctcgaactcctgacctcacgtgatctgcctgccttggcctcccaaagtgctaggattacaggtgtcagccaccctgccca

SEQ ID NO: 69973 - DNA, 601 bp, Human
ggaaggtaccccaccgcctctgtctcacctcgggagatgcactctgggatggctcatttgcctcactgtcactggaactactttcactctctgagtcagatccagagctgctttcagatccactgtggctactagaatcatccctggagttatctgctccttcactattatggtgtgaaggttcagagttactaaaagagatgaaatatacaaatgtccaaagtttattttacattgacaacaggaaaacatccaaatcgacaaccaactttctttttttcttcttgtcttttttttttttagacggagtcttgctctgtggcccaggctggaatgcagtggcacgatctcagctcactgcaacctccgccttccaggttcaagcaattctcctgtctcagcctcccaagtagctgggactacaggcgtccaccaccacgcccggctaatttctgtacttttagtagagacggggtttcaccatattggtcaggtgggtctcaaactcctggcctcaggtgatccacccgcctcggcctcccaaagtgctgggattacaggcgtgagccaccgcgcccggctgcaactttctttaaaatgt

SEQ ID NO: 69974 - DNA, 601 bp, Human
ggttttaaatggacatcaccaaggaccctgagagggcctgtggaaggtaccccaccgcctctgtctcacctcgggagatgcactctgggatggctcatttgcctcactgtcactggaactactttcactctctgagtcagatccagagctgctttcagatccactgtggctactagaatcatccctggagttatctgctccttcactattatggtgtgaaggttcagagttactaaaagagatgaaatatacaaatgtccaaagtttattttacattgacaacaggaaaacatccaaatcgacaaccaactttctttttttcttcttgtcttttttttttttagacggagtcttgctctgtggcccaggctggaatgcagtggcacgatctcagctcactgcaacctccgccttccaggttcaagcaattctcctgtctcagcctcccaagtagctgggactacaggcgtccaccaccacgcccggctaatttctgtacttttagtagagacggggtttcaccatattggtcaggtgggtctcaaactcctggcctcaggtgatccacccgcctcggcctcccaaagtgctgggattacag

SEQ ID NO: 69975 - DNA, 601 bp, Human
ataagtggccaggcacggtggctcacacctgtaatcccagcactttgggaggctgaggtgggcggatcatgagatcaggagtttgagaccagtctgaccaacatggtgaaatcctgtctctattaaaaatacaaaaattagtcagatgcggtggcgcacgcctgtaatcccagctactcaggaggctgaggcaggagaatcacttgaacccgggaggcggaggttgcagtgagccaaaactgagccactgcactccagcctgggtgacagagtaagactccatcttaaaaaaaaaaaaaaagataagcttaatgttatatatgacctttaaatagcaaatattcctattcaagaatccaatttcaaaggcataattacaaattaccgtacagaatatttaattctagaaagtaaacaaatgatgtaggtacaaagagatttttaactgcaatttaacaagctataccaaaattgtattacataagactctttttatcaacaacatgatgttctttgtaaccacagaacatcaattaccatgttgagtcataaaaataaaagaccaaactaaaggtacacagtattttagtgacctgtaata

SEQ ID NO: 69976 - DNA, 601 bp, Human
aggctgaaaaacagagaaatatgtatgcttttttcgatactgaatgcttttttcgttctccctcctttacaacctcaaagaagaggaaaaaccacaatgcctaatgcaacaaaagcaaatggttctctatgaaccaaagcaaagggctgagtattgactattagctcttatcatctgaataagaagataagtggccaggcacggtggctcacacctgtaatcccagcactttgggaggctgaggtgggcggatcatgagatcaggagtttgagaccagtctgaccaacatggtgaaatccygtctctattaaaaatacaaaaattagtcagatgcggtggcgcacgcctgtaatcccagctactcaggaggctgaggcaggagaatcacttgaacccgggaggcggaggttgcagtgagccaaaactgagccactgcactccagcctgggtgacagagtaagactccatcttaaaaaaaaaaaaaaagataagcttaatgttatatatgacctttaaatagcaaatattcctattcaagaatccaatttcaaaggcataattacaaattaccgtacagaatatttaattctagaaagtaaa

SEQ ID NO: 69977 - DNA, 601 bp, Human
cttatgcttcctcttgcctttgttggaaactttttctgaggcttgtttctgagcctctctcgtgtgcttttctggcacatttttcttttcccccttgggcggctctgtttctttgtaaggctttcctggtattctagtcaaaagattcaggtcaatcttcacaataagtgggtacctgtcatcaggctcactgaggggtgaaagaagttccttctcttccataggagagaacattcgttgccgaaaaaagctatcttcttcctccactgaggagggtttaacaggagtcctattgctctcrgggtacttaggagtttgtgaggaaggaggaaggctctcactttcatctgaatctgaggatgaggtatctgtttctatgatttcccttgatttctgggaagatttacttgttgacttatatttctttttctctgctgtaggtcgaggggaagacttagactccttctttatattgggtttccttgagcctttggtggctgctttgtgtctgctggagggcatgctgctagccaagtctacaggggtttcactttctatcttcaggcctccacgaggctcttcagcagctgccttctcagcc

SEQ ID NO: 69978 - DNA, 601 bp, Human
aactggagtggtgtttgtgttctaagtttacttacttggtaaggccattctggtacctatctgttcacctactcaagcttaacttctggtctttcacaatcatagacatgtatcggaagaaattatagtattctttgatatagactacttaaaactttacattctcctgtaaattcctcactagagctgaaaagatcaggctgtttttcccacagtctctatatatgtagtgattcagatctcttcattgtacgattattatcctccaatcacagacatgcgtgagttttcacatttcctyagtctaagaaaagcagaccttaaatatacaaattttgcctctatatccaaaattatcttggaagtatttagggatgacagctggctataagccagcaatatttttagttctgacctttgttaaggaaaataagctggggcatagaggtgcatagcagattagttatttaagtgtgacttggtctgggtgtacatcagaagagaatggtagggattataacaatacggggagtacatatccaaactaaaaacacctaaaaccaaaatgttgagaatgttgcaaatgccaatttgcaagctg

SEQ ID NO: 69979 - DNA, 601 bp, Human
aagtcctagcttccaaaagagcagagtctatcatacacaagctcttattccacattattctatgaattaaatcccacagccaagtccagcgatctgaggctgtgggctacaggggccagcagccctaaacagcttactagttgagcaaaacatctctatactatgataatggaaactcattaggtatagtatagagagtagtaagctttggttttctaaaaatttaaataatgtggacaatttcaatttttaaagattcaaaaaagaagtcatgtattattctaatttgtctgaatatatwtcatctgcacgtggcactgtggttttatgaaaaggagagaggaaaatatctcactccattttaagaaagtgctctattctccctgtagtatatgtgattctcaggtcaactggagtggtgtttgtgttctaagtttacttacttggtaaggccattctggtacctatctgttcacctactcaagcttaacttctggtctttcacaatcatagacatgtatcggaagaaattatagtattctttgatatagactacttaaaactttacattctcctgtaaattcctcactagagctgaaaa

SEQ ID NO: 69980 - DNA, 601 bp, Human
attaacaacactggcatgcaacatgttttgggaacgtactctctgttgctggatggcttatggcctgctgaattcttgtcctccgttttgggtttcttgctctcactggctcggttatcatcttcattctagatgaaaaatagaaaccgtggtctgatttttattcaactaacttcagcttccagcactagctacccacaaagagtttatccatgattaggcatcagaaagaagataaaagagaagtactataattcatttaaataatattcaagaagatgaggttttaaggctgaggtcrcctattttagatacacaaaacccagagactgaaacgcatttcctacagtctctaagatggcatcttttcaatgtaatgatttgggaggtagtatctgtgaaattataattaagatataatttacataacataaaattcactctttagaagtgcacaattccataacatttggtatattcagagttgtacaaccattaccacaatgaaattttaattttatttatttagttatttatttatttttcagacggagtcttgttctgtcgcccaggctggagtgcagtggcacgatctcagctc

SEQ ID NO: 69981 - DNA, 601 bp, Human
gccccaggcccccaacactttaccttaacctccttggagctactggaagtcttcccttcggtcttcttctgctttgatgtggaggaactgtttttgctgctgccactcgtctccttgttgctgttactgcttgactttaaggaagaagactgactaatagtcctcttccgagagccatgctctgtttttggatcttttgaaggaacaggcccagcgggagaaggcaacaaatccttttcttttgcagcactctgcttagatgacctgccaaaccaaacgaatgccttcatttctccacacrgtaatacaggggtaattgatttttccatttctctttgtctgctttcaagacaaatctgtttttccccatttgattactaggacacatgatttctataaaacaaaataagactgtaaattccatgaaggtaggcatcttctctgtttttattcccgtggttgtaaatccagggccaaaaactgacctaccactcagtagtactcaataaatattggctgaatgattgaacaaattgatgaatggtgaatgaagagattaccacttttaagttggcaaccagtctcttggaaattacagata

SEQ ID NO: 69982 - DNA, 601 bp, Human
gaaactcaaagcctatttcaaacaatatacaacaactcaatcttagcaactagaaccacttagttcttattttaaaagcttccataaccaacttttccaatgactggtttctatctttttttttttttttttaaattttaaagttcttttacagacagggtctcaccacattgcccaggctggactcaaattcctcaaatgatccttccatcttagcctcccaaatagctgggactacaggtatgagccactgtacccaagggtttttctttcaatatgtatgtgaccagctgacttaccrccttcacagtcttatatcactgtattcatttatcaggattattacatatagagggtaaaagacataggcctatatatttactgagatgttacaataatttcaaagcacagtgtcaccctggaaaagtcacatggcaagttgaatgattttcaaaagccccaggcccccaacactttaccttaacctccttggagctactggaagtcttcccttcggtcttcttctgctttgatgtggaggaactgtttttgctgctgccactcgtctccttgttgctgttactgcttgactttaaggaag

SEQ ID NO: 69983 - DNA, 601 bp, Human
tgatcttaaactcctaggctcaagtgatcctcccaccccagcctcctgagtagccgggaccatgggcatgtactactgcacctggctatatgtctattctgcctcctatcaatatagccctttatgaaagagctatgactctctctcaactgccttccatccagccctatctttaataaaacgaatatacatttttccataataaaacaccataaacaagtggaatttattccaggaatgcatggatgtttcaacattagaaaactcaataatatataattttactttacctatttacccmatataaaattttttatatttatataaaaatataaaatttttaaatatataattatactttgaaatggctttctgaatattatgttgtactgtaacattactaggatagcttttcctctgttttatttatttatttgtttgagaaagggtctcactctgtcgcctaggttggagtgcagtggtgcaatcatggctcactgtggcttcaacctcctgggctcaagcgatcctccagccagcctcccaaagtgttggaattacaggccgtgagccaccatgcctggccccctctatgttttat

SEQ ID NO: 69984 - DNA, 601 bp, Human
caccaaaatacgtgtgtgtgtgtgtgtgtgtgtgtgtgtaaaagtacaaaagaaataaattattaggtgagagctgggtgttctggaagacttcacagaagaggcaaggaaataatgagtaacacatggataaagggaagggggatacatcccagctactcccagctacctgggagtagctgcagtgagccatgatcgttttttttaaaaaactccctcttaaaaaaggggtgggtgggtgggtgggtggggagaggggagagatgaatcatactatgcacaaaggctgcagaaaagacartgtatgtgccccatgcagtttgcctaaagcagaggtttagacaaggaacaagagaccccttggggccagggtaaggagtttaaacttgacccagcaggcaactactgaagggttccaagtcataatcagaggcagattttaggaggatttatgtggtactggcctgaagaaacataggaaaatcttttaggaaactaagatagtagtcagaaaaggatggcatgaaaacaaaagactttttgtttgtttttgagacagagtctctctctctgtcaccaggctggagtgcagtggcatgac

SEQ ID NO: 69985 - DNA, 601 bp, Human
atttctgacactttcctagtttaaccaaattactcagaggtaacaaagaggtacagctctctcaagcaactgtaatcaccccaagcttcctgccaattaaatatttcttagaaaacatacatgttgaaatctggcaggttcatttcaggagtattaaaatttgtgaaatgttcaagactatgatcacacactaaaagaaaggaaaaatcaaaagttggggtaaaaataaacttgtgtatacacatatatacatattttggagacactcatgctctgtcacccaagctggagtgcagtggcrtgacctcgacttactgcaacctccacgcctccctggttccaatgattctcctgcctcagcctccagagtagctaggattacaggcgcgcacgacaccacacccggctaatttttgtatttttagcacagatggggtttcaccatgttggccaggctggtcttgaactcctgaccttgtgatctgcccacctcggcctctcaaagtgctgggattacaggcgtgagctaccatgcccggcttgtttgtatttttatctgcacttttagcattataaacttatgtaagaaaatacacacagg

SEQ ID NO: 69986 - DNA, 601 bp, Human
agtgagtcgagatcgtgccactgtgctccagcctgggcaacaaaagcgaaactccatctcaaaaaaaaaaaaaaaaaaatttctattcattccctagtctcctttatttcacaggtttcttccaatatacctaaaaatccagtatgagcatgctttcttatacattaaccttctcagatgtacagatgtttggatgtaatcttatgcctattgccaaatttactgttaaccatcctagggtaggacatatattttattacttttatggtatgagctgcatttaatgtgccagaatataagmacatttgtcttagtccaagaactattttcagtttagttttgtcaccagaatcatgagaggtatcttttgaccaaattcagtttcatttattgtttaactgctaagcaatgaagactattaacaaacagattatcattaactctaaataataaaactaaatacagactaaacgcttacttaactaaattataaaagttccttctaacaattccatcccttgaagtttatccagaaacctacctacctttttgctctttggaaagctgttcagcttggtcccaaatttcggtggcatagagg

SEQ ID NO: 69987 - DNA, 601 bp, Human
tggccggacgtggtggctcacacctgtaatcccagcactttgggaggctgagatgggcagatcacgaggtcagcagttcaagaccagcctggttcacatggtgaaaccccatctctactaaaaatacaaaaattagccgggcatggtggcgggcacctgtaatcccagctactcaggaggctgagcaggagaatcacttgaaaccggaaggtggaagctgcagtgagtcgagatcgtgccactgtgctccagcctgggcaacaaaagcgaaactccatctcaaaaaaaaaaaaaaaaaaawttctattcattccctagtctcctttatttcacaggtttcttccaatatacctaaaaatccagtatgagcatgctttcttatacattaaccttctcagatgtacagatgtttggatgtaatcttatgcctattgccaaatttactgttaaccatcctagggtaggacatatattttattacttttatggtatgagctgcatttaatgtgccagaatataagcacatttgtcttagtccaagaactattttcagtttagttttgtcaccagaatcatgagaggtatcttttgaccaaattca

SEQ ID NO: 69988 - DNA, 601 bp, Human
ctggccggacgtggtggctcacacctgtaatcccagcactttgggaggctgagatgggcagatcacgaggtcagcagttcaagaccagcctggttcacatggtgaaaccccatctctactaaaaatacaaaaattagccgggcatggtggcgggcacctgtaatcccagctactcaggaggctgagcaggagaatcacttgaaaccggaaggtggaagctgcagtgagtcgagatcgtgccactgtgctccagcctgggcaacaaaagcgaaactccatctcaaaaaaaaaaaaaaaaaaatttctattcattccctagtctcctttatttcacaggtttcttccaatatacctaaaaatccagtatgagcatgctttcttatacattaaccttctcagatgtacagatgtttggatgtaatcttatgcctattgccaaatttactgttaaccatcctagggtaggacatatattttattacttttatggtatgagctgcatttaatgtgccagaatataagcacatttgtcttagtccaagaactattttcagtttagttttgtcaccagaatcatgagaggtatcttttgaccaaattc

SEQ ID NO: 69989 - DNA, 601 bp, Human
gtctctcaagttacatttgttccctaagtcatgcaacattttaaacagaatgtatggtcagaaattaagtgttatatataagcaggattccatgaatggaaatgataaattgctattatgcagtagatattattaaaatgaagatttaatgccataatgtgctactgattactcaaaacattttgtgcattgcttttgtataagaagcaagtgacacaaaaaggaggacattctttgcctgtttcctgtaacagcctctgtgaggttagacacttaagattatatcaaactttcggctacmatcatatgccatgaaccaactgataactaaatcccatgtttttatttattttcatttatttttagacagtctccctgtcgcccaggctggagtgcagtggcgcgatctcggttcactgcaaccctggtctcctgggttcaagcgattctgctgcctcagccaaatataaaatacaaaaaagttttttttttttttttttagtagagatggggtttcaccatgttggccaggctggtctcgaactcctgaccttgggtgatccactcgccttggcttcccgaagtgctgagattacaaggt

SEQ ID NO: 69990 - DNA, 601 bp, Human
aggaggctggtcacatcaatctgaatccatttgtgtttctttccaaattcaaactgtgagttaaaggtaaatgagtatggagctctgccgagagtcctgctagaagactttggctcctttatcattagattgcacacacatttgacagcagaggaaaaagaaactgagttgttgatattgtacagcaagactgacttgagtaagtgttcaacggtagtaatgcgatccaggttaaatagcagttccactgatggaaggattcctaagaagaaaaaaaatctaccagtagtgcttgaaaatsagtcaacacaacaggcagtcaagtcaaagaattagtacttcataatatgctttctcccttctcttttccccactttctcaagcctcaaaaaaaaaaatgggggttaatatagaaaaggaaggcaattggtatcattactaattcccagcaaccttactggacattttatctccagaaagtcagatttggtggtgaatcaaagtaacagggaatcactacattctgaagtttcatttttattttttatttttttgagacagggtctcactgttacccaggctggagtgcagtggcaccatc

SEQ ID NO: 69991 - DNA, 601 bp, Human
tgctgaaggatgctccagctggtctttcatgcaagtaaaatttatagacatgtgaatacttctcttgttggaggccactaaaggttgaaggaggctggtcacatcaatctgaatccatttgtgtttctttccaaattcaaactgtgagttaaaggtaaatgagtatggagctctgccgagagtcctgctagaagactttggctcctttatcattagattgcacacacatttgacagcagaggaaaaagaaactgagttgttgatattgtacagcaagactgacttgagtaagtgttcaacrgtagtaatgcgatccaggttaaatagcagttccactgatggaaggattcctaagaagaaaaaaaatctaccagtagtgcttgaaaatcagtcaacacaacaggcagtcaagtcaaagaattagtacttcataatatgctttctcccttctcttttccccactttctcaagcctcaaaaaaaaaaatgggggttaatatagaaaaggaaggcaattggtatcattactaattcccagcaaccttactggacattttatctccagaaagtcagatttggtggtgaatcaaagtaacagggaa

SEQ ID NO: 69992 - DNA, 601 bp, Human
aaactgggccccaggacttaaggggagggcaaaagagaggagagaagagccgcggctggaggcgctggttaacaaaaaaccctggagtctttaatgttaattttagggaacgcccctcatttatgtccctgccccagcccttcaaacaaagaagcccttaaatttatttgaggttcgaaaacccaactctgcctgtctgtcagcaagcgggcctacacacaccggcgacccggagaacagtgccccacccaaagtaagactgagcccaacggggcaggttacgtgggcggtgctgtctcgrctatctggcttgtttggttgactttgaaaagctttctgtgcgccctagaagttatttatggagtatggtctgcttcagggctgaaggaagaatgcgatcctgaactgggaagagtcctatcccattttcttgactttcgcgctccaaaaagtagagattgggagccaacaagctgagcgatgcttgagctagtagtaaccaccctgctctacccacctccccaacacacacacacacacgattcccttgtccaccagcacacacacacacacacacacacacacacacgattcccttgtc

SEQ ID NO: 69993 - DNA, 601 bp, Human
cggctggaggcgctggttaacaaaaaaccctggagtctttaatgttaattttagggaacgcccctcatttatgtccctgccccagcccttcaaacaaagaagcccttaaatttatttgaggttcgaaaacccaactctgcctgtctgtcagcaagcgggcctacacacaccggcgacccggagaacagtgccccacccaaagtaagactgagcccaacggggcaggttacgtgggcggtgctgtctcggctatctggcttgtttggttgactttgaaaagctttctgtgcgccctagaagwtatttatggagtatggtctgcttcagggctgaaggaagaatgcgatcctgaactgggaagagtcctatcccattttcttgactttcgcgctccaaaaagtagagattgggagccaacaagctgagcgatgcttgagctagtagtaaccaccctgctctacccacctccccaacacacacacacacacgattcccttgtccaccagcacacacacacacacacacacacacacacacgattcccttgtccaccagctgacatttcctccttaagaaagcgttcgccggttggcaaaacgtg

SEQ ID NO: 69994 - DNA, 601 bp, Human
aatggggaccactggagtcaggcattgttaagaatgagcagcagcagatccgttcatctttcagaacaaagaaaatcaatgagcatcaacactaatccaaacaccgcactttggggccatttagggtagaattaaacagcctgatatacctcgaatgacctaaaagatgtcaccgaattatttttaaaattgattattatcatgacccttaattgctgtggaaggtggcattatgtttagtgtcctgattgtgagtggtataagccactttagaaaggctttttattcaaaattgttattaaaaaaaaaaatctggtgctttaaggtatatgcctccaactatccaatattaaagtgttgttatatgttacttttcgtagttatctaaggggttggtaatagtgagggcttgtgattaatttgtctatatcatcaaaaggatagagggccatgtggtatgatattatcaagaataaaaatcactaacatttattgagttcttcctgtgtgccatgctgttctgatgcctactaatttaacagataatggactcatcatatattaatgtatatgtgagatatattaaattgaaatcctaatt

SEQ ID NO: 69995 - DNA, 417 bp, Human
gtgcacacctgtaatcccagctacttcaggtaggctgaggcaggagaattacttgaacccaggtggtggaggttgcagtgagctgagaattgcgccactgcactccagcctgggtamcagagcaagactccatctcggaaaaaaaaaaaaagaagaagataatttcatataatggtaagagctgagagcagggtggctgcattcaactgagtgctttttttctaatttgcacaaggttcctgcatgggccagtagctgctctggcttaaggtaaaataaagtgctgggttggtcgaggatggatacttaaattggatgcaaatgaagacctgtctgaggagaggacattatattttattttattttattttattttattttttgagatggagtttcattcttgttgtccaggctgga

SEQ ID NO: 69996 - DNA, 601 bp, Human
atgcaggacttgttttgttaaccacaaaatgtgggattggtgtcactgtatcctagtaacaaatttttttgagtcctcccttgcagagatggtttttgagatggccacttgactgagagtcactttgagtcaggagaattctactgtggatggggccaggcccgaaaatctaggtggcatttatagaaagcagtttccaacttccttgtgcaatacaattggtgaccaacctatcaggccatatgtacaggttaattaggaagctgtgttgtttcacctggacagatgaaattcagcagaragccctctttaggttacaccctgtgataacccagtgatttcctaatggggggctgcagtctaatagctcagcacattggattgagaggaagaatgtggatattcagacatcactgaataaaactccttttatttagcatttccagaagagcaaagagtcattccattgagcctgtgttctcatccttgttgtggtgtgctaatttgaagaaactggcttccatatatttccatagtaactgaagtgaaataataaaggaccggctggcaattgctgtttagaacaaagggttaacatctt

SEQ ID NO: 69997 - DNA, 601 bp, Human
aatttgcctgatgaagatgtcattgctcatacaaatattccagcctgacaagtgggatgtgattcagagaacagaccctaccctgtcaggaaaggctgtcttaaaaggtcacctgtcaccaaaaagctgatggctttttcctcccagctgaccctgactttgtaattagggtatctactgtttggtatgggttcagggcaagcttgcagtcttcacttgatcttagccaaaaggctgagaagcagtcaagcttgcattctttcagcacaatgctcttcagcacctactaaatgacaggcawtaatggaggtgaatagcaacctacagccattactccatgaaagtgcgtccgtctaaaaggacatttcccacactggcccccagggtcgcacgttgggttagtattctactgagagccactcttctagatttgtagacttgttatttctgcagtcatctcaatggctgctttgcctccctcccttcgtccctctctatgtttattcaaatggatgcaccttgctctctggagacagcaagagtgcgaacggaatgtcagatcaagtagcagatgagttctcttttcctgatggatggtgct

SEQ ID NO: 69998 - DNA, 601 bp, Human
ggttcagataaataggtagtttcttgtgtttagagaagcagtttagcatgcttctctaaaattgagagttggttaagagcatagactctgcaaacaggctgcctggcttcaaatcttggctctactgctaactaaatatgtgaccttacacaaggcccataacatttggtgcctcagtttccttacctgtaaaatgggactgataatgaaaataactactaataggattgtggagagcatgaaatgagttaacatatgaaatgtgctttgagtagtgtctagaatgtagaaatcattatayaaatgttagctctagtttttattcctttgattagtgggtgttcccttcccatgtggagttctcttgtcaagtaagtatgtgggacttagccaccctgagaagcagaaggggggtgctgtggttcatgttcatggcttcttccccttgcctgctctgcagcaccagttatataacaaactgtgttgtcataactgatgtgacatttttgatggcgcagctgcttcagcccaagagctggggtgacatttcaaagggtgggaaagagcactgaaccaggagtccaggtcagtagctctgcct

SEQ ID NO: 69999 - DNA, 601 bp, Human
ttattcctttgattagtgggtgttcccttcccatgtggagttctcttgtcaagtaagtatgtgggacttagccaccctgagaagcagaaggggggtgctgtggttcatgttcatggcttcttccccttgcctgctctgcagcaccagttatataacaaactgtgttgtcataactgatgtgacatttttgatggcgcagctgcttcagcccaagagctggggtgacatttcaaagggtgggaaagagcactgaaccaggagtccaggtcagtagctctgcctctgcccctccgagggctcrgtttcctgaaagagttggaccagggctaccccaggctcccttcctgttgtcaacggtgtatgaaattgggaattccctttgttttcagggtcttgatgttctcaatattaaagcatgaattatggttttatcccatgggggtgtagggtatccatgaaagttcttttaagactaagttaattgcagaatagcaacctcagccacagagctttgtcagccaggaaatttgtagttctgagagtcaatttgagaaaaacacctctaaccaaacttttcatgcagacatggttcttaaaccaa

SEQ ID NO: 70000 - DNA, 601 bp, Human
atgttctcaatattaaagcatgaattatggttttatcccatgggggtgtagggtatccatgaaagttcttttaagactaagttaattgcagaatagcaacctcagccacagagctttgtcagccaggaaatttgtagttctgagagtcaatttgagaaaaacacctctaaccaaacttttcatgcagacatggttcttaaaccaaagaggaggatctgaaagtatctcattagtaagaaacaggatgtttctgggaggagagagccagtgacattagaagagaagtggtttttccgtggcytccaggatgctcagaagtggagacagccctagcgttcaccagaaatggctgcatatgaagaaacttgcctgggttaaggtgcctaaaacccagggagcagagagatttgcagactagtaaaaggggaggctcaggagaactgtattttaattttgattcactctctcatttaactttgggcagatcatttggccaccctgggcctcaatttgttcatctgttaattgggatgtgggttttcaccatagaatttctcagggctctttcgggtttccagctctaagatgcagtaaatgcaaa

SEQ ID NO: 70001 - DNA, 601 bp, Human
attggcaggtgtccatggagtctggcaagttgttggtgaccttggcaagagcagtttcaatagactggtgggagaaaagccaaattgcagtggagttaagaaatgtgtgggattgaggaaatccatgaagaacccccctcccagcccaaaagaaatgtgggctacagaaaaaaaggagtgagaggtagggagggagagagccctcctggaagggctttgcttttattgttcatttctacatgggagtagctggatccattgagaagttatccagatccctgatgaatggaaaagttgaagrtataggaaggaggaagtggtagaaggaacacaaccccttaggggatgggtagcttgagcttgacatgaacgtgcatctccttccctaagacagacaggaggacagtaaggatgggaagtctgtagagaaattctagggcataatgatgaggacaggaagttgagggagctcctgccttagcatttcttttctctgtgaagtgagaagaattaaaaagcagctgtgcttatttactggagcaccaaagaccaataacatttattctattaaaaccactcatttattcatttatctaatatt

SEQ ID NO: 70002 - DNA, 601 bp, Human
tgaggaaatccatgaagaacccccctcccagcccaaaagaaatgtgggctacagaaaaaaaggagtgagaggtagggagggagagagccctcctggaagggctttgcttttattgttcatttctacatgggagtagctggatccattgagaagttatccagatccctgatgaatggaaaagttgaaggtataggaaggaggaagtggtagaaggaacacaaccccttaggggatgggtagcttgagcttgacatgaacgtgcatctccttccctaagacagacaggaggacagtaaggatrggaagtctgtagagaaattctagggcataatgatgaggacaggaagttgagggagctcctgccttagcatttcttttctctgtgaagtgagaagaattaaaaagcagctgtgcttatttactggagcaccaaagaccaataacatttattctattaaaaccactcatttattcatttatctaatatttgtctcacacctattatgcattaggcactgttctgggtgctcggagtgtcagtgatgaacaaatcaagtcccagaggaaccgggtaataacctcatacacaaacaatcggacg

SEQ ID NO: 70003 - DNA, 601 bp, Human
caactgacataataaattataaaaaaaattaagctttcagaactctagtgctaattgagaaagaaaactgggacatcagctcagggaattgtggacaccagtgcatgttgtgtccatatgtactctccactgagaatgtggggccctgcgatgtaggaatttgtcttgtaatactgtcagagttatgagacctggatggtttgacgctgttccacagggagaagtgctgaaggtggttccacagtacaaagacaaaacaactcctggggtccctctctgaattcacgtggaaagaaaaagsaaggctgtgaatctgagctggctgtgtgcaggagctccagccagggcagacaacaagagctggagggacccatgcattaggagatggacaagcctgagggcaccagtgggcaagggcaggagaggcacccactctatctccctggtactctgtggcctcattggtgggaggaccttggggaagggatggtagaatggtgatgtgtggagagcctagttctgagctgtggccattcttcctactcttaattccccatgtgctatggaaggcctgtttcttctttgaatcctttccttagag

SEQ ID NO: 70004 - DNA, 601 bp, Human
acattagctgggcatggtggtgggcgactgtagtcacagctactcgggaggctgaggcaggagaatcacttgaacccggtaggcagaggttgcagtgagccgagatcacgccattgcactccagcctgggcgacagcgtgagactccatctcaatttaaaaaaaaaaaaaaaaaaaaagaggcagttaggagccaatgttcaaggaaggcctgttggctatggaaggacatttgggtttcattttgaatgccgtgggagattgacaacttgacctgacttatacattaaaagatacctctkcatcctggaaaaggcaaaaccacagggatggaaattacatcagtggtttccagggaattgggtgtggatggagcttgcaaaggggcacaagggaacttttgtgggtgatgtaaatattttctctcgtaattgcggtgatggttacactactgtgtatgtttatcgaaagtcatcaaactgtatacctaaaaagggtgaattttactctaagtaaattatacttcaataaacctgacttacaaaatgcatattttttaatcaaaaaaagaattgcagtaaggcttaacagaatccctctgg

SEQ ID NO: 70005 - DNA, 601 bp, Human
atcctggaaaaggcaaaaccacagggatggaaattacatcagtggtttccagggaattgggtgtggatggagcttgcaaaggggcacaagggaacttttgtgggtgatgtaaatattttctctcgtaattgcggtgatggttacactactgtgtatgtttatcgaaagtcatcaaactgtatacctaaaaagggtgaattttactctaagtaaattatacttcaataaacctgacttacaaaatgcatattttttaatcaaaaaaagaattgcagtaaggcttaacagaatccctctggcygtcctgtggaaggtacatggcagggagcaagtctggaaacagggacggttgcacagtccaagccatacgccccttcaatgctgtgcttacaattcagcctgtattatttgctgatcccagtggcttccttacaccagcttattgatgtgtgttcctagttttcctgtttacctagcttttccttcaaaactggtttgaaacctcagtgtggatagaaaccatctgcttcttttgtatgtgcccatgggagatggcttattacatattactctccttacatttaagtagtctttaacattt

SEQ ID NO: 70006 - DNA, 601 bp, Human
agtctctctgaacctcagtttactgattgttaagaaaagaccaaaaaaataaataaataaacacactgcagatacactgtgaggagtaagtgagataacacagctaaaagcaggtagcagataattgaaattccctaaatggtagctatttgtatcatttttgctatcagagaaaacatgatttatttaaggtgatgtggccagtacgtggtagaactagagcctagtttttctgattctaggtgtgtttctctttccatcacaccactcagaacattcttaattgttatcaattaattgktccagggctaactactttttaccaacttggatgcttaaatacaattgttgattattcagcaaatatttattgagcactcaccatatgttcaacactgttgttgacacaggatataatagtaagtcaaaataggctccacctctgcccctacaggtaataaagcagaatggtgagggagcacctacctcggtgtggggtctgggaagacttcctaggggaggtaacattgacactgtctttaaaagaaacatttttgttgtgatgtagatcaatatacatgcaaaatgtacattaatctta

SEQ ID NO: 70007 - DNA, 601 bp, Human
ctccctgcctcactccttactaccttaactttcgtggtaagtttcatgggtccttgcctttctttagagtttaccacctacatatgcatcctctaatcatttagtctagtttctcctggttttgatataattggaatcatgctatttgtatcttttcttcagtattacattcataatatcccagttgtatgtagctggagttgattttcattgctatatagtattctatggtattcattttatgaatatttttaattttcctatgtagcattcataaatattagtgaatattcatgaataygctatatattattcttcacctcattgctatatagtattctttgttacacaccagctgtgactatactgtaatttatttatccattctactgttgatgtggcattttatcattttgagtttggagcagttataaaagatgctgctatcaatgtgtgtgtgtgtgtgtgtgtgtgtgtgcgcgcgcgcgcacgtgtgtgtgtgtgtattctggggcacatgcatttgtgaagggttctttgaagaggaattgctgggaatcttcaactgcattagataatatacagtgttttccgaagtggt

SEQ ID NO: 70008 - DNA, 601 bp, Human
atcccagttgtatgtagctggagttgattttcattgctatatagtattctatggtattcattttatgaatatttttaattttcctatgtagcattcataaatattagtgaatattcatgaatatgctatatattattcttcacctcattgctatatagtattctttgttacacaccagctgtgactatactgtaatttatttatccattctactgttgatgtggcattttatcattttgagtttggagcagttataaaagatgctgctatcaatgtgtgtgtgtgtgtgtgtgtgtgtgttcgcgcgcgcgcacgtgtgtgtgtgtgtattctggggcacatgcatttgtgaagggttctttgaagaggaattgctgggaatcttcaactgcattagataatatacagtgttttccgaagtggtaattccatctttatattcacggtagcagaaagaatttctgttattataaattcttgctgccaatatttggtactgtccaattttttcaattttaccaaaccaataggcaagtagtagatctcattgtggttttactttacatagtctagattgctaaagaggttgaacagcttttcc

SEQ ID NO: 70009 - DNA, 601 bp, Human
atgaatatgctatatattattcttcacctcattgctatatagtattctttgttacacaccagctgtgactatactgtaatttatttatccattctactgttgatgtggcattttatcattttgagtttggagcagttataaaagatgctgctatcaatgtgtgtgtgtgtgtgtgtgtgtgtgtgcgcgcgcgcgcacgtgtgtgtgtgtgtattctggggcacatgcatttgtgaagggttctttgaagaggaattgctgggaatcttcaactgcattagataatatacagtgttttccraagtggtaattccatctttatattcacggtagcagaaagaatttctgttattataaattcttgctgccaatatttggtactgtccaattttttcaattttaccaaaccaataggcaagtagtagatctcattgtggttttactttacatagtctagattgctaaagaggttgaacagcttttcctatatttattggacatttggatttcctcttttgtgaggtacctgttcttttgccactttttaaattaggttgtaattttctcattaatttgtaggtgttctttatgtgttgtaaat

SEQ ID NO: 70010 - DNA, 601 bp, Human
atttacaatgcttaatatgcagatcagcttaactctcattggaggcagattattgataacccctttttatagatgaggaaagtaagattcagagagatgatgaaataaacgtgttcaggcacatcactgaaagaacagtctacggttggaggagtgctgttgctctatcaagcatacaccagactacatgccttctgcatttgagcatagacacccccagaactccctgggcctcctacctccagctatgccgtcctccagggtcccctcccagcccagctctggggctgcctctattaargctctgctagcatctctagacttgtgcaggcctggttactgtcaactcttgggttgagtttctgcccaaagttctgaggtcagtctccacccctgcccttctacatagttccctcccaaccaaggaaatgagttcacaacttgttgagttctaggaaccaaattaggagttgctctgggcatcttgtttcagtcgcgacttgaaaatgcggttgaggttttatgactgctttgttatacagtggcctagagagaatttatggtcgcagtgcttcccagcaccccctcccgcttctcgttg

SEQ ID NO: 70011 - DNA, 601 bp, Human
acaaggagagggtttgcttctgctggctgtgcaaaggcatggggaaatgctctgtgtgtgaacacagcccagcagtgctctattcagcgtgacaacttcctactttggaacacatggctcttcacagggtgactgtaaattatgcaactccagagtcaaagaatgaggaataatgggggaaaggaagggacaaactgcaaacttcagcctggatctgaaatgtgagtgtggagacccaggctgcttggcaattgatgggaggagagtcttcaacgactgagaaaaaccaggaagtcctgtagggactacttgtgagagtggcttttactgtttaaaaaatgtaaatgttcttttcaaactctgtttatcaattcagggagagttttagaaacttggagggacatttacaaaagaaagtagtcacatgcgttaccaaaagtaattgaatgccatacatggtatgtaacctttgtcccgatggctccaactcgtccttttttattattgcttcatgctaaaaattggtgctcctaagggcaattgtacagattctcaccttctcctccacccgcaatggtcctggaatgcagtgaactctgct

SEQ ID NO: 70012 - DNA, 601 bp, Human
gtcaaagaatgaggaataatgggggaaaggaagggacaaactgcaaacttcagcctggatctgaaatgtgagtgtggagacccaggctgcttggcaattgatgggaggagagtcttcaacgactgagaaaaaccaggaagtcctgtcgggactacttgtgagagtggcttttactgtttaaaaaatgtaaatgttcttttcaaactctgtttatcaattcagggagagttttagaaacttggagggacatttacaaaagaaagtagtcacatgcgttaccaaaagtaattgaatgccatayatggtatgtaacctttgtcccgatggctccaactcgtccttttttattattgcttcatgctaaaaattggtgctcctaagggcaattgtacagattctcaccttctcctccacccgcaatggtcctggaatgcagtgaactctgcttcgataagctttgtggaatgttcctgtctcttggctgactgtcatctctcatgacttgctgctttcagtggtcccacctcaagcattattccccttctcttgttctgctctgaatctgcgatggcccagaaaactaaacgaccagatttgtcac

SEQ ID NO: 70013 - DNA, 601 bp, Human
gggaaaggaagggacaaactgcaaacttcagcctggatctgaaatgtgagtgtggagacccaggctgcttggcaattgatgggaggagagtcttcaacgactgagaaaaaccaggaagtcctgtcgggactacttgtgagagtggcttttactgtttaaaaaatgtaaatgttcttttcaaactctgtttatcaattcagggagagttttagaaacttggagggacatttacaaaagaaagtagtcacatgcgttaccaaaagtaattgaatgccatacatggtatgtaacctttgtccckatggctccaactcgtccttttttattattgcttcatgctaaaaattggtgctcctaagggcaattgtacagattctcaccttctcctccacccgcaatggtcctggaatgcagtgaactctgcttcgataagctttgtggaatgttcctgtctcttggctgactgtcatctctcatgacttgctgctttcagtggtcccacctcaagcattattccccttctcttgttctgctctgaatctgcgatggcccagaaaactaaacgaccagatttgtcacaatagtgtgtagagcaagaatg

SEQ ID NO: 70014 - DNA, 601 bp, Human
gtcgggactacttgtgagagtggcttttactgtttaaaaaatgtaaatgttcttttcaaactctgtttatcaattcagggagagttttagaaacttggagggacatttacaaaagaaagtagtcacatgcgttaccaaaagtaattgaatgccatacatggtatgtaacctttgtcccgatggctccaactcgtccttttttattattgcttcatgctaaaaattggtgctcctaagggcaattgtacagattctcaccttctcctccacccgcaatggtcctggaatgcagtgaactctkcttcgataagctttgtggaatgttcctgtctcttggctgactgtcatctctcatgacttgctgctttcagtggtcccacctcaagcattattccccttctcttgttctgctctgaatctgcgatggcccagaaaactaaacgaccagatttgtcacaatagtgtgtagagcaagaatgaataggatataattgaggacctgaggaactcttctagaagtagagtgtttgtgctttagtgcttggacttgtctgcatttctgcctatctatgacacaggattaagtatgtaaaaatgaatt

SEQ ID NO: 70015 - DNA, 601 bp, Human
agtacagaggctccaagtcccgagtctgcccgtgtgcaaaccacaaggaggtttatatgtctggagtcacaaaaaaaaactggaacaatgggtgccctcatggagtcagtagtttctctgggtgtggtctcactaaagacaggggcgggaaagaaatccccatcacagactcgtgtagacctgtgacttgtgggcattcagactgtgttattccgctgccaggcctagggcttgggggtggtgtcctgtggatgtgtgtgtgtatcctgacaaaggagggacatggaagggaaggatcccwtccatgaatgaagggggttgactctggcataatctaggaagaattctaggaagactcagttatttctggttggtttacaggagacaaacactgaacatgttgggctgccttgccttgctggtctcctagtggaggaggctctcattgctggggcttcccgttggccctagctctgcatctgctctcccatatcagcattaccagaccatgagcactgaggctgtcacaggacaaggagcctggccccagacctcattcagggctgctgacccagctttgggctccaccgtagacgtgctc

SEQ ID NO: 70016 - DNA, 601 bp, Human
ccatcacagactcgtgtagacctgtgacttgtgggcattcagactgtgttattccgctgccaggcctagggcttgggggtggtgtcctgtggatgtgtgtgtgtatcctgacaaaggagggacatggaagggaaggatcccttccatgaatgaagggggttgactctggcataatctaggaagaattctaggaagactcagttatttctggttggtttacaggagacaaacactgaacatgttgggctgccttgccttgctggtctcctagtggaggaggctctcattgctggggcttccygttggccctagctctgcatctgctctcccatatcagcattaccagaccatgagcactgaggctgtcacaggacaaggagcctggccccagacctcattcagggctgctgacccagctttgggctccaccgtagacgtgctcagtaagcaagcctggggtctaggggcagacacctgggagcagagtcacaggggcaggtttccccaagtgtagcctgaaagtttagtggtatacaaatacacactttattttaatgtgttttaggacaaaaggttcctaacacatcaaaaccatagtttt

SEQ ID NO: 70017 - DNA, 601 bp, Human
acacacgagcaaacacacacatgcactactaccagaacagaatagtcttgctcaccatgagcctgacacagagctctgtgcgggagccaattgaagagaagcggtttcagcacaatgaagggtaccagcctggcttgaatcctggcagtgctaccttctagttttgtggccttgggcaactaggtttgaggatgatatgaaacagtgtagaaattactgagcccagtactaggaacataataagataattgtggttgttattgttcactaattggcaaacatttgctatatgtacgtttgkttccttgtctaggctgtaaacctcctgtggattcttggggcacagtgaatattcagggtacatttacataataagtagagtggtccatttacattgctgtgggttctctcataaattggctgttaggtgtagaagtttttgcaagcttatatgaaacttcagtatacatacatgatatgtatcatttgtgtgtttggttcacagtgggttaagaattgttgagcttatcaaaccacagttctgtattgagtacttactgtatacaggtgagagggaagtgtatacccccactctcttcct

SEQ ID NO: 70018 - DNA, 601 bp, Human
aataagataattgtggttgttattgttcactaattggcaaacatttgctatatgtacgtttggttccttgtctaggctgtaaacctcctgtggattcttggggcacagtgaatattcagggtacatttacataataagtagagtggtccatttacattgctgtgggttctctcataaattggctgttaggtgtagaagtttttgcaagcttatatgaaacttcagtatacatacatgatatgtatcatttgtgtgtttggttcacagtgggttaagaattgttgagcttatcaaaccacarttctgtattgagtacttactgtatacaggtgagagggaagtgtatacccccactctcttcctgatgagaagactgctgtctctgactgtcccatctcctttctccacagcttggatgtgtacctctgctccctatctctacagatcttggagtttttagctctccagcaggtgctaggaccaggtttcagcaatagaggagtgggtggcagggttgtagtgctaagtgcaccattctttacacttatttctactgctaggagcaaaaaaatccaaaggaaacatcatcttggtttaggca

SEQ ID NO: 70019 - DNA, 601 bp, Human
attcagggtacatttacataataagtagagtggtccatttacattgctgtgggttctctcataaattggctgttaggtgtagaagtttttgcaagcttatatgaaacttcagtatacatacatgatatgtatcatttgtgtgtttggttcacagtgggttaagaattgttgagcttatcaaaccacagttctgtattgagtacttactgtatacaggtgagagggaagtgtatacccccactctcttcctgatgagaagactgctgtctctgactgtcccatctcctttctccacagcttrgatgtgtacctctgctccctatctctacagatcttggagtttttagctctccagcaggtgctaggaccaggtttcagcaatagaggagtgggtggcagggttgtagtgctaagtgcaccattctttacacttatttctactgctaggagcaaaaaaatccaaaggaaacatcatcttggtttaggcagtggttacacaggtgacacagctataaaaatccactaaaatgtacatttaagatgtgtatgttttactataggtaaataatatctccattttttaaaaggtgatcataatgct

SEQ ID NO: 70020 - DNA, 601 bp, Human
aggttaagtcaggtgtccaagttcactctcttagggttgagccaggatgtgatcctgagagctttcctaaagccccatattgcactattttagggttaccattaacagtatgttatgtatgaacgatcttattcctgagtagcttaaaatcaaataggagagacaaaacatgtaagcaaattaacagcaatgcatggtaaagtcccataagggacagagaatgtgctgtgtatgttcctaggaggaaagaggcatttgttcagatggaggcaaggaagatgccaaacaactcaccatctgmaattcattttgttgggcctagcatttttatcctaatgtccaagtatgtatttctgatattctaagaattgccaaaaataattatgaagctgtgcctagccccaggtgggcgagagatcctctcaaatgtcccactgtagcatgtctctttatttcctttctgtcctttgctgaaaatgaaaaatgtcccattgtactgagtagagctgctctctccctaagctcaatggccatctggctcacaccttcctgaacaaagaggtgagttgtatctgggcctccactgccttgtgtagtagtt

SEQ ID NO: 70021 - DNA, 601 bp, Human
cagaatgtgctttcagagatcattctttcaaaaattgttcactagagcctactgtggccaggttccctggtaagtccaggcttccagtataaaatgacatatggactttctcctgcaagcattcacagcattctggagaagtttggggtccaaaactgaggttcttaatgtcttttgggtcacaaacccctatgagaaactgatggaaactatgaagaatttccttagaaaaatgctcctgcattttttaatttaaaaaacaaatgtttgcgtatgggggttgctgtggtttgaatgtgcrtcccctacaaaattcatgtagaaacttaatctctaatgcaacagtatttagaggtgaggcctttaggaggtgcttaggtcacaagggttccaccctcgtggatgggattagcgtgggttttttgttgttgttgttgttgttgttgtttgagacagagtctcaccctgtcacccaggctggagtgcagtggcacaatcttggctcactgcaacctctgctgcccgggttcaagcaattcttctgcctcagccacctgagtacctgggattacaggtgcctgccaccgcgacctgctgattt

SEQ ID NO: 70022 - DNA, 601 bp, Human
tggagaagtttggggtccaaaactgaggttcttaatgtcttttgggtcacaaacccctatgagaaactgatggaaactatgaagaatttccttagaaaaatgctcctgcattttttaatttaaaaaacaaatgtttgcgtatgggggttgctgtggtttgaatgtgcgtcccctacaaaattcatgtagaaacttaatctctaatgcaacagtatttagaggtgaggcctttaggaggtgcttaggtcacaagggttccaccctcgtggatgggattagcgtgggttttttgttgttgttkttgttgttgttgtttgagacagagtctcaccctgtcacccaggctggagtgcagtggcacaatcttggctcactgcaacctctgctgcccgggttcaagcaattcttctgcctcagccacctgagtacctgggattacaggtgcctgccaccgcgacctgctgatttttgtagttttagtagagacagggtttcaccatcttggccaggctggtcttgaactcctgacctcgtgatccacctgccttggcctcccaaagtgctgggattacaggcatgagccactgcacccagccttgga

SEQ ID NO: 70023 - DNA, 601 bp, Human
ggagccttattaagaacagagcatgtcagtgggagggagggagggagcagcagcgtgttcacagctctggagggcaagtgaggcagcctccttgatttgcaaagtgctttgcagtcctttttcattatttctgcaacagacccatgagatgggtagagaaccaccctgctccccacaaattgtagaacactaggaggtagtgggctgtccatctaaaggtgtccttataataactggatggtccctgggtttgcccctctacaaccaacatgatgtgataacctagattagaatgcctccscactccccagaccttggagtcttgtgattgcttgtatcagtggcctcttcagaacaaaagcatacaagcttgtccttctatgagattgtaacccctcaagcatgctcactagttggaggaaattctgacagccctactccaggcttgaggctcgccctggagcctggtaacttgagcctccatcgtaggtgtgtgtgagaaaggaaatgcagaaatggagtgagccgaggaaaaacccaggggcgacagatcctcggagagcatttcatccagtcctttcccttgacacgtgggagagca

SEQ ID NO: 70024 - DNA, 601 bp, Human
ccctgggtttgcccctctacaaccaacatgatgtgataacctagattagaatgcctccccactccccagaccttggagtcttgtgattgcttgtatcagtggcctcttcagaacaaaagcatacaagcttgtccttctatgagattgtaacccctcaagcatgctcactagttggaggaaattctgacagccctactccaggcttgaggctcgccctggagcctggtaacttgagcctccatcgtaggtgtgtgtgagaaaggaaatgcagaaatggagtgagccgaggaaaaacccaggrgcgacagatcctcggagagcatttcatccagtcctttcccttgacacgtgggagagcaatgtgacacggctttgctgctagatggtgaagactggcgatgaggtgataatgatagctagcatgttttgagtgccatgtcccaggcatggtgcctgatatcacctgtgcaccctgcgagatgagctttgcagcgtggttgagtatctgtgttatatacagagaccctggtgctagagccccagcacccagctccagcaccttctgggtgtataactgggtttcttattgtggctgtttcaa

SEQ ID NO: 70025 - DNA, 601 bp, Human
cgtgggagagcaatgtgacacggctttgctgctagatggtgaagactggcgatgaggtgataatgatagctagcatgttttgagtgccatgtcccaggcatggtgcctgatatcacctgtgcaccctgcgagatgagctttgcagcgtggttgagtatctgtgttatatacagagaccctggtgctagagccccagcacccagctccagcaccttctgggtgtataactgggtttcttattgtggctgtttcaattggccacagattttgtggtttaaaacaataagatgtattgttttayagttctattggtcagaagccccattcaagttcaccagcctaaaatcaaggtgtcagcaggctgtgttcccttctggggcttctaggggggagaatccattccttgctcttggagattttggcagaattcaatgcctgccgttataagagcccccttttcatcctggctggaaaccgagggctgttcccaggttctagaggtggctgccacatatcttggcagaggcccctgctttcctctatcttaaaagccagcagtggcaagttgagtttttctcaggcacatctgactcttcctcca

SEQ ID NO: 70026 - DNA, 601 bp, Human
tgcagctttgcctcccaggttcaagcaattcttgtgcctctgtcagcctcccaagtagctgtgactacagcgtgcatcaccacgtctggctaattttttgtatttttagtagagatggggtttcaccatgttagccaggctagtctcgaactcctgacctcaagtgatccaccaaagtgttgggattacaggcacgagccaccgtgcccggcccaggacttgggttttagtctgcccatttacacttacggctttgtggtatttagggcatttggctccttgggactaatttcatctgtascccatctggacacttataaggtctcaaacaatcctcgtttcaggtgccctttagaggatggttcaaaaactttcacatcagcctcagggacagagctgtgctgtcattccaagggcttctggctccactgaggctgaacacaacttggcagccagtgaaatctttctggacagctgatagtgtcccccatctccatgggagccagctaaggtaggacagggtgctaaccagtaactttgctgtgctaggctgcccctgacacaaggcagccacaggaaaagccattatatctctgtagag

SEQ ID NO: 70027 - DNA, 601 bp, Human
ttaggagagagatgatctgacttctactttgagtttgctgtggctgctgtgtggaggacgggctgtggaggggcaagagagggagcagggagaccaaggagggggcatcatagcctttcagttgggtgaaagatggtggtaactgggaccaagtttgtggcagtagacagtgagaaattattagaatcaggcagtattttagagttagagtcaatagggcctacttatgattaggatagtggtgtgctggtaaaccagccaagggtgggagggaggcccttgttggtagagcttgccagtktctgtggtgtaatattcccaccacagctggtttcaagctacccatctggccagtgagtgatgcaacgttagctcttgtgagccagcacaactcactccagcacaccactgggtcaggccatggaagatagaagcaagaaggactgaagagcattccatggctttgctctgagcacctgggtagatggggatgccgtctactgaggtaggaaagactagaggtggaaagaaagatcctggggcagtggcaggaaaaaatggttttgctctggccatgttaatttttaaatgcacattagat

SEQ ID NO: 70028 - DNA, 601 bp, Human
agttttgggcacttgcatcctttatgtcatttaagtgtcagtcctttcaataactatgagtttggtggtttcttctccattcacagaacaataaaccgaggatgcaagggaccaagaaacttaaccaaggttgtacaatcagtaaatgacagagctggatttgaacttgggtctgaccctgccccaagggccgaatcattgcccacactgccctccagaaagcatcccactcttagcttgatgctacatttttgggatttaaaaggggatctttaggaagttttgaacagcctttataccrgagaagtaatcacagaatggttgctcagagaccagactctgccctttgatgtgttgtgtggttttgttttttaaggggtgtggcgggtagggaaaaagaggaaggtggggaggggaaactgtttgtttcattttgttttattggcccatgcagtttttttgtttttgtttttgttttttaaagaaaacaagaagaagaagaaagagagaaatgtaattgttttaggcaagtctgcgcgcccccgccactgctcctggcctcctccattccctgctgtctcaccacctgcccatttgacac

SEQ ID NO: 70029 - DNA, 601 bp, Human
tctgcgcgcccccgccactgctcctggcctcctccattccctgctgtctcaccacctgcccatttgacacacgtgacacttgcttggctcaggaggcatccagtgtcccgtgctctagaggagcccaggtgtagtggcctctgcaggcaggctcttggcttcatccttgcacctcagggagtgagcacctggttcccaccctgtctccaggcctgagccagtcactggggcctggggtgtgtttgatttgcactctctgctgctcccttcctgaccactgccagctacctaagacatcactgtgcttcaacggtaagagctgtggtctttggccaggcacagtggctcatgcctgtaatcccagcactttgggatgccaaggcaagacgatcacttaagcccaggaggtcaaggctatagtgagccatgacagtgccattatgctctagcctgagtgacagaggaagaccctgtctcaaaaaaaaaaaaaaaaaaaaaaaaagaattatggtctttctgattctatacatactaaagcaatcccacctctttccctggctttattggtattattttccctggtattattgttgttattttg

SEQ ID NO: 70030 - DNA, 601 bp, Human
cgcccccgccactgctcctggcctcctccattccctgctgtctcaccacctgcccatttgacacacgtgacacttgcttggctcaggaggcatccagtgtcccgtgctctagaggagcccaggtgtagtggcctctgcaggcaggctcttggcttcatccttgcacctcagggagtgagcacctggttcccaccctgtctccaggcctgagccagtcactggggcctggggtgtgtttgatttgcactctctgctgctcccttcctgaccactgccagctacctaagacatcactgtgctkcaacggtaagagctgtggtctttggccaggcacagtggctcatgcctgtaatcccagcactttgggatgccaaggcaagacgatcacttaagcccaggaggtcaaggctatagtgagccatgacagtgccattatgctctagcctgagtgacagaggaagaccctgtctcaaaaaaaaaaaaaaaaaaaaaaaaagaattatggtctttctgattctatacatactaaagcaatcccacctctttccctggctttattggtattattttccctggtattattgttgttattttgctaaca

SEQ ID NO: 70031 - DNA, 601 bp, Human
ctttggccaggcacagtggctcatgcctgtaatcccagcactttgggatgccaaggcaagacgatcacttaagcccaggaggtcaaggctatagtgagccatgacagtgccattatgctctagcctgagtgacagaggaagaccctgtctcaaaaaaaaaaaaaaaaaaaaaaaaagaattatggtctttctgattctatacatactaaagcaatcccacctctttccctggctttattggtattattttccctggtattattgttgttattttgctaacataatgaggctcggaggcatsgtttttctgccttttggccttcttgctggtgatatgttcaatttaatggtgttcttcagtgtcactaggcgtggctggagctgagtggaagctgccatcaggtagtctgagaggagcacacaactgcgtaaatggctgtgtctgcctggctcccttggaccgagaagcctccattccctgcctgggcagtgctgggcttggttacctgaagaggcatagcaggattgacaggaagctctcaccccacggttggcatgaccagatagccctgagcatgatgccagggctggtggcactttg

SEQ ID NO: 70032 - DNA, 601 bp, Human
cccccattgttgtttttacccatgtgaaaacaagtactggggaccaggagctataaataattggatctctgctgacaaccaggcactgttcatggatgggtgggtggatggatggatggatggatggatggatggatggatggatgaataaatagatagaatttaatcttcacaataacccattgagattaagtttcattgtctccatttcacagattaaaaaacaaaacaaaaatgcaaaaccttgaggcccagaaactcaagtgtatctaattccaaagtacctaaaaccatgactaaacagaatgcaggtacccagtgagtgtctgtggaatgaacgaaatcctagcttgttacactcttagaacttctcgagcttttccaccaagtagcttttgtggaagaagatggtgagtgtgtgcccaggagagtcgaagggcatcgcctgtagcagtccacctcaagccagagttgtgtttttttaacatctggctttttattttaaaaatccatgtgaatttctgtattatccttcatatggtgaaacaaactcctcctgtttgttttacaggaaaaatgatgcttttgatcatttggtcac

SEQ ID NO: 70033 - DNA, 601 bp, Human
accactgagactcagcccacaagactttgatgtcacatagctaagggccccttttctggttcatgtttcagtgactgggtttctgagcatcttctctaatataggggtccagactccaggatttccattgactcgcgataaggtttcttcattctttgtgtctttgctttcctcttcctggaaactgagttcaggcatgtccagagtcatgtgtggtttaaaactgaaaaggctcatagagaccatccagcccttgcatttctcagatggggaactgaggcccagagacagaaagggaggstgtgccccgttgtgctctgtcagtctgcaacctctcagcccgggtctgtggagttggtgccctgggtgtctgtccctgtcaggagacagctgaggctttgttcagcatttcttatctggttaatccccaccctgtgggtatgtcatatagccaggacccaaagacaggaagagatgaggagaatgaggatgtacaagtcccaaaacaggatgacaccattacctgggcagtgtggcttatgctttatgtgaaagactctgttggtccatgctcagactcagcccagcctactccatggcc

SEQ ID NO: 70034 - DNA, 601 bp, Human
tcttatctggttaatccccaccctgtgggtatgtcatatagccaggacccaaagacaggaagagatgaggagaatgaggatgtacaagtcccaaaacaggatgacaccattacctgggcagtgtggcttatgctttatgtgaaagactctgttggtccatgctcagactcagcccagcctactccatggccaggcccagaccttgactggcaactcacctcccagccctctgaaatccaccgtggggtaggctcagagcagactcacccttacccaagaaaagaactccattcaggtctckgcccatatgtcacctcttccaagaggccttccatgacaccctgtcttaaatagcagtcctcatcacttgccgtctccacgctctgcttaattcttcatttattaccacctttcctgtatttgtgtgttcattttttcttttccttttctagaatatatgttccctgagagccaggtccgagtctgttttgtccctagcacctagaagagtacctggcatgttctctgtgagcggggattagagagagagtggaacttggggaacaactgggagggactaaaagaactgggaaagtgggag

SEQ ID NO: 70035 - DNA, 601 bp, Human
actccatggccaggcccagaccttgactggcaactcacctcccagccctctgaaatccaccgtggggtaggctcagagcagactcacccttacccaagaaaagaactccattcaggtctctgcccatatgtcacctcttccaagaggccttccatgacaccctgtcttaaatagcagtcctcatcacttgccgtctccacgctctgcttaattcttcatttattaccacctttcctgtatttgtgtgttcattttttcttttccttttctagaatatatgttccctgagagccaggtccgrgtctgttttgtccctagcacctagaagagtacctggcatgttctctgtgagcggggattagagagagagtggaacttggggaacaactgggagggactaaaagaactgggaaagtgggagggacgtggtcaaggaagagaatgagcacccttttctgaaccacttaaataaatctgaatgcagactgtgtttgaaaagagctgcttcaaggggctcatctgtgattccttgaaaaatcaccaggcttggtactaggcactggcacctgaagtcaggggtttttgattccctggcagtcca

SEQ ID NO: 70036 - DNA, 601 bp, Human
tgacactcttgttccccaaaggctccatgcccccttgtctgtgggttggcaccacataatgacatgttaacccttggcctgctgatgttgattttaccttctcttgagggaatataaccaaggcactggaccaaaataaacagcccagatgctgtgctgacccggctctgctgggaagcatggtattgatttgcccccagcctctctaccttcagtaacctcatctctgcctgaggctcctaagctgggaggttgattcacttctttccttggcagtgtattcacccaaacacccacaccyactttgtttatattcctaaagaagccagcattagctatttttaaggactgtgagtggccctaggtgcccaaccctcctggtctggctgtaggcaggaggtgacaccccaaggagagtctacctgtctcaacctctctggtgggaaaacccagtagccaccagcctagggaatgccaaaggcctaagcaaacacttgtgcagccagccagcctcatggccttggccctctggccagaatgcccttaggctgagggtactcatggttggtggggtggggcagttcagactgatctccaaaga

SEQ ID NO: 70037 - DNA, 601 bp, Human
gcagctgaatactgtctttagggaagtgcagctggaaagagggtttagctgtgattcagccaggcctgcagttcctcagccttgcccatgaggctctaatagccagtttaaggagagctcactgaaagtctgcatgaacccatgaactgtttcacagctgacccagcttcccagttctgcagcttccattttcccctgtccctgggtggtttgcttctcaaatccagggagtcttctccgagggtacaggagtttttgagggagtgtggttcagaatgggaccagccccttcccctctggktcccccccaactcctattccagtgaccacattgggcatgcagggggccctttccaactcaaagatcctccaagagaaaacattctagccttaaaaattgaggaaaacagtctacctctgtccccctggtcatctgcttgagccagagaatctgtttcactttgggggtgggcagtgtgtggccatcgggagctacactggctatttgcttgccccagtggctagttaatgttcagccaccagctgcctgtgaaaatgctgtttatgtctttcttaccccacagcccctcggggagtttaa

SEQ ID NO: 70038 - DNA, 601 bp, Human
tgctgtgcagccaacagcctctgtgtccttactctgctgggatcacccagccctgcctgggagctaagagagtggcccagccttgtaggtagccacttgccctttggattaagatgaatatgcatgattctggcaggagataagatatttatcttatttatttgacatgcatggatttcttggctctgtgtgaagtaggaagggaaatggagtggtggaagttggtagatgggcattttatgtacacgacttggacctttatcatttgaaattttcacaaagggggatcaaggctctcccrttttcactgagatggtgattctttgagtcatagcctattttgacttggagaagctgggtaccaggtctccactcaagttcaggcagtcattcttggtttcacttctcaggtaaagaggcatgttctcccattattgcttctgagatctttcctaaagatgatgaactggttgacctttgctgacaagtccacattagtctgctgtggggagaagaagtgagtggtgtgggcaattctggctgaagtttaaattgcagaattgaaccttagatatgagtttcatagtagatgtgttggaga

SEQ ID NO: 70039 - DNA, 601 bp, Human
ctctgtgtgaagtaggaagggaaatggagtggtggaagttggtagatgggcattttatgtacacgacttggacctttatcatttgaaattttcacaaagggggatcaaggctctcccgttttcactgagatggtgattctttgagtcatagcctattttgacttggagaagctgggtaccaggtctccactcaagttcaggcagtcattcttggtttcacttctcaggtaaagaggcatgttctcccattattgcttctgagatctttcctaaagatgatgaactggttgacctttgctgrcaagtccacattagtctgctgtggggagaagaagtgagtggtgtgggcaattctggctgaagtttaaattgcagaattgaaccttagatatgagtttcatagtagatgtgttggagaaaagagagcctgggttaactgtatcttttctagtcccttcacaaaacacaggcacgcacacacatacagaaggagagagagacagagaaagagatcattcagtttgaatccatagaattgaccctgggaggtagattagaagagagaaagggaaagtggaggtggctttcttaggagctttag

SEQ ID NO: 70040 - DNA, 601 bp, Human
ctccatcatgggtcccatcacagatccccccccgcccgccccacacacatttgtgggacgactttttttcagcaggcctgctgcatcctcctgatatctagccacaagaggaggttttcaaaacgtgggaccaagaggatcaggcttcccccagtctgacagcctctgaggtaccaacaaggcctggcattggagcaaggttggctactcctcttctctcttaatccagaaaactgcatcctttcctaaaggctggagacacacagctatccttgattgcagtccagtcttgcctgtgcaygtggccagaggcacagcgggttctaacaccttggggctgagaccagattggagagtgggggacaagcacatgaccacagcaccacagtcacagagtcttcctccccaccttgttgactttcttttttcatgttaataatgtcaacatagtggtggccatcccactgctgcaagaacatttgttggaaagatacttcttttggaaaacaggctcaggggagcaattgttccccctcaagtctgcctgcactcctgatctctttccacgctgcagggtacacagcagacagcagtagactca

SEQ ID NO: 70041 - DNA, 601 bp, Human
cccaaataggtggtctcaaaagagaaaaaagacttatgttttaataaaactccctttaataattaggtgctttaataaaaggccacttgggtcactgtctgcctcctcagcctagacttcctgcagttggaaaaaaccttccaaggacagagagggttctagggacatactggacaggccctgttcccagccgctgagcccacagggactgacaaggcaccaccccataagaatgtctgtacccttttggagcctacatctgtaggtgctgaggcatcacattcttcaggttctaatgaaraattattgcagtgatgagttgtagaaataatcatttaatgtttattattctgaggaaaatttaagaatttctgtattcagagcagattgacaaatatggcaaccacttcacataatccacacgctagatccttataaatgtcattgttatcactggagcctcagctatggttgtctttcccaagctggatgaataggactgccagttattcactaaagatagagacagcacatggcttctcttaggcctggttgctgggcagaggctatagcattgccttggggtagggggtgcaggtct

SEQ ID NO: 70042 - DNA, 601 bp, Human
agactctgtgggatatggtttgatttgcctcagctcaggaagcccaccccgatggagaaggagaaggcaggtagaagccaagggaatgacagtcaaggccaggatgcctccacagggaagagtgctccttccaggaggtggcatcagcaccgtccagctctctctagggctccgtactctctgtgtacatggtggcccaggctttacttcctgctttttggagtgggacctcgagaaccaagcagtcctgccactgcagcccaagcggagcatgcagttctttgccacaggccttacagcrctctgacgctgctcccatggaacttttcccaaccaattcagagcactttgagggccacagtgatgctgggagcctgtgttgtgagtcccactgctatccagggaaggccagtgtgaatgagtagcagtgctggggagtaaagcatcacttctcaagccctgtcctcaggctcatgtgcagcactagcgatgcagcactgactgcacacagcatgccactcagtcactgaggaggggaagtgagccccttttagttctcttccagtgcttcccatcgagttgaggagagtccattgggcac

SEQ ID NO: 70043 - DNA, 601 bp, Human
agcgatgcagcactgactgcacacagcatgccactcagtcactgaggaggggaagtgagccccttttagttctcttccagtgcttcccatcgagttgaggagagtccattgggcactagaacagcttaatatccctctaaagcttgccaatcttttgaaacaaatagtctgttataggtttgtttgcattgtatttgtttccatggttatctcctatttaaagcaggtgataccatttaaggcaacaatgtaaaatttcctttttaaataataacaaataataataatatttgtttgcagygtatagaattaaactaccaagcaaatgaagcataatggtataggctatggccaaaaatcatgagggtaatggagtgactcaagtttgagaaatgctgaaccagacctgctgctttccttatcctgcagtccagtgtcccttcgtgacaaggcatttgagaaggtattttgattgagtgtatgtttataccactcacaaggaggtcccagttacgagcctgtgggagctgggcatgagcagaagctgtgctgcttgctggcagaaactggcctgagctgcaatgggaagctacactgggaa

SEQ ID NO: 70044 - DNA, 601 bp, Human
aaccagacctgctgctttccttatcctgcagtccagtgtcccttcgtgacaaggcatttgagaaggtattttgattgagtgtatgtttataccactcacaaggaggtcccagttacgagcctgtgggagctgggcatgagcagaagctgtgctgcttgctggcagaaactggcctgagctgcaatgggaagctacactgggaagatgaaaagccctggcctcagaagccctgtacctggaaaagggctaaatcccagggtggtcactgctagttagggggtgctgtgtcattcattcatcycactctcctgccagcccaggacagtctctggggcacagcagtgatagcagaaatgctaatagcaaacatgcattggactctcactgcattctggcacttcacctgagtcatttacttctcataatgctgaaaggtaacagtggtagtggtagtaataaggggaggagaagaaggaagatgaaaaaaatgttaatatttattgaatattcacccccaaatcatttatagattgaacataatccctatcaaaatcccaggtgccttctttgtagaaattgacaagctgattctaaaattcaa

SEQ ID NO: 70045 - DNA, 601 bp, Human
aacaaaaactaaaacataggggtaaatcttcatgactttggcaaagcattcttaaataaaacatcataaacaacaaaagaaaaacaatagataaattagactttatcaaaatttaaaaattgtatgctttagagcagtggtccccaacccctgggccacagactggtgggaacccaccaggccatacagcaggaagtgagtagcaggtgagtgagcaaagcttcatctgtatttacagccgctccctatcgctcacattactgcctcagctctgcctcctgttagatcagaaggagcattmgattcttataggaatgggaacgctgttgtgaactgtacatgcaagggatctaggttgcatgcttcttataagaatctaatgcctgatgatctgtcactgtctcccatcacccctagacgggaccatctagttgcaggaaaacaagctcagggctcccactgattctacattatggtgagttatataattatttcattatatatagcaatgtaataataatagaaataaagtacacaataaatgtaatgtacttgagtcatcctgaaaccactccatcccccacaaccccagtccatggaa

SEQ ID NO: 70046 - DNA, 601 bp, Human
catgactttggcaaagcattcttaaataaaacatcataaacaacaaaagaaaaacaatagataaattagactttatcaaaatttaaaaattgtatgctttagagcagtggtccccaacccctgggccacagactggtgggaacccaccaggccatacagcaggaagtgagtagcaggtgagtgagcaaagcttcatctgtatttacagccgctccctatcgctcacattactgcctcagctctgcctcctgttagatcagaaggagcattagattcttataggaatgggaacgctgttgtgaactgtacatgcaagggatctaggttgcatgcttcttataagaatctaatgcctgatgatctgtcactgtctcccatcacccctagacgggaccatctagttgcaggaaaacaagctcagggctcccactgattctacattatggtgagttatataattatttcattatatatagcaatgtaataataatagaaataaagtacacaataaatgtaatgtacttgagtcatcctgaaaccactccatcccccacaaccccagtccatggaaaattgtctcccatgaaattggcccctggtt

SEQ ID NO: 70047 - DNA, 601 bp, Human
tagatcagaaggagcattagattcttataggaatgggaacgctgttgtgaactgtacatgcaagggatctaggttgcatgcttcttataagaatctaatgcctgatgatctgtcactgtctcccatcacccctagacgggaccatctagttgcaggaaaacaagctcagggctcccactgattctacattatggtgagttatataattatttcattatatatagcaatgtaataataatagaaataaagtacacaataaatgtaatgtacttgagtcatcctgaaaccactccatcccccrcaaccccagtccatggaaaattgtctcccatgaaattggcccctggttccaaaaaggttggggactgctgctttagaggatattgtcagtaaagtacaaagacaacccacagagtgggaaaaaatatttgcaactcatatgtctgatcagggatttgtgcccaaaatatataaagaactcttacaactcaataataaaaaaacaacctaacttaaaaatgggcaaaggatctgaatacacacgcctccaaagacaatatacaaatgaccaatagcacatgaaaagatgcttgacgttatt

SEQ ID NO: 70048 - DNA, 601 bp, Human
tagcagtcacgtatctgactctgcttgacaagaataagaaactggatccctcattgcttgttctgggaccacttgctggggaaggccaccctcaggtctaggggcttccgctgcgattctctaaggtcatttgaccccctgggacttgccctcccttggactccctggctttcctctagtctctagggtcccagctattttttccaccacacccagggttccctgtggcaggcccaagctaaggtggatgtgcagagtgtgggctggccagtatagccaagctgggcaaatgcacgtgctstcaggagcatggacagagctcccggtgctcagagtccaccaccgcttctgctcttcctacaggcagaaggcaaaggcctgtttcccactgaatagcaccttctccagtcatgcctggggagctctgaaaataaaccagattgggaatagtcaggatgtgggctactgatggcccctcgggtctatccagtgcattttctctggcactaattttcaaagaaagtttcactaaaacattttccactgggcaaaatcatgcctttagaatcagcctacactagagtcttaggatagctgagcc

SEQ ID NO: 70049 - DNA, 601 bp, Human
ggacagccacatgtctttgaatttgtagggcctagtagagcatcttgtgcatacataataggtcctcaacaaataattggattagaatggattgaacagtcctcccctaaagctcacctcacatctccttccctgaaatcctataaaaataagcacttgtctcccgagggagaagggcttcttggagcaggaatgtggttgatgcttaataaataatagctggatgaacaaatatttgcaaacatcctgcctaagatagaggattggactcagtgcttcctggggcagaaagttgtttaayctctatcacttcttgataaataatccctacattaggatatttggaattgccaactaggtatcatgtaaaggcaaaacaattatgatactgaatgtgcattctcacacacattggttgaggattacagctctcagaaggttgttcataaaggcatgatgtctctctgtaggtctctttggggacaggggattttgagggagattctgttggcccagtctcaactgttagtgcctttaagaaaacccaaactgattttctttagacaacactaagaaaagcatgcacaattctttgaaacaa

SEQ ID NO: 70050 - DNA, 601 bp, Human
gttgttcataaaggcatgatgtctctctgtaggtctctttggggacaggggattttgagggagattctgttggcccagtctcaactgttagtgcctttaagaaaacccaaactgattttctttagacaacactaagaaaagcatgcacaattctttgaaacaatttttaacagtaaaacatatttataccttttaattgtgctgtcttaacatttagagaaattaatatgcaaaaactttcaccactcttaactctcgtttctgttttccagtgctaccttccagtctttgtccatgtgtrtgaaagaagctttcatttctgccagaaatgaaatcaaacttctgatgttttcctgttataaacatcaaatctaacaggcaaactttgtgaacacctactgtgtccaaagccatgtactgagaatggcgggagatacaaaaagagtttgttcactacacaagtatatactaaatgcttgccctgtgcctagagctgttctggtccatgataacagctgtgggtgagacaggtcctcagcttccaggatggaaagagaggcaccacacagaaaaataatatgtcaggggcagataggctatg

SEQ ID NO: 70051 - DNA, 601 bp, Human
ctggtccatgataacagctgtgggtgagacaggtcctcagcttccaggatggaaagagaggcaccacacagaaaaataatatgtcaggggcagataggctatgaagaaaaataaacagggagggacttagagggggccattgttttatgagagtggtcagggacattctctccaagataacatttaagcagcctctgaaggaagtgtggaggtgagggaagagtgttctaggcagaagaaacagcaagtgcaaaggccctgaggtgggagtggtttttaagaaacagaagcctctatggcrggagggataggttggggaaatatgaagtcaagagagggagccagaggactgggctactttagaggctgcagaaggacttggacttttattccaggtgtgatgggagcccatgggaagtgttgatctcactgtggagaacagcccagagacaggaatagatgcagggagatcattaaggggctgctgaagtttctcaggagagaggctgtggtggcctatataaggtgctctactaggccgcacaaattcagagacatggggctgtccacaagaaactacggtggtagtgatttagggagg

SEQ ID NO: 70052 - DNA, 601 bp, Human
ggtgagggaagagtgttctaggcagaagaaacagcaagtgcaaaggccctgaggtgggagtggtttttaagaaacagaagcctctatggcgggagggataggttggggaaatatgaagtcaagagagggagccagaggactgggctactttagaggctgcagaaggacttggacttttattccaggtgtgatgggagcccatgggaagtgttgatctcactgtggagaacagcccagagacaggaatagatgcagggagatcattaaggggctgctgaagtttctcaggagagaggctgtrgtggcctatataaggtgctctactaggccgcacaaattcagagacatggggctgtccacaagaaactacggtggtagtgatttagggaggtagcagagcaatcaggtcctggatgtgttttgaaagtaaagccaacagatttcctttcatattgaatgtaggtgtgagagaaagagaggagtcaaggttgaatccaaggtttttggcctgagtaactgataaaatggaggtgatggtctctgagatacatggaatgggggggaacaagtttgggcagtgaagtcaggagttttgtttgga

SEQ ID NO: 70053 - DNA, 601 bp, Human
gggacccaagtcttttctctctattcattgtgcctgcctcagcacaccagctggctcctccctgcagcagctccaggcattatggtttcaccacctaaatcaagggaaatgacagggtcgagcctctccctattttagaagccctgctgggagactggcccttacgctggacagatttagccctcattgcacagatttgggtcccatgtctcttcttaaaccaatcactggttagggcagtgggtttacatgatgtgcttctgccaatcaagaggagatagggacaccaggacacagctcrgacttggccaacagggaagagagagaacaatggtggatggcttggccaccaacagtgtctgctccagccccaaaccatcaggaagaattggtactgagaagtaagaagggagggcgttctaggtggggagaaaagcatgagcagaggcacagaagcatgaagatacaaggtatgtccctcagacaagttggcggggttgatgagttgtatacagtgtggcatggaatgaaggccagaaagaaaccgtaattgctaaccttatttggggatcttcttggcttaccaggggtcttcagacca

SEQ ID NO: 70054 - DNA, 601 bp, Human
ccagctggctcctccctgcagcagctccaggcattatggtttcaccacctaaatcaagggaaatgacagggtcgagcctctccctattttagaagccctgctgggagactggcccttacgctggacagatttagccctcattgcacagatttgggtcccatgtctcttcttaaaccaatcactggttagggcagtgggtttacatgatgtgcttctgccaatcaagaggagatagggacaccaggacacagctcagacttggccaacagggaagagagagaacaatggtggatggcttggycaccaacagtgtctgctccagccccaaaccatcaggaagaattggtactgagaagtaagaagggagggcgttctaggtggggagaaaagcatgagcagaggcacagaagcatgaagatacaaggtatgtccctcagacaagttggcggggttgatgagttgtatacagtgtggcatggaatgaaggccagaaagaaaccgtaattgctaaccttatttggggatcttcttggcttaccaggggtcttcagaccagtacttaaaaaccacagatctagaaggccaaccatctcaaggaagg

SEQ ID NO: 70055 - DNA, 601 bp, Human
cttggtatgggaagtgcaagtcaccctgaggaggtgccgtccatgctggagccagattctgaggctgcaatggaactttgggctgatgcactcacattgcttgccttctgccaagagttctgctggggagctgccctcggctaacctctgagtgtctgactagatagcagcagcggcagcagcagccatctctggagccaagcatttgagcagagaacagctgctcctggtcctgggccccctcttgcctggcccaggttccagtcagctctgcctaaaagactccccagggcagcctggmtctggtgccaggacccttcaccctcctcgttcctccatctcacccgcaacagtgtgtgactgatcgactcctcctgccactttgtcttatcacgaagattagcagggaggaagctgggatgtggagtcagaagacctgggttggagccccagcccggctacttgctggcctgtgaccttgagcaggtcccatcctttccacacttctggaagatgggagaagagaatctttattctttcttcttaattgggcaagtgtgattaattgtaatgcaatgcagagttgcctgatgagaagctt

SEQ ID NO: 70056 - DNA, 601 bp, Human
actatgaattcttgtgtgtttcctctaaaaaatgatgggcaaactatttgaggtctttggttatcttttctgagtagtgtatacatggtattctgctctcttttagtttgtagtgtttcagatgagaagttcaatgtcagtcttactcttttttccttataggcaatatgttctttctgtctggaagcttttaagattttgtgttcatcttgaagtttagcagttgtaccaaggtaacctatgtgtatgtcttttcttgtcgtccttcctggaactgtgtgagccttttcaatctgtagaktcagttcttttttcagttcagggcaattgtcttctgtttgttatttaattattggctgtcctctctcagtttgtttttctacttctagaactcccaatatttttaagttagatccccctggatctgtcctccatgtctgttatcttttcccttataaattatatatctatatttttactgtatatttggagataggttttccattttgtcttccagaccaccaattcacatctcaacagggactcacctgcaatagttgggaagacattgttttaatatgtgagaaatcttttaagtctg

SEQ ID NO: 70057 - DNA, 601 bp, Human
ccttgctccaaagctctctgaagctggtctctaataagggagatccccacaccagtttttcagccttgtttcccgcatgtacccccatctgcccaaaggcctcagcagttctctaatttaggattgaacagataggttagagatgataatctctttcaggttgccatgttctcaggatctgttgtcttttctcagttactgatggatcaactgagactggaggtcagtctctttctctctgtctctctctctctctctctctctctctctctctgtgtgtgtgtgtgtgtgtgtgtgtgtgtgtgtgtgtgtgtgtttgtctttttttctggataggctatccctatggctgcactcaggggccactaacactccccattactctttgtctagttgaatctgattagacactggactagcttccagaatcatatactccagagtgcctcaaattacaggacggacactgccagtggcccaagatgagttgcagtggtgcaaggacagtgtttgagaatgttgaatcccgtggtgggaaagttgtttgttcagttctcttttagttcttctaattatggcaaatagtctcgcgtttggcatt

SEQ ID NO: 70058 - DNA, 601 bp, Human
ttgctccaaagctctctgaagctggtctctaataagggagatccccacaccagtttttcagccttgtttcccgcatgtacccccatctgcccaaaggcctcagcagttctctaatttaggattgaacagataggttagagatgataatctctttcaggttgccatgttctcaggatctgttgtcttttctcagttactgatggatcaactgagactggaggtcagtctctttctctctgtctctctctctctctctctctctctctctctctgtgtgtgtgtgtgtgtgtgtgtgtgtgtgtgtgtgtgtgtgtttgtctttttttctggataggctatccctatggctgcactcaggggccactaacactccccattactctttgtctagttgaatctgattagacactggactagcttccagaatcatatactccagagtgcctcaaattacaggacggacactgccagtggcccaagatgagttgcagtggtgcaaggacagtgtttgagaatgttgaatcccgtggtgggaaagttgtttgttcagttctcttttagttcttctaattatggcaaatagtctcgcgtttggcattac

SEQ ID NO: 70059 - DNA, 601 bp, Human
agccaaactcaggcctcacctaaggaggcagaccagcatgtccgattcttcaggagaaccagaaatcagtgtccttttgtgacaattcttctgatttataaatgtttgcttaaaggaaaaaaataaaaagaaaagaaaaactcaaaactactgcaggccaaacaaaatacatctccctggcccaaatccaggctgcagatggccagtttgagacctctgctacgtgactgcaggccagccaatcactctgattcttatacttcccaccattactgtgaaacagagccactaccaggcttgytgaggtggagattatgagtggggttctgttttagctcccagctctgctgcttactggctctgagatggtggccaagtagtcagttaacctccctaagcctcagtctccttatttgtaaaatgaggataactgggttattcattcctatcatgaggacttcatgagaaaatatataaaaatgtccagcacaaagttggtgttttgtcaagaggaactgttgttactgttcagtaacacgtgaaatgtttggaaaacctgaaagggagtgttgggcatttgacagttatgggtagtggcaca

SEQ ID NO: 70060 - DNA, 601 bp, Human
tgcaggccaaacaaaatacatctccctggcccaaatccaggctgcagatggccagtttgagacctctgctacgtgactgcaggccagccaatcactctgattcttatacttcccaccattactgtgaaacagagccactaccaggcttgctgaggtggagattatgagtggggttctgttttagctcccagctctgctgcttactggctctgagatggtggccaagtagtcagttaacctccctaagcctcagtctccttatttgtaaaatgaggataactgggttattcattcctatcakgaggacttcatgagaaaatatataaaaatgtccagcacaaagttggtgttttgtcaagaggaactgttgttactgttcagtaacacgtgaaatgtttggaaaacctgaaagggagtgttgggcatttgacagttatgggtagtggcacaccacccagagcagaaaaccccttgcccatggttctgtcatagtgaggggcaacagggcctgatgatggtggatatattcctagagtcctggaacttgccattcaggaagagccctgttccccagcagcttccctgtggggtggtgtcagaa

SEQ ID NO: 70061 - DNA, 601 bp, Human
ccaatcactctgattcttatacttcccaccattactgtgaaacagagccactaccaggcttgctgaggtggagattatgagtggggttctgttttagctcccagctctgctgcttactggctctgagatggtggccaagtagtcagttaacctccctaagcctcagtctccttatttgtaaaatgaggataactgggttattcattcctatcatgaggacttcatgagaaaatatataaaaatgtccagcacaaagttggtgttttgtcaagaggaactgttgttactgttcagtaacacrtgaaatgtttggaaaacctgaaagggagtgttgggcatttgacagttatgggtagtggcacaccacccagagcagaaaaccccttgcccatggttctgtcatagtgaggggcaacagggcctgatgatggtggatatattcctagagtcctggaacttgccattcaggaagagccctgttccccagcagcttccctgtggggtggtgtcagaagcaggcctagctgttctcccacaaatcggtctggacagacttgcagcctctgggcagcccctgcctgttacagagcgcttcccaaga

SEQ ID NO: 70062 - DNA, 601 bp, Human
ggaagagccctgttccccagcagcttccctgtggggtggtgtcagaagcaggcctagctgttctcccacaaatcggtctggacagacttgcagcctctgggcagcccctgcctgttacagagcgcttcccaagattgaaaggtgctgagaaggcaggggagagtttcctgcagctcctctgggagagacaggggattggggcaggcaatagctcttgggtgggagtaggcaggagaactttcagtctgaagttagacagggaagccctgtgcatttctgacctcaagagccccattgttaktgcttctcattttgacacagatgtcccagtcaaggccactcctgtgcacagccctttgttctttatggaaagtgctgccaggcacacatacgcgtggctttagatggcgtatacattcttacatgaccagctgaagagccttagggacattttgtgatcagtgggcgtcagcaagtccatgttggagctggggacatgcaggagccagtgcaggaagaaagccttgtttcagagggtgtggatagcaccactttaggaagcccctcaggaatgagagcaacacacttgaaataggaccaa

SEQ ID NO: 70063 - DNA, 601 bp, Human
ctttcagtctgaagttagacagggaagccctgtgcatttctgacctcaagagccccattgttattgcttctcattttgacacagatgtcccagtcaaggccactcctgtgcacagccctttgttctttatggaaagtgctgccaggcacacatacgcgtggctttagatggcgtatacattcttacatgaccagctgaagagccttagggacattttgtgatcagtgggcgtcagcaagtccatgttggagctggggacatgcaggagccagtgcaggaagaaagccttgtttcagagggygtggatagcaccactttaggaagcccctcaggaatgagagcaacacacttgaaataggaccaaatgcatcttcagcctcacatgctgtgtgaatgccgcctccttgtcagggaacgtgatctgcaccagtcaaagaggcaaatgccaggccttgcactcaggaggtgttgggtaaatgtttactgaactgaattccattcttgggagccctatttgtgccacatctaatgctggaaattatgtgtattctaccccttctcaccatccttcctggtttccaactgccctgttccataccag

SEQ ID NO: 70064 - DNA, 601 bp, Human
gaagtcatcagtattccttggatatttagtctgagggctgtccataaagtggagagctcttgagaacacccatgtttgatagccacataaccttgggaaagctcattaactttcttattaaccagtttcttcatcttcaaagtggagctagcactaacacttgcatagctttgactacagctgatgtcaggaggcaggggttattgggaggattcagtgtggcagtgtccatgaagcccttagcacagtgcctgcacctgaagggattcaacagaggctgccgctactctgttctcccagrcccagctctcgctactgtggcgtggctaagtgacaatgggcagtgtgggctgtgggccttttttctttttgtctctacctgaaatccagatgagagtctgagagagtggacagagtctcaggatggcagcttgaggggcctgttctccttagcctgcttgtcttcaacgtgcaccaattttaggcttgattcacactgaaaattcctcagctgccggctgctgggccagaagcaggcctttgtctcagagagacccagagaccatgatgaaggctgagcatacctgccctcctgctggcc

SEQ ID NO: 70065 - DNA, 601 bp, Human
gctgtgtctctctgtgaatgtatttctctggcaagacatgctgtcacctggaattctcccctactcttgttcaaaggcccaacaaaggggtggcgcagagggaaccagaaggatgtggctcacgtccatgtagtcagagatgtttggggacctgacccaatgcagacatagccatctttgtccagcaaaagttggcgtggcaactgaccactgccgtttcatttgaggagacatgagttaccctggagaggaatgtgcattcagacttgcttttggcagactttaccataagcagtcctcycagaggacatgagaaatcatgatttccctgaggagcccccatttggggtgatctgtaccttttgccttgaactctcctaggcagggagctgagaagggcgtcttttgtctgtttcagaacactcacctaaaatggtccaccatctggggcaacgcttaggaggctctgtggcaaatctcaaaggcacgtgtgccaagcagcctgcactggagaatgagggattctgtccatgcccctttgtctcttcaggttgctggtggtgtattggtgtccttctctgcccaatcacatggcaaggag

SEQ ID NO: 70066 - DNA, 601 bp, Human
caaagctctgcagccgtacttgcgcattctccacaaaatataattaaaaagctatgcagactgctcccaatgtacagtattgtttatatactaaacataatgtactaataggaatacctcacttcattatgtcagcagaatacgaaagggagatctagcagctgcccttatcaggcagatgggagaccagaaatgttacttagatctaggcagtaaaattgacattgaaccaatttgcctcactcgtgccgcttttactgtgtttaacaaaagctcatgtctgcacataaggcattgtgargaggactcagcagccataaagctctctgtcatgtctctgcaacataaccagtgaatttaaccgttgggtttcaaagaacagttttggattttcctggaaataagcctacagaggacagcataaggcagctgtgtgtcctgacccttagaaacctgtgagaaccaagacatcagggttgaaggaggggaacccatgccagtgaatgagggagcgagtctagttacaatcacaaggaaagggccacagactccgggcccaagggggaagactattcagtccgcaaggtggagatgggattgg

SEQ ID NO: 70067 - DNA, 601 bp, Human
gttttggattttcctggaaataagcctacagaggacagcataaggcagctgtgtgtcctgacccttagaaacctgtgagaaccaagacatcagggttgaaggaggggaacccatgccagtgaatgagggagcgagtctagttacaatcacaaggaaagggccacagactccgggcccaagggggaagactattcagtccgcaaggtggagatgggattggcagccagggctatgagtgggggatggtggagagagatatgtccatctggggccactgtttacaggctacccaccttcacaraaaggagttatatgtggagccctcattttagagccagaggtcccaagcaatcacctgtttcattcagccattcatccagcattgattgatcattcgccatgtaccaagctctgccctgggcactacagtctgtgaactcagtcctcatggagctcacgtcgatatgtggggaaacagatggtatacaaataaaaatatacataccaggtggtgatacatgtgatgaaggaaaataaggaagaataaaggcacagaataatgtagggaaggggccgtagtcagactggtctgaggaggtga

SEQ ID NO: 70068 - DNA, 601 bp, Human
tctgatattagaatatcaagttttaatatagtattaaaaatatagtattaaatatagtattttaatatagtattattactaattaatatatttttatcgtatagtatatagtattaatatagtatatagtatagtatactaattatatagtattaattaataattaataattactaaagtggtcataattattttttaaataaatgttcgcataccatacagcttcaccccacaattaaacagctggatttttagctgagtcttctcttctttccaaatagccaagggatccatttgtgcycaagttattcatcctcactttgtaaggcctaggtgtcacccagcctctatcttgtcccatctaggttttgtggttttctgcctcccttgggagaagcaccctcgtggtcagacaagccccccagcccgagcagctgaatctgaagctggaaagagctctcattcgtgagcagcccaaatgtccaccgtgaggggtttggttgaatagctcatggcccattcagatgatgagactaagcagctaatagaaccccagggtcacatggagccacatcaatgacttcttcctgaagtcatctct

SEQ ID NO: 70069 - DNA, 601 bp, Human
ttttaacaggtgagcatttgttttaatgtgtagctgagaaaaaattttgagtagtacattagccatagtactggtccctgctgctcctctggcctcatcccccactttccctatcactcactaggttcaagccctgctggttcctcatcattagaacactaaaggtgccccggggcctttgctcttgctgctccctctgcctgttgcgttcttcctcaccaatatgcaaggcccacttcttatcactgaggcctcagcttcatgccacctcatggctcttaactctacccttccccactarctactagttttgtgtttattactctgtaatatttgtttacttctttatgctttcccctattgagctgtgagtcctttgaaggcagggcctctgtctgtcctgttcgccagtctcctgggtgctgtgtgaactgcacctggtacatagcagtcagttctgttagatgagaagaggaggatgccgtcagtggggggattgaaggaggccataatctcagggatggctgagctctgccagtcaaggaagcagcctttatgcctggtaaagagcaaagcttctgacttcccatcaggggcctct

SEQ ID NO: 70070 - DNA, 601 bp, Human
tgtagctgagaaaaaattttgagtagtacattagccatagtactggtccctgctgctcctctggcctcatcccccactttccctatcactcactaggttcaagccctgctggttcctcatcattagaacactaaaggtgccccggggcctttgctcttgctgctccctctgcctgttgcgttcttcctcaccaatatgcaaggcccacttcttatcactgaggcctcagcttcatgccacctcatggctcttaactctacccttccccactaactactagttttgtgtttattactctgtratatttgtttacttctttatgctttcccctattgagctgtgagtcctttgaaggcagggcctctgtctgtcctgttcgccagtctcctgggtgctgtgtgaactgcacctggtacatagcagtcagttctgttagatgagaagaggaggatgccgtcagtggggggattgaaggaggccataatctcagggatggctgagctctgccagtcaaggaagcagcctttatgcctggtaaagagcaaagcttctgacttcccatcaggggcctctacactcttggaattctgggaaatcagaa

SEQ ID NO: 70071 - DNA, 601 bp, Human
agcatcaagggaggtaagacgcctgtagcacaatggaaaggcctctgggggttttgtccctgctctgccacaaactaaatgtgcctgtaggcacatctcttcctctccatatcacagttttccatctggaaaatgactatttctgtgtgggctctaagcagaaccatttatttggccagtcttcgtggcaaaggaggcagggaaaggaactcttcatgagaagggagtggctttcaggtggcagccagcacatccttcaactggcccttggcagatgccacttttttgttgttaattttcmtttcttggcactagccttatcttaccatctagattgagaagctctggaagggagggaccaggcctcataggctttaagtcggaagagaccttccagcaggctgaacccaaatgtgtcactccaggagattcgtattgatcaatgactctaccccttttactcaagtattctctctaggtcaaaatggtccctagtaggttaaacacgaagtgtctgtctcccattggaaatgacttgttgttcttccagataacaagtatacatttttaaacatgaaacaaaacatacaaagaagaaagt

SEQ ID NO: 70072 - DNA, 601 bp, Human
aggaggcagggaaaggaactcttcatgagaagggagtggctttcaggtggcagccagcacatccttcaactggcccttggcagatgccacttttttgttgttaattttcatttcttggcactagccttatcttaccatctagattgagaagctctggaagggagggaccaggcctcataggctttaagtcggaagagaccttccagcaggctgaacccaaatgtgtcactccaggagattcgtattgatcaatgactctaccccttttactcaagtattctctctaggtcaaaatggtccstagtaggttaaacacgaagtgtctgtctcccattggaaatgacttgttgttcttccagataacaagtatacatttttaaacatgaaacaaaacatacaaagaagaaagtttaaaaaaatcactgaatgccaccacccaaaagtgattattaatacatcttgttacacatcctcacataataactccctctccctccttctccctccataccacaccctacctcctgcccccacccacaaacagttttatgaaaacagctgcacaggacacacactgtaaccagcattttcactttaccgt

SEQ ID NO: 70073 - DNA, 601 bp, Human
cagggaaaggaactcttcatgagaagggagtggctttcaggtggcagccagcacatccttcaactggcccttggcagatgccacttttttgttgttaattttcatttcttggcactagccttatcttaccatctagattgagaagctctggaagggagggaccaggcctcataggctttaagtcggaagagaccttccagcaggctgaacccaaatgtgtcactccaggagattcgtattgatcaatgactctaccccttttactcaagtattctctctaggtcaaaatggtccctagtakgttaaacacgaagtgtctgtctcccattggaaatgacttgttgttcttccagataacaagtatacatttttaaacatgaaacaaaacatacaaagaagaaagtttaaaaaaatcactgaatgccaccacccaaaagtgattattaatacatcttgttacacatcctcacataataactccctctccctccttctccctccataccacaccctacctcctgcccccacccacaaacagttttatgaaaacagctgcacaggacacacactgtaaccagcattttcactttaccgtcctgtc

SEQ ID NO: 70074 - DNA, 601 bp, Human
ttttaacctaatataagccagtttgaacaacttatagggctaatcatgatttgagcaatttcccccaaattgcaacatttctgcaaactgcaaatgaagcttctttatcttgggacaccccaggcaacagattgagacctgccaggcagtattttcagcccatgaattgaagtgtgatagaaagtactgtgagcttggagacctgtatcctgttcttggcccaggctcttacctgctgagagatattggggcaattacttattctctctcagcctcagttttctcttctgtcaaatgggtrtaataaaatcccaccctttccacctgatcaagtgcatataaagattaatgatatcaataggtgtgaaataggttgaaggaagtcccagagccagccataggtctagagaacattcccaggagagtggtagggtctgctggtcccaaatgaagcatgagaaactcaatgcactggcttctggggaagcatatcatagcatggggaccagcaaatcctgcctgcaccactcaggtcacccaaagggtcccaccctcttaggggaatctaggtaccagttgcctttcttttctgttttttagt

SEQ ID NO: 70075 - DNA, 601 bp, Human
gtctagtaaacacctaaaggcggacgcccaggccatcaccggactctcctccttggtctcccttctctcagggatcacagtcctgcactgtctattctccagtgtttgaagatgcttgtttcacatattttgtctggttttctagttgtttacagtgggagctagcaaagatccctttgagatctctctggggtggtgcaccagtggcctgtactggttatgtactccctcaagatacttttacaaaactggacttaggaataatgaaagtcgacagaaagttaatagggtcattctgatstgctttttagagaaattcagggtgaagacccgcaaaccagcaccaagtggaatttgcagcaggaatcattattgtacgtcaactgatgactggataaataaaatgtggtacatccatacagtggaatactattcagtaataaaaaggaatgagctactgatacatgctacaacatgaatgaatcttgaaaacattgtgctaagtgaaagaaaccagtcacaaaagaccatacattgtatggttccatttatatgaactgtccagaatagccgaatttatagaaacaaaatgtagatcagt

SEQ ID NO: 70076 - DNA, 601 bp, Human
gccatcaccggactctcctccttggtctcccttctctcagggatcacagtcctgcactgtctattctccagtgtttgaagatgcttgtttcacatattttgtctggttttctagttgtttacagtgggagctagcaaagatccctttgagatctctctggggtggtgcaccagtggcctgtactggttatgtactccctcaagatacttttacaaaactggacttaggaataatgaaagtcgacagaaagttaatagggtcattctgatctgctttttagagaaattcagggtgaagaccygcaaaccagcaccaagtggaatttgcagcaggaatcattattgtacgtcaactgatgactggataaataaaatgtggtacatccatacagtggaatactattcagtaataaaaaggaatgagctactgatacatgctacaacatgaatgaatcttgaaaacattgtgctaagtgaaagaaaccagtcacaaaagaccatacattgtatggttccatttatatgaactgtccagaatagccgaatttatagaaacaaaatgtagatcagtggttgcttagggtaggggcagggcatggaca

SEQ ID NO: 70077 - DNA, 601 bp, Human
acagtcctgcactgtctattctccagtgtttgaagatgcttgtttcacatattttgtctggttttctagttgtttacagtgggagctagcaaagatccctttgagatctctctggggtggtgcaccagtggcctgtactggttatgtactccctcaagatacttttacaaaactggacttaggaataatgaaagtcgacagaaagttaatagggtcattctgatctgctttttagagaaattcagggtgaagacccgcaaaccagcaccaagtggaatttgcagcaggaatcattattgtmcgtcaactgatgactggataaataaaatgtggtacatccatacagtggaatactattcagtaataaaaaggaatgagctactgatacatgctacaacatgaatgaatcttgaaaacattgtgctaagtgaaagaaaccagtcacaaaagaccatacattgtatggttccatttatatgaactgtccagaatagccgaatttatagaaacaaaatgtagatcagtggttgcttagggtaggggcagggcatggacagtaactgctaatggatacaaagttccttttggggagattgaaatg

SEQ ID NO: 70078 - DNA, 601 bp, Human
aaactgttgtttttaaaaaaagaagaagaatctttagccattttctcctgcatgaaagtaatgaaggaattggaaggagccttggtatggtagaaaggaggtctcagttattatattggtgcgtgaacgtgtcacaagtagtgttctatctgggactgaaaatatgaccacagaagagtttacatagttcattgagggaggacaaatgtaggatgttaatcttaaaattcatttgctctttctggattactttagttataagaggattcttgtggttttggcgtgagcccctccttctagctttctctcctgcccggatccttgtcagcagtgagcacatgttgagtggctagcaggcagtgccacgtggcctctgaaagttgtgatgtcccctttatgtcttctttgtccctgttcagatccaccagaacgagggtggtatgtggttaaatcctagccaaggatgaaaaagtaggcaaacccttttattgacttttctgttgtcaaagataaagatggttatttgtttgtcttaagtgaatcattttaccttcattaaaagcggtgagttttctgtgaaagaaaaatgcatcatccattt

SEQ ID NO: 70079 - DNA, 601 bp, Human
ctatttctcctccatggaatttcccagtcaagtcagccttcaagtaggaaggaggggaaggctccaatggaaggagagactgagagctaagcgggactccctggagagtccactggacacagtcgagtccaagcacagttccgttatggcaggtggcaccatggccagcacctggcccatccctagggcaacacagccttgtctggtgtgagcttcctggtgggcaaaggcctccctggcactcaggcacccccttcctgtattcttacacctgtgaggagcaggaaaggagtgaacccgrgacccaggccacagcaagccagacaactggaaaaggcgttcccgggagtgggctggtgtggattcgcagcctgtggagctgggcagaagagagtggaagccaccacttggcatgaggagacatgccaggccagaaagggctgcagtacctgctggtgtgggggcagctcagagccaacatccttccctttccatgttctcatggagcttcctatctagcagtacaggcagcaaacaagcccacaagtaggtgactgcataatgtcagataatgctaagggctgcaaggaaaacaaaataa

SEQ ID NO: 70080 - DNA, 601 bp, Human
caggcacccccttcctgtattcttacacctgtgaggagcaggaaaggagtgaacccgagacccaggccacagcaagccagacaactggaaaaggcgttcccgggagtgggctggtgtggattcgcagcctgtggagctgggcagaagagagtggaagccaccacttggcatgaggagacatgccaggccagaaagggctgcagtacctgctggtgtgggggcagctcagagccaacatccttccctttccatgttctcatggagcttcctatctagcagtacaggcagcaaacaagcccasaagtaggtgactgcataatgtcagataatgctaagggctgcaaggaaaacaaaataaggtgatgtgagagcctgatctgggggtaggaggagcagataattcagagtgggaggacgaggggacagaaagttccagacaagcacccaggccctgagggaggaatgagcctggcgcagaggaatataaagctctgttcagctggagctacctgcagccaggcagctcctgatgtccagatgccctgagcccagtgctgggtccccatatttttctgtctctagggtccccagccactctcca

SEQ ID NO: 70081 - DNA, 601 bp, Human
gcagaggaatataaagctctgttcagctggagctacctgcagccaggcagctcctgatgtccagatgccctgagcccagtgctgggtccccatatttttctgtctctagggtccccagccactctccacctaggggatctgccatttggatgctggggaaaccaccttatgctgcaggagtccagatccgtgttttggtctctgaagaagagacctccttccctctcatgtttttttcacctctgccacccaccaccactcatcaggggatgtctggaggaagacaaccccactcccagcmcctgccggggccagccagccttgcactctccacacagaaaagcgcctaagagcttccttgctgtacctcagtgtcagcccctagaacaggtaggtgtccctgagttcccccggcagctgactcaccacctgtcctgtctgtttcccccagaggaaagaggactggctggtttttccttcagcctctctggtgtggagtcacttggggccccgtgactgtgcgtgagcctgaacctgaaagagcctccgtgcagagcaaacagcagggacctccttacatccgtctgtggtttccacaccc

SEQ ID NO: 70082 - DNA, 601 bp, Human
gactgtgcgtgagcctgaacctgaaagagcctccgtgcagagcaaacagcagggacctccttacatccgtctgtggtttccacaccccaggccccagcctcagactacagacctctcccaggggccccatgtactctcactcctctgggccttcgctggggtgtgctctctgcctctagtgccgtcctcttttcttcccctcttccacgtggaactgccccactcagtaagggcccactatgcttcatcttgtccatgaagcctccttcccttttccttccctgaggaagaaactcagctsagggctttctccatgaagctcttatctcacacactggcatgaagatgaattgtttatgcttctttccatagagcagtgggccctaaagtgtagtcagagtcctttgagcagctcatgaaagccgcgagccttccctccagaacaggggacacagcacacatctaggagattctgcatgcaatttcaagggggcctggcccaccaatggagtccagcctaagaaccccttcatcatttaaggtcttctgatcaaggcgtatgtcgtttatctttgggtcacctcctcactccagcagccaa

SEQ ID NO: 70083 - DNA, 601 bp, Human
atacagtgtagacatggaagcctaacaagactagaacctgtgtggcctgggtccagagcagagtcccatttagataggcacagtatgatgaggtaaaacaaatcattcaaagaatcccatccttcatcctaagtctctctaagaatatgaaaagggaccagagacagctccccctgctgttctcaaacatcctctcctgcctcccacatctgtcccaccccactcccttgagctgccttacccccctgggttctccatggaccctcttctccaccccagcgagcaaggctggtcctctctytcccactaaaggggttcctgctctgcctctccttcactcctccctttttcttcatctccctttcccctccccttctatctctccctttcccgccttccctttttcccttttcctctgtcctcctccctccttctcagtccccttttcctcctccccttccctctctccctcccttcctcctcactccagctcattattatgtaaattgtcttcaccttctgagccaagctctccccctcctccttcctctagccttagcccagggcctacatctgcatcacaaaagcagagggccttgtt

SEQ ID NO: 70084 - DNA, 601 bp, Human
tttctctcaactataaactccttaagggcagagtgtagatcctgttcctctagcacaatgcctaatacaggaagtattgaatactaagtttaaaccccaattctaccaccagctatatggccctgggtaaattatgtaacctctctaagcctcagcattttggactgtaaaatagtaatgatcctgatacctccctcattcatatctgccgtaagagtaaatgagataatgcctgtagcgtgcataggatagtgcctgtcacatagcaacttctcaacatgtgttggcaattattctcattatttgtctaaaatcattatttttgataaagtgttgatgaattctactcacagcaatctagtgaggaatgggcaaggttttatctgcacttttcaggttagaaacagaagcacaaggttcttaactggccacccaaggtcatattaccaagcctgggtctgctgaacctgtgccataaagccaaacaccaacactgaagtttacaacaagacaaaagactgcgtttatctgcaggaggctgagcaaggagagtcaggcagctcatgcttaacatctcacttcctcaatggccctacaagca

SEQ ID NO: 70085 - DNA, 601 bp, Human
cagccaatttggggactcattttctttcattcagttggtcaatcaatcattccacaaatacttatcactcaattacttattacttacaaatgcttacttcctggggaagtgcacaagatggcagaggtgggtacaaagatgcaaagatcaagaggctcccggtcttgggcagagatgccagccccagaatgagaaggtaaacgccttggtttccagggcttctcccagctctgaaattctagctctccagggctcagtgcagcatcagcacagctccctgatccaaggctggatcgggccrcaagctcctggtttgagggaaggcatccaccatctaagccctgccacaaggagcctgagacccggctactggtactttggcccaggatggcagcatcagtggctttccttgaccatcatctaaaaggaagaaccaacccaaaggaactgcagttttcagtatgggaaagaaagaaggactaaagtgtcagatttttgaaatgtctcttagctgctcctcctcattagagtcttgggtttccttagctaaaagtggtgccctcccccaagcccctcccagctgccccccagcagcacactc

SEQ ID NO: 70086 - DNA, 601 bp, Human
gccatgcgtgcttccattcatgtgttcccacagcggtggctcagcctggagcaggcactcagcctccagggctccagcacattggcccctgcagaggccccagccagcacctagccttcatctggcctggcctgccttctcttccgtggcgtgcagagttgagtggatgctcaaggctgggctgccatcagtctctacatgttcattgcctgtagaaaagggcatggaattttaaaaaggaaatttaaatgaaagacttcaacaaacagtaaacgaaaactgcaagcggtgatgccttgcrcttgtgtgctctctttctgtctttcacactccaaccccgccccccaccgccaccataagccctaatgactctgctctgatggtgggaaaatgttataaccacgtaaataaatattcctcggcatcaggactgaagtggcccccaccaatcttggatgtccaagagccaccccattgcagcccctcttctacccccaccaaacccccacctggcagctacacagggggaactgaccgcctcccctctggagaggggccattgtgtgagcatcctttgggcttgtggtacctgtttcaaggt

SEQ ID NO: 70087 - DNA, 601 bp, Human
tgttcattgcctgtagaaaagggcatggaattttaaaaaggaaatttaaatgaaagacttcaacaaacagtaaacgaaaactgcaagcggtgatgccttgcgcttgtgtgctctctttctgtctttcacactccaaccccgccccccaccgccaccataagccctaatgactctgctctgatggtgggaaaatgttataaccacgtaaataaatattcctcggcatcaggactgaagtggcccccaccaatcttggatgtccaagagccaccccattgcagcccctcttctacccccaccmaacccccacctggcagctacacagggggaactgaccgcctcccctctggagaggggccattgtgtgagcatcctttgggcttgtggtacctgtttcaaggtggcaaaccagctgccaagcagacttcagccttagaagccataggccacagcagagaggggcctgcctggccagtgccctgtattttgggactcctggaatattgaaaattgaagaattcccaaaacaaggtcacaaaatcgtgttgtattttaaatgcatctacttaacaaatcagtactttgggcctaccacaaatgc

SEQ ID NO: 70088 - DNA, 601 bp, Human
caaggtcacaaaatcgtgttgtattttaaatgcatctacttaacaaatcagtactttgggcctaccacaaatgcaatggaatataattgtgctccctaaaaagacaattataggatttacaaaaatattaattgacagtgcagtgctggccctgtggtcctgtagtgggacacaagtcagagccctgtgctgagcactgtagctttcactgtgagagatctctctcccgactatgtctgggacctcatttggtccaagccccagaattgagccctttgtggatgtataatccctttctggycaccagatataccgtggagtagcctaggaaaccaggaaggtagattttagtttgctgaaggaagaggcgccagggactgagaaagggttaggtttgaggcagcagcaccacgtggggaaggctgtgtggggtggggacagccaaggtggtatctgcccctgccctgctgggagtgtagtgggggtcacagtcccacacatgtgagatggagatggcttccctaggaaaaccagagccactttccatcctcccgctacacacatctgcacacacgctcatcagcttctgctttactcagct

SEQ ID NO: 70089 - DNA, 601 bp, Human
catgtggggagtgggggcttgatcagcagctcaggggacgtccctggcttcccccatctctccactctgccgcactgtgtggttttcaccctcgactccacagcatcactcctgcaccaaggaggaaaatggctccagcagctaagtcatcacttgtaaccttgtgtgcatcctaggacatcaccaagcacaaggtgcatctgagcaaccaccaagtcctgcaagtctctctctctctctcagtctctttctgtctctgtcgcctctgtgtgtgtgtgtgtgtgtgtgtgtgtgtgtgtgtatgtgtgtatctgtctgtctgtctgtctctctctctcattgcccctccttgacccaatcaccatgaccaagggggctgaggggttcctgggataagagtgaatcccccagaggaaaaccagaagctcctgaaaaaggaaatagaataggaggaaatgggtgctggggaggccaccagccgcccacagatctctccttgccattggggctaccagctgtgctgccccgtgcaggagatgactcatgtcgtagggtggagggccggccaggctgagtccactgcagcaggaccatgagatgg

SEQ ID NO: 70090 - DNA, 601 bp, Human
ctcattgcccctccttgacccaatcaccatgaccaagggggctgaggggttcctgggataagagtgaatcccccagaggaaaaccagaagctcctgaaaaaggaaatagaataggaggaaatgggtgctggggaggccaccagccgcccacagatctctccttgccattggggctaccagctgtgctgccccgtgcaggagatgactcatgtcgtagggtggagggccggccaggctgagtccactgcagcaggaccatgagatggctgagctcggcagcaagccagcactgctgctcccrtggcagcctctcccctgaggtcccaggtggcaggacacatgggtgcacagcccccagcccaccactgaccaatggtctcgcctttccactgtggccgcagcagggggccagggaagagtgggaggtgaagaggggagataggctggtaacagaagaggcctccactagaagtcaggtcccttggagcctgccccagccagcaacagccttagagctagtcaacacctcgcttcaaagctggggaggcactgccccagagggcgggcagcaggagtcagagatgtgactttgaatcctggc

SEQ ID NO: 70091 - DNA, 601 bp, Human
cagccgcccacagatctctccttgccattggggctaccagctgtgctgccccgtgcaggagatgactcatgtcgtagggtggagggccggccaggctgagtccactgcagcaggaccatgagatggctgagctcggcagcaagccagcactgctgctcccatggcagcctctcccctgaggtcccaggtggcaggacacatgggtgcacagcccccagcccaccactgaccaatggtctcgcctttccactgtggccgcagcagggggccagggaagagtgggaggtgaagaggggagatrggctggtaacagaagaggcctccactagaagtcaggtcccttggagcctgccccagccagcaacagccttagagctagtcaacacctcgcttcaaagctggggaggcactgccccagagggcgggcagcaggagtcagagatgtgactttgaatcctggccctgccctctgccaggcagtggacttagcactagtcacctgactgactgaccctcaggttcctcatctgaaaactggagatcataataatacctactcacagggttgttgtggctaaaagaaatgatgcatgttaacagc

SEQ ID NO: 70092 - DNA, 601 bp, Human
cctggctgtctcattcactcactggtttatttacttgagaaatatggacgtggccttctctgtgccagcagcatgctgagtgctttgtgcaccatggtgaactaatgcaagcaggtgtactgctgctcagagctcagctggcgagcaggtggacagcctcagtgattccagagagcagagtgtcctgacagtcggcctgtcctagcctgtgctgaggacggggtatctgacaaagagctgaagggattggcaccggtggggtctcaccagccaccaggataggagggtaaaaagactgctmccaagtgtccccatatggggcacgccaggaagtaagaccagagcacatacttgggctcctggctgtagaagttcccaagctatataaggagaggagaatcaggcctggcctctaaaaggaggctgcttcctcttggggaaaagtcagggaggtgggaaaatgcagccttcacagccctgtgtcttaagtcactcagctctgatagcaagagtggccagcgtgggggccggtcttccctttgcgttactttctggcctctggagagtcaggagctcaggtagcctggagtcccctggaact

SEQ ID NO: 70093 - DNA, 601 bp, Human
ggggcacgccaggaagtaagaccagagcacatacttgggctcctggctgtagaagttcccaagctatataaggagaggagaatcaggcctggcctctaaaaggaggctgcttcctcttggggaaaagtcagggaggtgggaaaatgcagccttcacagccctgtgtcttaagtcactcagctctgatagcaagagtggccagcgtgggggccggtcttccctttgcgttactttctggcctctggagagtcaggagctcaggtagcctggagtcccctggaactcagcagcaggggtggasgcgggtagggtctttgtcatgaaccggaagcataccaggccttcacttagaacactgacccctcacagaaagaccagcccctaggccctgcctcggctggcagggtgacctcaggcccatcccttaccctacagggtctccattttttcatccattagatctgaggaacgacaccgaagatcgcccctcccccaccctacctcctttttagttctataaattcccctggcagaacttaattgctaagtttaggtgattgccaagcacaaggttcttcctttgtatccaaaaaaggggggg

SEQ ID NO: 70094 - DNA, 601 bp, Human
acctcctttttagttctataaattcccctggcagaacttaattgctaagtttaggtgattgccaagcacaaggttcttcctttgtatccaaaaaagggggggggagcggaaaaaagagaaaaaaacacagtttcaaagttagggcacctgtgttcaattgaagactgactttctcttaaggagggagttgatgttcccacagccgctgggctgttagcagcaaaagcagcctagcaggaggggcagccttggtgagcccccagtgcaggccacttgggccacttgccccacagtatccagygcactggggggcagatcagcctgtcactgagaatgacacactcaagtttggagccgggacctcttttttgccatccatcaatgagagtggttcagggttgtcagtctaagacgggagtatagcccagggctggggactgtagaaatgggcatggtccccacccggtggggatggggacaccggtgtggactggcacacatgggccacggagccatcggggtgaagacactaaatcaggcagaaaaacactgtcaagtgttaacactgcagcatctgtgtcaagggtaaccatgtctcagg

SEQ ID NO: 70095 - DNA, 601 bp, Human
ctgtcactgagaatgacacactcaagtttggagccgggacctcttttttgccatccatcaatgagagtggttcagggttgtcagtctaagacgggagtatagcccagggctggggactgtagaaatgggcatggtccccacccggtggggatggggacaccggtgtggactggcacacatgggccacggagccatcggggtgaagacactaaatcaggcagaaaaacactgtcaagtgttaacactgcagcatctgtgtcaagggtaaccatgtctcagggacgcaggagatgagcggccycatgcaaagctgtcagttttagtctgatcagtccagaaggctcccggtgtggggagaggaaggatggatttcagtagcagcttgctagatgaggatgagatggcagagcatacggcgcaggcttgaggagggggtacggaggccagggaggcctttgggcagctggctgacagcactgttacaaacattttgcacacattttattgattggcccactcctcaaacccagagcacataaacaagtgtcccatggtaccattggggtacctggaacccagagcagtggggaatgtccctgcc

SEQ ID NO: 70096 - DNA, 601 bp, Human
ctgggcctcttgtcctgactctcagacccctggtatgtgtgctcacctgagtatttgatcaatgtttgtgccccctgacccaacaaggctgtaagggacagggacagggcctatatgacttcagttggagtcagtctccagcacccagcacagtgcctggcccagaattggtgggtgctctattgaagtctgcagctagtccgtggtagagctgttcttgatcccagatgtttgaacacctggcccattgctttctgtatggccccttgtaaaatcagagcaggtagttaaaatcagatcmtggagacccagaatgagtttggaacctgagttctagaacccacttgttcataggccctcttgcaggcctcaattttttcacctgctgaattgaaaccacacctgcccacgcactgtgcaggaagcaaggagtaggggtcacacacgtgaggcatgtgagagggggtgcctcctgaaagctggctctgtgcatccactcctggaacccggcccctctccaggcaaggcacagaggcaagcacctccaaaagaaaccctatacccgttagcattccctccctacccctctgcctgcagcccc

SEQ ID NO: 70097 - DNA, 601 bp, Human
ccttgtaaaatcagagcaggtagttaaaatcagatcctggagacccagaatgagtttggaacctgagttctagaacccacttgttcataggccctcttgcaggcctcaattttttcacctgctgaattgaaaccacacctgcccacgcactgtgcaggaagcaaggagtaggggtcacacacgtgaggcatgtgagagggggtgcctcctgaaagctggctctgtgcatccactcctggaacccggcccctctccaggcaaggcacagaggcaagcacctccaaaagaaaccctatacccrttagcattccctccctacccctctgcctgcagcccctggcaaccactaatctgctctctgtctctatggatttgtctattctggacattttatataaatggaatcatacactatgtactcttttgcatcttgcttctttcacttggcataatgttttcaaggtttttccgtgttgtagctgaatcacatttcattgtatggatataccaaatttcattcatctattcatcatttgatggacattgaggttgtttccaccttttggctactatgaataatgctgctgtgaacattcatgta

SEQ ID NO: 70098 - DNA, 601 bp, Human
ttttccaaagtggctacaccgtcttacattcccattttccgcatatggaggttccagtgtctccccgttctcactaatacatgttattgttcatcgtttttattatagccatcctcgtggctataactcattgtggttttcatttgcatttccccagtgattaatgatattgagcatcttttcatgtgcttttggccattggtgtattttcttcagagaaatgtctattcagaattagcccatctctaaatggggttatttgtcttacggttaagttgtaagagtcctttattctggataygagtcctttattagatatgcgatttgcaaatattttctccccttctgtgcattatctttcgaattttgtgatggtgccctttgaagtctcacctcattctgcccttgcctctgcccccttgccagagttcctcactcccccagacctactcatctgtctctgttcctttatgctgctgcaacaaaataccttagaatgggtaatttagaaacaacagaaatgaattgcccacatttctggaggatgagaagtccaacatcaagataccagcagatttgctgtctggtaagggtttcttct

SEQ ID NO: 70099 - DNA, 601 bp, Human
gacatatgttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatrcgtatatcttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtg

SEQ ID NO: 70100 - DNA, 601 bp, Human
catatgttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatgcktatatcttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgag

SEQ ID NO: 70101 - DNA, 601 bp, Human
atatgttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatgcgtatatcttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgaga

SEQ ID NO: 70102 - DNA, 601 bp, Human
atgttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatgcgtayatcttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgagagg

SEQ ID NO: 70103 - DNA, 601 bp, Human
gttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatgcgtataacttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgagaggtt

SEQ ID NO: 70104 - DNA, 601 bp, Human
gggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgagaggttttcgtctgcagataaagaagtgatcatggtatcagaggttgaacttgtkgactctggggtcagacagtcctgggtccaagtcccagctccgtggctcgcagatgggcaggtccttctcgtctgttctctgagccttgcttttctggtgtgtaatatgaggataataagtcacctacctccttgtgctgctgggaagattaaatgagatgatgatctcaggggcctagcacctatcaagggcacacaaaggctgggctgtacctgttaccactcctgttgctaaggcacgctagcaccccagggccagcccatgtgaaaccactctgcacaaagcaggcttcttctccct

SEQ ID NO: 70105 - DNA, 601 bp, Human
agtggcttctctcagtcaaagtggtaccagctggcccctggctgcagctcaccacggccaactgtgtgacatagtaacagttaacctccactgactggtcaccgtgctccaggcactgtcttaagtggcttgtattcattcctttaatcctcataacaccctgagaagttgggactatttaaacagattagaatgctaaggttttgtgaggtcacacagagagcgagtgacagagtccagactgaatctggggttactcacctccaaatgcttccctgggtaaaatactggcctctccagwctttatttttctcatctttaaaatgggttgattcttatttggcctatccctgaccaaaaaaaataatattttttaaaatataaacttttacacaaatcgatctgaaaatcagcatcctgctcccacttggctctggtgcccttgatggagctgaagtctgtctgggtggttcctgagttttctcagattccttcagggctgccagttgaaccaccaatgtgtggagttttacttaagcctcattttataaatcagaccatttgacttgtctcccactaacttgtcaaagttccagcgagc

SEQ ID NO: 70106 - DNA, 601 bp, Human
acgccagtcctattggattagaacccatctaatcattttaacagaattgcctttttaaagaccctgtctctaaatacagtcacattctgaggtcctgggggttagaacttcaacctgtgagttttgggggaacacagttcagctcctaacagggagcttccctgccgtcctctgagatgaagctcgtggatcagcatattttgaatgctgcagcaggctgaggagcccagttccactgcttgctccctgctccctctttgttgaaaggaatgattcacaggtgttgatgggtgtcaaagayaaaagggcaccaagcagcctttcttaccgaaggtcagtcagaagccttcctagcgtgagttagtggtgttaatgcagggtcccagaacaacctggaatcttcagcggcccacactctgggaaatccccttcatcgttgtggcggaatctgcagagtttaggcagggaagtgagttgactggccagggcgcaggagagctggccaagctgcccccgctccttcagggtttcctcccaacccctagcagaaccctttgctggagagaggcccagaaagggtagtgctgaattcagtgaggtg

SEQ ID NO: 70107 - DNA, 601 bp, Human
gggaacacagttcagctcctaacagggagcttccctgccgtcctctgagatgaagctcgtggatcagcatattttgaatgctgcagcaggctgaggagcccagttccactgcttgctccctgctccctctttgttgaaaggaatgattcacaggtgttgatgggtgtcaaagataaaagggcaccaagcagcctttcttaccgaaggtcagtcagaagccttcctagcgtgagttagtggtgttaatgcagggtcccagaacaacctggaatcttcagcggcccacactctgggaaatccscttcatcgttgtggcggaatctgcagagtttaggcagggaagtgagttgactggccagggcgcaggagagctggccaagctgcccccgctccttcagggtttcctcccaacccctagcagaaccctttgctggagagaggcccagaaagggtagtgctgaattcagtgaggtggacttatgaccagctgtccccaagacccctgagatcagtgtttcttcagcctccagggctaacctgctgagggctgaggtgcctgcagacacacagaccagcctccagtcactgcctccaccttatg

SEQ ID NO: 70108 - DNA, 601 bp, Human
aggcactgcctactgctggccaggcaaagggagtgaaaagggcagcgtggggcctcgggcacaatgtggccgggaactctgggcaaaggctgggggccgcggggggctgcagcccttgggagcctgctgtgcctctgaggagatcagtggagccgctcctgggaggagagctaattgaggtagcgacttctccttggagagtgagctttggtccaccccagcccatcttgggggcagtcactggacagaactctggcctggtggtcccaggcatgcccccacccaagtctcccccaggagytacagaaacaggcctggttcttatgcagagcgcccagtgccctccccaggagggggctgctcccttccggggacttctcctgccagcctctaagattcaccaggcgaagaaggccagctccctccttcccagaatcccgggaggggcagccccagtccctttcagattggagggcagcggctgggcctccgcgttggtagggagatatggcagccagctagcctgggaggtggagcatctgcccccagaggctcctgcatgtctctcctttttgtgcaccatagcttatctcacaaagcc

SEQ ID NO: 70109 - DNA, 601 bp, Human
agatgggaagagtcgaaggagctggtgggcaagggaccttggttcttccatggctgccagtggggagcacggagggttccactgtggcgccattgaaagactcagcggtggatgagagggagattaggaggccagtctggagtcgctgccctcatccatgcagggaggcaggggtgtccttggaaggtaagaagaagggacagattcacaccttcctgagggtaaatgaccttgggaatcagccagctgcaggaaaggaggaagagtggagccaactttggggtccccagcctgtgtcatrggaagcacagaaatgccattggaaagaggctgtgtgtccccaaagagtggtgtgcgctttcctggggcacacaaatgacctggcagtttttacagaccaacagctttggttttagtagttttattattttagtgtatattagaaaaattagcacacaaacctctggttctgtggatattgtggcctagggtaagctggcttttttaaatgagtccaatttaataacattttcaaaaatattgagtcagcagtgacggtgacttgctgatagggcagaaagctggagaatgaggcaggaag

SEQ ID NO: 70110 - DNA, 601 bp, Human
gcttttttaaatgagtccaatttaataacattttcaaaaatattgagtcagcagtgacggtgacttgctgatagggcagaaagctggagaatgaggcaggaaggaatgcgatgctggagccttggatgggaaaccaggaggggagtctaactggggacacattgagttgagtctgaaaggccagtgacccagaggttaggtaggggtaatccagttgttccctgcacagaggaaaatcaggcaggatctggctcagggagaaggtggctcgggaaagcaagaaggggtttgaggactgagyccttgggaacattggcacctaaatgttgggtggaggaacaggaccacagttggagacagaggagggatcacagtggactgaggtgaaccggcacccacggggctgggcgcccagagaagaggagaagtgggcgtgatggagagggcactgcgagccctcatggagtggagagggaggcagcaagacagaaggaggaggaaggggaggacagtggcttcacggggaggccagctcagaggacgggttaggatggaggggccagagacccccacccccaccttttcatcaggtcaagtctaa

SEQ ID NO: 70111 - DNA, 601 bp, Human
tcccataggatgccacacactccttggggagcccaccagtgggctcattccaccttgaaaccaagaccaaggaaccaagggtggggacaaggacagagaagggagcaggaggtctgcgggcttggaagcctggactcagtggcatgaccagatcactgccgcctgcctgcaagcactgtacattcccagccaatcagggttgttctcaggcctcacaggaccagaagccaaggcccttctgctaggagaagagggaggtgaagtgacctgtttccagtcccaccacccaggggccagaccyggacccactgctcctgtgcgtgccgctctgctccctcatagctgaggaatgtgcagcagtgcctgctgtgctgggtgctggggcagtcctccccagagtggagaaaggacatcagttttagctggcatgatggattaacatgttgatttttatctcaatatttatgaattcattttcatggatattagaaaaagataaaagctagcatattaaatacatcctttcccagacattgttggtactaaatttccttttgcttgaaataaatttaagtagaaaaagtctgaaggaaaatattag

SEQ ID NO: 70112 - DNA, 601 bp, Human
tgttgtgatgtgttgtttggttgaagaaaaatttggccccacacgaacagggaaggagtattttactagccttttcagataattattctttgaaactcccaggacttggcaaatggtagtttattaaaggagagttgcaatgtggaatctgaaagtatatcaatgacccttctttttttactttttttgagacggtatctgtctcgcccaggctggagtgcagtggcacgatgacaactcactccagcctcaacctctgggctcaagcaatcctcccacctcagcctccccagtagctggkactacaagtacacaccactcccagggggccaccatgcctggctaattttttttaatttttatagagacggggtctcactgtgttgcctgtgctggtcaatgaccctttcctgttctgttacattaaaattcactggcctaccttgcactttgaatggatctcttactatgaatgatttttaacaccattttggtcatttggaaaatattggttcatgagttacacagatctgaatgttgacacatttcagcatattatatcaaaaactcacatttgttaatatcaacactgatctttgag

SEQ ID NO: 70113 - DNA, 601 bp, Human
ggtcatttggaaaatattggttcatgagttacacagatctgaatgttgacacatttcagcatattatatcaaaaactcacatttgttaatatcaacactgatctttgagaaaagctttaggtattgggaagttaccaagtttacagtggtaaacacaagtcttccacaattctgcattttcacttgaaagccagaattttataattttggtaacaaatatgtcagtggttttctttgaaatcgtggctcactggttcatttttgggagaacttctgccagagaccccagtctgaaatcctmctgcttgccgctcaggcttttcaaggaaaagcagtgtcccatgaaggaagggatgagtccggcttgcaactcagcctttccccagtacagccgccacccttacatttgcagcacgtgttttgtgcttacttcccatgtcatcatctcacagaattctcagacgggtactcgagtggagttttttataagtcgtaatttttacttcttcaccaacgacattcttcagtccagccagcatttgctttcttggcatgcatggtggtagggagtgcaatggcagctctgcagcccggcgccgag

SEQ ID NO: 70114 - DNA, 601 bp, Human
cactgttctgacgcccagctgcagagagggaggggcggggggctctctcctgtgccggagagaacggagagaacgtgacggtgtttcctcagatgtgcaggcctgggtgggagcgctagttactaagtacccagaattcttcgccagctggaattgtagtggccaggctgggcccccccagcggctggggtctctctgccccttcgcgttgaagagcaagtcggcagcccaaggaaggcgcgatggccgccgggcccggccctgcaatgcctggtctctggctcggcgggtccagctcacrctccctctcccattggcctgtgcactcctgccccctggtgggtacagggacaactacagtacatggggcagggtggggccagatggaggtttttccctgcaactggaggactgggtttgtgtgtgtgtgtgcgtgcgcgtgcatgtctgcagactcacacttcacttggcctaaaagattagagatggaggaaagctctgaatgatccaaagcagctcctcaaatggaaggggttattattataattactatgattattgttatcaagattatcatgcttgcctagaaagtcttgtacaa

SEQ ID NO: 70115 - DNA, 601 bp, Human
ggttattattataattactatgattattgttatcaagattatcatgcttgcctagaaagtcttgtacaaagcaggcttattttgtgtcagcttgttgtttgtgtctgaggcatttcatctttgcttataataactaacattggcaggcttctttcatgttgcaaagctgtgtcacatcctcaccccgttttatctgcacaaacagccctgtgcagtggggagtagtgagagaacagaggctcagaggttaagtgttctgtccaaggtcacatggctaaaaagatgcagaagccaggatttraacttgggtcacacaatgaaaatccctgttcatttccccatcatatccttggcacctcatcccttgagagggaagaggccttttattaagctttagctccaagcctctttgccactgatatttgctgaaaagcttacattgccatgaagagaagggaagggttttgaagactcaagtgttaaaagtgcagtttaccatcccagtttcacacaaagaatatacctgggcttttccaagtccctgcagtacctggggtgtgagtggagaatgtggtcttctatccttttcgctcaggttctc

SEQ ID NO: 70116 - DNA, 601 bp, Human
tggctaaaaagatgcagaagccaggatttgaacttgggtcacacaatgaaaatccctgttcatttccccatcatatccttggcacctcatcccttgagagggaagaggccttttattaagctttagctccaagcctctttgccactgatatttgctgaaaagcttacattgccatgaagagaagggaagggttttgaagactcaagtgttaaaagtgcagtttaccatcccagtttcacacaaagaatatacctgggcttttccaagtccctgcagtacctggggtgtgagtggagaatgwggtcttctatccttttcgctcaggttctcttggtcaccaccaccacccctggggtgtggcacaggacagacaggcatctgctacatctctgagaagcgcggaagaaggtgctatgacaggagaagctggtgcagggggactgtctgtgtcctggtgggtaggagctgggtacacagggggcagggccctgactgggctctgggagcctacgcccctccttggagcatgggttctatctccagggaccagctggctgactggagagagctttctggaagcagcacccctccctgctgcgca

SEQ ID NO: 70117 - DNA, 601 bp, Human
tgagttttctaaagaagtcagctctagccgtctgccccgcataaaatactcacaggccagacctggtatcttcatccattcaggctatcatagcagaataccatatgctgggtggcttatacacaacagaaatttatttctcacagttctggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcstgagagctccacctttaagacctaatcacctcccaaaggccccatctccgaacgccagcatcttgggggttaggatttcagcataggaatcttagggggacataaacaatcagactacagcacctggtgagtctgcccagagaacgtgcgtgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatggga

SEQ ID NO: 70118 - DNA, 601 bp, Human
gccagacctggtatcttcatccattcaggctatcatagcagaataccatatgctgggtggcttatacacaacagaaatttatttctcacagttctggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcctgagagctccacctttaagacctaatcacctcccaaaggccccatctccgaacgycagcatcttgggggttaggatttcagcataggaatcttagggggacataaacaatcagactacagcacctggtgagtctgcccagagaacgtgcgtgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatgggaaattcaggctcagcctgagccccgtcccccagacccctaaaagcaggcagacaaa

SEQ ID NO: 70119 - DNA, 601 bp, Human
ttctggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcctgagagctccacctttaagacctaatcacctcccaaaggccccatctccgaacgccagcatcttgggggttaggatttcagcataggaatcttagggggacataaacaatcagactacagcacctggtgagtctgcccagagaacrtgcgtgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatgggaaattcaggctcagcctgagccccgtcccccagacccctaaaagcaggcagacaaaggagcagggtctcccctggctctagtaattgcttgtgaagcccaccatccttttttttgtgctggcaaagcccttccttcccctcaggcct

SEQ ID NO: 70120 - DNA, 601 bp, Human
ggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcctgagagctccacctttaagacctaatcacctcccaaaggccccatctccgaacgccagcatcttgggggttaggatttcagcataggaatcttagggggacataaacaatcagactacagcacctggtgagtctgcccagagaacgtgcrtgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatgggaaattcaggctcagcctgagccccgtcccccagacccctaaaagcaggcagacaaaggagcagggtctcccctggctctagtaattgcttgtgaagcccaccatccttttttttgtgctggcaaagcccttccttcccctcaggcctggcc

SEQ ID NO: 70121 - DNA, 601 bp, Human
gggtacccgttagttctcagcttgggcctcaggtggccaggccttgtctgagatgtgaagtccagagctgctggctgtggcacaagaggaggtcgactttgagtccaggctctccttactggcgatgtgatctttagcaagctctctcgcctaagcaggatacccacctgccgtaatcattaaatgagacacaaactgacaagagctggaggatagataggattgagtgagaaactggggccaagcctcatattaaaatgccaaggatccatacatcctgcagacgtggctgagcaccaastctctaccaagcacggtgtgaggcccaggtaccgtgagaaatcaggaaacgatccctgccctgaggaccaggctcatacagcaccagctgtaccatggtgttgctgtgcgctgtgggagcagggaggtgggcttccctaaggaggtgacatttgagatagggtgggactgagaccagagtgatctggacagatggagcacccagcttatttggggaacaggagtaaggctgtatggctggagccccgtgagagggggcaagttggaggatgtcaggacagagaggcagtcaggggctttg

SEQ ID NO: 70122 - DNA, 601 bp, Human
agagctggaggatagataggattgagtgagaaactggggccaagcctcatattaaaatgccaaggatccatacatcctgcagacgtggctgagcaccaactctctaccaagcacggtgtgaggcccaggtaccgtgagaaatcaggaaacgatccctgccctgaggaccaggctcatacagcaccagctgtaccatggtgttgctgtgcgctgtgggagcagggaggtgggcttccctaaggaggtgacatttgagatagggtgggactgagaccagagtgatctggacagatggagcacycagcttatttggggaacaggagtaaggctgtatggctggagccccgtgagagggggcaagttggaggatgtcaggacagagaggcagtcaggggctttgtaggccccaaggagtctggaatgcgggaatgatgggcagctgttgaaaggaagagctatacccattatgattaagtttaactgaataccagaaactctggaaattatgccttaaataagatagaaattgatttaagtattaagaaaacacacactgaagatagtgtgaggatgacttcagatagtgtggagtctgatcctt

SEQ ID NO: 70123 - DNA, 601 bp, Human
gaggccaaggcgggtggatcacctgaggttgggagttcgagaccagcctgaccaacatggagaaaccccatctctactaaaagtacaaaattagccgggcgtggtggcacatgcctgtaatcccagctactcaggaggttaagccaggagaatctcttgaacccaggaggcggaggttgtggtgagctgagatcatgccactgcattccagcctgggcaacaagagcaaaactccatctcaaattaataataataataataatgcacacatgaataaaatatcccaattctggagagcccrtgaaatcggggagatggtaggcctggtgtatgcgactcccagaccccagtggggtctcagtctctgttgggctccaggactcgtgcggtctgaaaccagggggaaggcggctggaggaaggaccccagctccctgcctccacctcctccagtgctgagcatcttgtcttgggcctggtagtagtcagggtctctgtgagtgcaagtggcagaaactaacgggatagggctcacaggacaggtcacatgaagggtaaagggacccagccttggggacctaaataccatgacacttccctgc

SEQ ID NO: 70124 - DNA, 601 bp, Human
agaccagcctgaccaacatggagaaaccccatctctactaaaagtacaaaattagccgggcgtggtggcacatgcctgtaatcccagctactcaggaggttaagccaggagaatctcttgaacccaggaggcggaggttgtggtgagctgagatcatgccactgcattccagcctgggcaacaagagcaaaactccatctcaaattaataataataataataatgcacacatgaataaaatatcccaattctggagagcccgtgaaatcggggagatggtaggcctggtgtatgcgactcycagaccccagtggggtctcagtctctgttgggctccaggactcgtgcggtctgaaaccagggggaaggcggctggaggaaggaccccagctccctgcctccacctcctccagtgctgagcatcttgtcttgggcctggtagtagtcagggtctctgtgagtgcaagtggcagaaactaacgggatagggctcacaggacaggtcacatgaagggtaaagggacccagccttggggacctaaataccatgacacttccctgcttctttctggtagctttattctgagagtcttcttcatgg

SEQ ID NO: 70125 - DNA, 601 bp, Human
gccactcaccatcgggttgttaagtgagtgccttcctctctgtggccctcaatttccccactatgaagtggagatggtaatactacagcaactgctgtattagctgtgccacagcaatgctgtctactgagcctctcctaaacccagccacttagttctgcagatcagagacccagggcaggctccactctgtaccaggctccccgagtcctcttcccaggatgaatgacagagcccgggcgtattcatggcgatggcagggcccacgaggaccagcagaaacacggcctctcaaggagcyggcacagtgccactgctgcaccattctgtgggccacggcgagtcctgtgccatactcaacatcaagcagacaggacatatactcagcctttagcaggaggagctgaagaggcgcagggcaaagggtgtgggcagaggaggggtgaaaggcccaacgacacagctcttgccactcgctcctgaggtgggggaggttctgaggacggagtgtgttcaccaaatcctttgtacgctaagtactactcccgtgtgcaaggtggcggtgacggtgcagtcctgggatgtctgcaggagccttctt

SEQ ID NO: 70126 - DNA, 601 bp, Human
ataagggggatgacaggagggcaggaggacggaaggaagaaaggaaggggagagagggagaaagaagaggacagaagagaagacggagaggtgggaagtggtaaaagctggagctggttagaaggtgctcccggctcttcccatcacagcaggtcacaggtccactggctgcagctttatcactctaggcatctccaaggacatcctcactgcttccgtgcccttggcctctagattggaggctccagagccctgggatggtcagcgttggtcagggacatgtcttctgtcatggagatastgggattgcccccttggctttcgggaaatgcaccccacctttgcaattgcaatctggtacccatacattcagtgggggctttctgcaaggagcccttgagctttatcccactagctgggaagattctgacatgatccagtccagccattttcaccaggtctcagctggggcctttttgcctccaggggacattcagcaacatcgggagacatttttgatggctgcagctagagtggtgctcccggcagctagcaggtagaggccagagatgctgttaaacaccccatagtgtgcaggacg

SEQ ID NO: 70127 - DNA, 601 bp, Human
tgcaatctggtacccatacattcagtgggggctttctgcaaggagcccttgagctttatcccactagctgggaagattctgacatgatccagtccagccattttcaccaggtctcagctggggcctttttgcctccaggggacattcagcaacatcgggagacatttttgatggctgcagctagagtggtgctcccggcagctagcaggtagaggccagagatgctgttaaacaccccatagtgtgcaggacggcccccacaacaaagagttacgtggccccaaacatccatagtgccaakattaagaaaccctgatctacgcaatgccaatggacagaggctgaggccaatgttcactcctggacatttccacgggccacatggcagccaacagactagggacttgagcaaggccgggagcggcttcccatttctgcacacctagattgtccacagggcaaatgccgaagtcctgtgagtcccaggtgatgactacctaggcccccgggcctgatgagctcccagggacaccctggtggtcagggcagtgagcccagaagctcagtgtccaccattccgtatgcacaaatcacagaccag

SEQ ID NO: 70128 - DNA, 601 bp, Human
ggccagcaagaccctcaagggcctttagggccagctggcccaaatctgtcttctagtggctcagcaaattctgctctccacttacatttttacccatttcactaattataacatgaatccattaccaaaaaaaaaattaaacaaatgcagagggatgtaaaatgagaagtaatcttcctactccccccaccagccctgcccctcccacttttacccacttccatttatttgtcccagtggcatccagaaaaacttgatcctctgactcaaaatagtatttactgccacccactctggaatsgagggagctcagctcaccttccttccttccatcgctctccaccttcacctccggctttttgctagttacaggattatttttagttcttccggtgcttacctttataactttaaataagaaacttgagtcagtatttgtcaactccccaccaagtaagctgaggaaattctcctccctgcagcctcatctctgccttctttcaaattttccacttcccaggttgatgatgttaccattctcttctgtcactgtggctgggccttccgtgtctcccctctgggagagggcaggaaagacagg

SEQ ID NO: 70129 - DNA, 601 bp, Human
gccttcccgactgggttgttaagcagttctcccacaccttgcccaccctccacagccgtctccttgcatgaggctcggccagcacagagaggccagagggccaggttgcccatctaaaggaggtttgccctggctgggaaaggaagagcaggaccaaacgcttccaggctggtgtccagctgcagatgacagcagagggcgtcctcacagcttggaagcagaggtcatgggcgccagggcggggcaggcacagaggcttgggagaggctccttctggctgagaccagagcctgcccagatrccactggctggcgaggaggctgtgaggccgggggcgtgtacaggtctgctctgcagcctcggctctctcaccccatccccacaccgttcctgtccacggagggcagtcaggctcaggagaggaggccaggagtcctgtttaaattttttttctggatttttaaaatgctgatgatgtccagtttaagagcatggggtctggagccagtcagaactgggctggaatcccagccaagtgcattttctttttttctttttttttttttttctccccgagacagagtcttgctctgtcacccag

SEQ ID NO: 70130 - DNA, 601 bp, Human
gcagagggcgtcctcacagcttggaagcagaggtcatgggcgccagggcggggcaggcacagaggcttgggagaggctccttctggctgagaccagagcctgcccagataccactggctggcgaggaggctgtgaggccgggggcgtgtacaggtctgctctgcagcctcggctctctcaccccatccccacaccgttcctgtccacggagggcagtcaggctcaggagaggaggccaggagtcctgtttaaattttttttctggatttttaaaatgctgatgatgtccagtttaagagcrtggggtctggagccagtcagaactgggctggaatcccagccaagtgcattttctttttttctttttttttttttttctccccgagacagagtcttgctctgtcacccaggctggagtacagtggcacgatctcaactcactgcaacctccgcctcctgggttgaagcgattctcctgcctcagcctcctgagtgctgggattataggcacctgccaccaggcccagctaatttttgcatttttagtagagatggggtttcaccatgttggccaggatggtctcaaaatcctgacctcatg

SEQ ID NO: 70131 - DNA, 601 bp, Human
acagcctcaggcaaggtacttaccttcgatgagccccagttttagtacatttaactcagggaaattacacatgaaacatggttacacatgcaaagaatagaacctatctgttggccattattatcttttaaatgaaaaaatgacaaaacagtattataataaacatggtagtctcatataaaagcttgatcttgtctgagtgtcccgggagctgcatgcgtagcccttttggctgtgaatgagtgcgtgaggccaagacccctaagacccacttcctcagtcgcccccactccctatggcytggaatggaggtgatgtcttttccacagtgacctggaggggccctgaccgagactggactctgaagatgggtggcctggccagtcccgaacagtgtccaggcatttggtccatagtcccctgtttgttgccatcctcagctacctggacagcctggatcggattggggccgccgactaccagcccaccgagcaggacatcctccgaaccagggtcaaaaccactggcatcgtagaaacccacttcacattcaagaacctccacttcaggtgaggcccagagaggcccccaggccctggcg

SEQ ID NO: 70132 - DNA, 601 bp, Human
atcttgtctgagtgtcccgggagctgcatgcgtagcccttttggctgtgaatgagtgcgtgaggccaagacccctaagacccacttcctcagtcgcccccactccctatggcctggaatggaggtgatgtcttttccacagtgacctggaggggccctgaccgagactggactctgaagatgggtggcctggccagtcccgaacagtgtccaggcatttggtccatagtcccctgtttgttgccatcctcagctacctggacagcctggatcggattggggccgccgactaccagcccacygagcaggacatcctccgaaccagggtcaaaaccactggcatcgtagaaacccacttcacattcaagaacctccacttcaggtgaggcccagagaggcccccaggccctggcgagggctaagatgggacatgcccagcctctcagcgcattgcgtttacagcgcccaaacatcatcctgccccagggaacctgcgggttggggcaggcagctagatactagaaggaacctgtctgtgtttctgccaaggttaggggctggagtgagcagggaggctttctggaagaagattcccagagtgg

SEQ ID NO: 70133 - DNA, 601 bp, Human
cccgaacagtgtccaggcatttggtccatagtcccctgtttgttgccatcctcagctacctggacagcctggatcggattggggccgccgactaccagcccaccgagcaggacatcctccgaaccagggtcaaaaccactggcatcgtagaaacccacttcacattcaagaacctccacttcaggtgaggcccagagaggcccccaggccctggcgagggctaagatgggacatgcccagcctctcagcgcattgcgtttacagcgcccaaacatcatcctgccccagggaacctgcgggytggggcaggcagctagatactagaaggaacctgtctgtgtttctgccaaggttaggggctggagtgagcagggaggctttctggaagaagattcccagagtggggctgtgaggaacagggaggatttggacaaggaggggcagcctgtccctgaggtgacttccaaggaggaggaggaggtgggctaccagggggcccttccaaggtcaccttggggggaggagccaagagtggggctgggtaagcccaagctacctctgtgagaccctgaggacccacgtaatcccagagctggaagga

SEQ ID NO: 70134 - DNA, 601 bp, Human
gctaagatgggacatgcccagcctctcagcgcattgcgtttacagcgcccaaacatcatcctgccccagggaacctgcgggttggggcaggcagctagatactagaaggaacctgtctgtgtttctgccaaggttaggggctggagtgagcagggaggctttctggaagaagattcccagagtggggctgtgaggaacagggaggatttggacaaggaggggcagcctgtccctgaggtgacttccaaggaggaggaggaggtgggctaccagggggcccttccaaggtcaccttgggggraggagccaagagtggggctgggtaagcccaagctacctctgtgagaccctgaggacccacgtaatcccagagctggaaggagcagagagagctgacccaccctctcctagtacgcttgggaagctgaggcctgacaagagcagggcttttcccaggcacagagcacagctagaacccaggggctctggggcctcagagcaggggcctgacgggtgagctggttcccagggtcctgctgcagcgctgtgtccccacctgcagtaacatgcgtgcactgaggcctgctccgtcctgtgggga

SEQ ID NO: 70135 - DNA, 601 bp, Human
ctaagatgggacatgcccagcctctcagcgcattgcgtttacagcgcccaaacatcatcctgccccagggaacctgcgggttggggcaggcagctagatactagaaggaacctgtctgtgtttctgccaaggttaggggctggagtgagcagggaggctttctggaagaagattcccagagtggggctgtgaggaacagggaggatttggacaaggaggggcagcctgtccctgaggtgacttccaaggaggaggaggaggtgggctaccagggggcccttccaaggtcaccttggggggmggagccaagagtggggctgggtaagcccaagctacctctgtgagaccctgaggacccacgtaatcccagagctggaaggagcagagagagctgacccaccctctcctagtacgcttgggaagctgaggcctgacaagagcagggcttttcccaggcacagagcacagctagaacccaggggctctggggcctcagagcaggggcctgacgggtgagctggttcccagggtcctgctgcagcgctgtgtccccacctgcagtaacatgcgtgcactgaggcctgctccgtcctgtggggaa

SEQ ID NO: 70136 - DNA, 601 bp, Human
aggtgacttccaaggaggaggaggaggtgggctaccagggggcccttccaaggtcaccttggggggaggagccaagagtggggctgggtaagcccaagctacctctgtgagaccctgaggacccacgtaatcccagagctggaaggagcagagagagctgacccaccctctcctagtacgcttgggaagctgaggcctgacaagagcagggcttttcccaggcacagagcacagctagaacccaggggctctggggcctcagagcaggggcctgacgggtgagctggttcccagggtcctrctgcagcgctgtgtccccacctgcagtaacatgcgtgcactgaggcctgctccgtcctgtggggaagagaggccagcagagaaggggagggcagggacccctgctgggagagctggattctaatattccctgcctcccatgtccccaactcctgcccgctcctgttcagactgaggggccgaggctctgggcccaggaacccctaggcctccgcagatctggggagcaaaaccttgggcagagcagccctgaggggcctctcttgccttcccaggctccttggtctctcctgctccccca

SEQ ID NO: 70137 - DNA, 601 bp, Human
agcagccacaaaggcagctcattgccgtggtggcagcaagaacaatactggcgctgtagaactaagcagtcatcgccgtgcgctgggggcgcatgcagaggtggacagcttgggagtcagacagatctggtccagggtctagcatcacccctgccgcctgtgtgatcatgggcaaccgccccaccctgcccgggcctgcacctcctcctctgtaaatggtgacaatggtagaatggaccaccgggctaaaagctgtaaaagtgcctgtacacaggaatcatcactcagtgaatagctcctktggctacaacattcagatgccatggctagaggtcaggttctaggatgtgggagctctgtctgcctcagggaggcaagagccaggccccaggaactcaggccttggtcctcagccatcctctctggtcagcgctgtgcatccctctctggcctggggtgagagcctgcaacaaaggtgtctggaagcagcttctggagccaggccaggagagccctggggctagtggctgccactggccatccagccgccctgtccgctgcatcccgggagcccgagagcctggtcctggcctcgtacctg

SEQ ID NO: 70138 - DNA, 601 bp, Human
tgtttcatcttggggttcctctggcccctctactgagaaaccagccccaacaaccagttctcccagagcctcccccgctccagcccaccaacgagaccaccaaccacaccaaggccacagcaagctcacccccgagacgctattccctggtgtctgcttccaactcgggattaattcgaggatctcttagtcctcagttaatgtttcccaactgaatgcgtgcacccttccaaccttgctgtcaaaaccgaatgagaccctggtagagaaatctgcatgagcagggttccgcgcagatgcrttcggtggtggttgcggcccctgcgctgtacgtgcatggtgcatgtcctctccgtgagctggagcctctccagtgacctcactgcccccacctggggccagctctctttggaagggggcagcatcccccaaccctgcccggccctgctccgccccgccctgcctgcgtgtggaatgaaacaggaccacgtcccgtctgtccttgtgggtcctcccgtctccgtcctggtggtctccgtcccggtggtgcatccagccacattggtggaccttccctttgcttgtcccgctgtgtcattgg

SEQ ID NO: 70139 - DNA, 601 bp, Human
gagcaaacgccgagaagatgaggggcggggcacagaggcttggagttaggcagcccaaggtttatgccccagctccgccactcacaagcagctcaggcaggtcatgcagcctctctgaacctcagtctctgggtctgtgagatggggtgatggctgtgattgccctcgcctccctcaccaggtgctatgaagagggaatgagctgatgggcacgcagagcttcgcgtggtgccgcacataggaagcgctccctgcctgtctgctcttgcctttagggttatgcctgtaactcacacggggytgctgcaagactcaaatcacagagctttgcaagcagcagagccctggccccctatatagggtgctggggatgagaggccagccctgccagtgctgtggtgggtttacctgaccatggggtgggcgggcagccaggagggcagcatgaccagggcccctgaggagctgcaggttggcagctctggtcagtgacaccagagcggttacagggccccagcatagctcgggtgcccatcagctcttctgagatggccagaccctgtccagagaagtgagtgggaggagaagtggggcaccctca

SEQ ID NO: 70140 - DNA, 601 bp, Human
aagcagcacagctctcctacctcctgcctccgcccatccccccatatcaggctgagtgcctggcaggccaggacccaggcatgtccagctggagttgagtagggctcagcctccctggaagctcccagccagcttcctctctagccatagttgagggcctgtggatcctgccctagtgacccgggcttgtggcctgtggggcagtggaaacaggtggggtcggtcagttaccaaggccagtgtgggcctggagtggggaaggaggaggggacaagggaggctgagtagtcagctgcagtcytaggacactccccaacctccagcccagattgagcaaagagctgaggtctggcaggccctccaggctttctgcacagcagcccactccagcttagagctgcggctctgaactccagctcccctccctgctgccccctccacagccctgcttgcacctggcatggattcctggaggctgagggccttcagtgcaaagctggggtcctgttcttctgccccttcccaaactagaagcttctctcctagactctcctctccctgagcctacctgagaaccagctcagtgtgttgccccctgagg

SEQ ID NO: 70141 - DNA, 601 bp, Human
tgggcctggagtggggaaggaggaggggacaagggaggctgagtagtcagctgcagtcctaggacactccccaacctccagcccagattgagcaaagagctgaggtctggcaggccctccaggctttctgcacagcagcccactccagcttagagctgcggctctgaactccagctcccctccctgctgccccctccacagccctgcttgcacctggcatggattcctggaggctgagggccttcagtgcaaagctggggtcctgttcttctgccccttcccaaactagaagcttctctcytagactctcctctccctgagcctacctgagaaccagctcagtgtgttgccccctgaggaaggcagcatgtgagccaggcggttgttaatcccctgtgagtggacagcagaaacaagaagtttataggcttcttctcccatctggcccagcagtggccacaggaggtgatatcaaggcctgctctgtggactcccaaaggaaaaggcccacccacagggtgtgcatcgaccagggctacctgcatgagcccagtgccctcaaacttccttgctcatgacccatgataagatataacatttg

SEQ ID NO: 70142 - DNA, 601 bp, Human
atgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtgggrtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaa

SEQ ID NO: 70143 - DNA, 601 bp, Human
ccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccrtggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgc

SEQ ID NO: 70144 - DNA, 601 bp, Human
tccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcasaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagtta

SEQ ID NO: 70145 - DNA, 601 bp, Human
cccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctcckcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggc

SEQ ID NO: 70146 - DNA, 601 bp, Human
tggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagygcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgc

SEQ ID NO: 70147 - DNA, 601 bp, Human
caggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcrtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctg

SEQ ID NO: 70148 - DNA, 601 bp, Human
cccaaagcagagtttttgcccagggcaagaggctgcccccgttcggcatctgtggggcgcccatcacgttcatccatttgctaaacaggctcctgtgtgcagggcagccctccacatctgccttgcttagaacatcatgcagtgtcagatgcagctgagtaggacccagccagaggaggtgtggccagtcccccaggtgctcctggaggtggccctgccaggagcctctcccctgagtggtggcacccaggatgctggcaggacctggcatgccttcccctgagaccataggaagggccckgagtctctcaccactcccagagaacatccccctacccaggatgggcccaggaggagaggtctaggcaggaagggccaaagcccagctctccggctccggtccagactcccccaacgcccacacacacaggcacacacacaggcacgcacacacactcaagcacatggatgcacacaggcatgcacacacaggtgcacacacataggcacacatgcacacgaacacacacaggcacacataacaggtgcatgcacacacacacaggcacatgcacacagccacacacacgtgtgctgggag

SEQ ID NO: 70149 - DNA, 601 bp, Human
tgcccccgttcggcatctgtggggcgcccatcacgttcatccatttgctaaacaggctcctgtgtgcagggcagccctccacatctgccttgcttagaacatcatgcagtgtcagatgcagctgagtaggacccagccagaggaggtgtggccagtcccccaggtgctcctggaggtggccctgccaggagcctctcccctgagtggtggcacccaggatgctggcaggacctggcatgccttcccctgagaccataggaagggcccggagtctctcaccactcccagagaacatcccccyacccaggatgggcccaggaggagaggtctaggcaggaagggccaaagcccagctctccggctccggtccagactcccccaacgcccacacacacaggcacacacacaggcacgcacacacactcaagcacatggatgcacacaggcatgcacacacaggtgcacacacataggcacacatgcacacgaacacacacaggcacacataacaggtgcatgcacacacacacaggcacatgcacacagccacacacacgtgtgctgggagaccctcacatagctgggaactctgcagtgggga

SEQ ID NO: 70150 - DNA, 601 bp, Human
ttgcgcctcctctctccccttcttccttcgtccctggtctttgccccaaatccaaccactccagctatctgcaagcctcctgtatcactgcctccctttcttctgccttctctggggctttcttcttgctctcaggggaatgtgtcacagaccttcccccccacccggctcaatgacgctctttccaaatggatggatgagggatggtggcttccgtggaatgggccaactctgggctactgctaatgcctaaaagcagcactgatgggatgccagagcccagccctggtccctctagggkctgggaagcttctaggggtccctggggtaggagttgcctttgcagactacagagtgcacagggccagcaccctgccatggaggaggaggtgtcctgtcatccgccaggtcagggcacaggttggctcggccaggaacccatgttctgacagccctggagtaaggctttgggcatgggctcagtctcagggccacacgggtccccaagctcagccacagggtgcctacatccagcataggtcgatgctggtctccccacccttccccacagctgggagcagtgtgtgaagaagggctgtca

SEQ ID NO: 70151 - DNA, 601 bp, Human
acggagaaggtgccctctgcaggatggagtgagggcaggagggcacaggacaagccctgaaaggccagccccaggtggcccttgggcagagccaggctgtagcccactctggcagccactcctgacctctcccagccacaacgatggagtccagtaggccccctcaggccagggctaccctcagagacaggcccaaccctacggctctttcttgcccagtgtcccactggggcctgacttgggagtggccagtctcactgctgtggagtgcaagcactagatgccccagcgaagggcagtyggaacctgagaaacaagttctccagggccttcagaggaatccagtttgaattcaggtatcatggatgacagatggtcaccagtgcagtggccccatggagtgcaaacctgtgagggcacaaaacaagcagcaggggtgggacgggaggtggccggctgtctaagggacgtgtgggccagcatggctgggtggcagcagggctgtgtgaggacgctgggctcggcagacacagcgaaggcacgaggcgctcctcccacctggacggcttcctgtggccaccttccaccctgggctgtgccc

SEQ ID NO: 70152 - DNA, 601 bp, Human
cagagacaggcccaaccctacggctctttcttgcccagtgtcccactggggcctgacttgggagtggccagtctcactgctgtggagtgcaagcactagatgccccagcgaagggcagttggaacctgagaaacaagttctccagggccttcagaggaatccagtttgaattcaggtatcatggatgacagatggtcaccagtgcagtggccccatggagtgcaaacctgtgagggcacaaaacaagcagcaggggtgggacgggaggtggccggctgtctaagggacgtgtgggccagcrtggctgggtggcagcagggctgtgtgaggacgctgggctcggcagacacagcgaaggcacgaggcgctcctcccacctggacggcttcctgtggccaccttccaccctgggctgtgcccagttcggctctctccagacaggaagctcctgggcagggtccacacgggctgctttgtccaatccttaacagctgtgctgtgggcttggcatctctgcaccagtggatcaaggatgaggctttgcactgtgggtccaggcactcctgctgggctgcccagagctggtctcagccatgacaac

SEQ ID NO: 70153 - DNA, 601 bp, Human
tggatctggtgtgaaaacagtaagagatcttgcaaagtccaaagccaggcaaatgctcagcctgtgtatggttggtgcaaaagtaattgcagtaattgcagttttgctatcaaaagtaatggcaaggccaggcgtggtggctcacgtctgtaatcccagcactttgggaggccgaggcaggtggatcacctgaggtcaggagttcgagaccaacctggccaacatggtgaaaccccgtctctactaaaaatacaaaaattagctgggcgtggtggcacgcgcctgtattaccagctactcrggaggctgaggcaggagaatcgcttgaacctgggaggcagaggttgcagtgagctgagatcgtgccattgcactccagcctgggcaataagagcaaaactctgtctcaaaaaaatagttctttaatttaaaatgcaactatggcttggaactgcccagcagttcctactgctcccttcctgtctcatcccacttcctgggacacgccacaacccacttcttgtcttcatgtccccagccctgtccacccacagcgctcatcagggcctctccccgttcttctgtgtcttgttacaggccc

SEQ ID NO: 70154 - DNA, 601 bp, Human
ttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgata

SEQ ID NO: 70155 - DNA, 601 bp, Human; identical to SEQ ID NO: 30381

SEQ ID NO: 70156 - DNA, 601 bp, Human; identical to SEQ ID NO: 30382

SEQ ID NO: 70157 - DNA, 601 bp, Human; identical to SEQ ID NO: 30383

SEQ ID NO: 70158 - DNA, 601 bp, Human; identical to SEQ ID NO: 30384

SEQ ID NO: 70159 - DNA, 601 bp, Human; identical to SEQ ID NO: 30385

SEQ ID NO: 70160 - DNA, 601 bp, Human; identical to SEQ ID NO: 30386

SEQ ID NO: 70161 - DNA, 601 bp, Human; identical to SEQ ID NO: 30387

SEQ ID NO: 70162 - DNA, 601 bp, Human; identical to SEQ ID NO: 30388

SEQ ID NO: 70163 - DNA, 601 bp, Human; identical to SEQ ID NO: 30389

SEQ ID NO: 70164 - DNA, 601 bp, Human; identical to SEQ ID NO: 30390

SEQ ID NO: 70165 - DNA, 601 bp, Human; identical to SEQ ID NO: 30391

SEQ ID NO: 70166 - DNA, 601 bp, Human; identical to SEQ ID NO: 30392

SEQ ID NO: 70167 - DNA, 601 bp, Human; identical to SEQ ID NO: 30393

SEQ ID NO: 70168 - DNA, 601 bp, Human; identical to SEQ ID NO: 30394

SEQ ID NO: 70169 - DNA, 601 bp, Human; identical to SEQ ID NO: 30395

SEQ ID NO: 70170 - DNA, 601 bp, Human; identical to SEQ ID NO: 30396

SEQ ID NO: 70171 - DNA, 601 bp, Human; identical to SEQ ID NO: 30397

SEQ ID NO: 70172 - DNA, 601 bp, Human; identical to SEQ ID NO: 30398

SEQ ID NO: 70173 - DNA, 601 bp, Human; identical to SEQ ID NO: 30399

SEQ ID NO: 70174 - DNA, 601 bp, Human; identical to SEQ ID NO: 30400

SEQ ID NO: 70175 - DNA, 601 bp, Human; identical to SEQ ID NO: 30401

SEQ ID NO: 70176 - DNA, 601 bp, Human; identical to SEQ ID NO: 30402

SEQ ID NO: 70177 - DNA, 601 bp, Human; identical to SEQ ID NO: 30403

SEQ ID NO: 70178 - DNA, 601 bp, Human; identical to SEQ ID NO: 30404

SEQ ID NO: 70179 - DNA, 601 bp, Human; identical to SEQ ID NO: 30405

SEQ ID NO: 70180 - DNA, 601 bp, Human; identical to SEQ ID NO: 30406

SEQ ID NO: 70181 - DNA, 601 bp, Human; identical to SEQ ID NO: 30407

SEQ ID NO: 70182 - DNA, 601 bp, Human; identical to SEQ ID NO: 30408

SEQ ID NO: 70183 - DNA, 601 bp, Human; identical to SEQ ID NO: 30409

SEQ ID NO: 70184 - DNA, 601 bp, Human; identical to SEQ ID NO: 30410

SEQ ID NO: 70185 - DNA, 601 bp, Human; identical to SEQ ID NO: 30411

SEQ ID NO: 70186 - DNA, 601 bp, Human; identical to SEQ ID NO: 30412

SEQ ID NO: 70187 - DNA, 601 bp, Human; identical to SEQ ID NO: 30413

SEQ ID NO: 70188 - DNA, 601 bp, Human; identical to SEQ ID NO: 30414

SEQ ID NO: 70189 - DNA, 601 bp, Human; identical to SEQ ID NO: 30415

SEQ ID NO: 70190 - DNA, 601 bp, Human; identical to SEQ ID NO: 30416

SEQ ID NO: 70191 - DNA, 601 bp, Human; identical to SEQ ID NO: 30417

SEQ ID NO: 70192 - DNA, 601 bp, Human; identical to SEQ ID NO: 30418

SEQ ID NO: 70193 - DNA, 601 bp, Human; identical to SEQ ID NO: 30419

SEQ ID NO: 70194 - DNA, 601 bp, Human; identical to SEQ ID NO: 30420

SEQ ID NO: 70195 - DNA, 601 bp, Human; identical to SEQ ID NO: 30421

SEQ ID NO: 70196 - DNA, 601 bp, Human; identical to SEQ ID NO: 30422

SEQ ID NO: 70197 - DNA, 601 bp, Human; identical to SEQ ID NO: 30423

SEQ ID NO: 70198 - DNA, 601 bp, Human; identical to SEQ ID NO: 30424

SEQ ID NO: 70199 - DNA, 601 bp, Human
tcaggagggccatttcccttttcctgcccagatgctgttttcgctccttcgaagcaagatcccatgctcgactagacggccagtgtgcgccaggacccgcgtgtctccttccccacctgcagagctgctgagcccctcggcccccaaataaattgtaccgcagcacacaggccaaaaagggccccccaccaccaggggcttggctggggacagtggcttcacggtccaggtagggatggagggaacgtctcttgacgcttggtcatggccctcaagactaagccgtctccactgttccccstccccagctccaacttgcctcccctccccccactgcgagaagacctaggaggtgcgggcaggcagcaccgccacctcttcctccggtggagcgctcggccgacactcaccctttcaccacaaagaaggggtcctccatggacatggcgtcccggccccggccgccttcacctcctccgcgcacagggcgcccgtgcctcccggtctccctccgcccaccccgcctgttcccgcagctgcccgcgccttagtctgggtgaagccgagcagcgggcacgcgcacaggccaggtgcacaggac

SEQ ID NO: 70200 - DNA, 601 bp, Human
agatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgygtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcagccactgaataatattaagtagggtacacctgtctaggactctagaaaagcttacactgtgctgtccaacacggaagccacatacaactactgactggaaatgtggctagtgtgacagaaattaaattttaa

SEQ ID NO: 70201 - DNA, 601 bp, Human
ttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcacccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaatcacagtcactgtattgagtctggcactgctggagtactaaggctaagggagagcagaggctagatcagtgaggtcaggaagtgttggcactttattctgcaggccagcagcag

SEQ ID NO: 70202 - DNA, 601 bp, Human
gcctgagtacaccacttattagctgtgtgaccctaggcaagtaagttaacccctctaacacttcctcagcttctcatctctaaaatgtggctagtattcatcatatgggtgtttttacagagtgaaaattcatataaagtgcttacttagcactttacatgtatgcctggcactggagatgcatcctttaaatgtgagctgttactacttccctaaactgtctactccacctgggctgctcttccagatcatttctaacacacattgcccaacttaggcctttggctggtggtgttctcayccatgaggcaccattccatcacaatcaccaccatcaacaaagagtatgtgttcaacatttacactatatattcaaggtgtaggctggaaatacagaggaaaaaaaaaaaaaaaacagtcccaaacctcagagctcatagtctaataatgaaagagagacagaggaagaggtccaataattaggggtgacaaaggaagcacttcctggaggcaagggagatgcttacactgactccagaaagctgcgtgggtgaatcaggcagtgtgggtgcatgtagagtaagagcatccagtacagcaa

SEQ ID NO: 70203 - DNA, 601 bp, Human
gcctcaagtgatcctcctgccttggcctcccccttcatcgttttgatttatcctttcttctttgcccatgctggcagactctgaattggcatgttctagttatcgtggttgtttaacaatgaccccaaaatttagtggtgtaaaacaaccatttatcatgtcatggagtctgtagatcaggaatcagacacagcagagctgacttgtccctgttccacaatgtctgggacctcagctgaaaatattaaacaggctggggctgtaaaggcatcacatctctctatctctccacagtctgcamacatgctctaacagagtggcttcaatgtaactggacttgttacatgttagctcagggtagcctatacttgtgtcccaagatgaaagatgcagatggaaggtatagtggttgtcttttatgacttaagcttcaggagtcaagcagcgtcacttctgcttcaatctgctagtcaaagcagtttataaaggtctgcccaggttcaaaggaagggaatacaaactccagtttgataaaagaatgccagcttcacaatttaataaaaacaaacagccgggcgtggtggctcacgcctgtaatccc

SEQ ID NO: 70204 - DNA, 601 bp, Human
atgagaagaaagagtatctcagccattagggagctttgttccccagtatttgtcattcagttgtaccaacaaattgcgtaagtgtagccacaacccccatcatcctttttcctgttgtggttgagacagggtctcactgtcaaccaggctggagtgcagtggtgcaatcacagctcactgtaatctcgaattcctgggttcaaaggattcttccgtctcagcctcccaagttgctaggactacaggtgcacactaccacgccaagctaattttttttatttattgtagaaacagggtctcrctgttgcccaggctgatctcaaactcctggcctcaagtgatcctcctgccttggcctcccccttcatcgttttgatttatcctttcttctttgcccatgctggcagactctgaattggcatgttctagttatcgtggttgtttaacaatgaccccaaaatttagtggtgtaaaacaaccatttatcatgtcatggagtctgtagatcaggaatcagacacagcagagctgacttgtccctgttccacaatgtctgggacctcagctgaaaatattaaacaggctggggctgtaaaggcat

SEQ ID NO: 70205 - DNA, 601 bp, Human
gtttcatctgatacaggtagcatttcgtagataccaagagccagtgttggcaattctagggatgtggcttttcctccctgctgtctacaaaacagcccatcaaaatcatggaacctgtcatcttctcaaggattaaactccctacagacaccagaatgaaggctcttcatggcaagtcaccacaatgcccacaggaccacttgcaatgcagaactttcccagtaagtagctgtcaaaaatggaaacactgcccacatctttgaagaatgcatcttttgggaaaaacaaaataaagtcatcygagcattcagattcttccattctttttttttttttttttttgagatggaatttcactcttgttgccctggctggagtacaatggcacaatctcagctcaccacaacctccgcctcccaggttcaagcaattaccccgcttcagcctcctgagtagctgggattacaggcatgcaccaccacgcccggctaattttgtatttttagtagagacggggtttctccatgttggtcaggctggtctcaaactcctgacttcaggtgatccacccacattgacctcccaaagtattggtattaca

SEQ ID NO: 70206 - DNA, 601 bp, Human
agcctttttcaaatccttgaaagagaaagacggctatctccacacatcaagcaaatcttgcgctatccgtcacacatgctgcccaaatcagtttcatctgatacaggtagcatttcgtagataccaagagccagtgttggcaattctagggatgtggcttttcctccctgctgtctacaaaacagcccatcaaaatcatggaacctgtcatcttctcaaggattaaactccctacagacaccagaatgaaggctcttcatggcaagtcaccacaatgcccacaggaccacttgcaatgcasaactttcccagtaagtagctgtcaaaaatggaaacactgcccacatctttgaagaatgcatcttttgggaaaaacaaaataaagtcatctgagcattcagattcttccattctttttttttttttttttttgagatggaatttcactcttgttgccctggctggagtacaatggcacaatctcagctcaccacaacctccgcctcccaggttcaagcaattaccccgcttcagcctcctgagtagctgggattacaggcatgcaccaccacgcccggctaattttgtatttttagtagag

SEQ ID NO: 70207 - DNA, 601 bp, Human
ttgatacccagaactttccatgagagagtatataccatgaagcagtatataccttgaagcaggtataccttgaattgtcagagttcttcagcttagcaaacttcttggtaaataacaatctgctcacccacagcttggagaatcacatctggcagcatttcactgaaaacttgctgatgactttcctaggaattatagttttagctgctgacccagagaagcctttttcaaatccttgaaagagaaagacggctatctccacacatcaagcaaatcttgcgctatccgtcacacatgctgmccaaatcagtttcatctgatacaggtagcatttcgtagataccaagagccagtgttggcaattctagggatgtggcttttcctccctgctgtctacaaaacagcccatcaaaatcatggaacctgtcatcttctcaaggattaaactccctacagacaccagaatgaaggctcttcatggcaagtcaccacaatgcccacaggaccacttgcaatgcagaactttcccagtaagtagctgtcaaaaatggaaacactgcccacatctttgaagaatgcatcttttgggaaaaacaaaata

SEQ ID NO: 70208 - DNA, 601 bp, Human
catgtcctgaggaaaaaaatgaaagaaatggcaggaattagaaaaatgctacaaagcagttgcagaataaagctcagcaccctacaggcctgaccagcaacttggcttattccattctaaagctcttatttttaaaaagaggattcatgtttagttttcatttagtaacacagacataagaaaggtaaactagtcgttattttacatttttaagatggatgttttaagggatcacaaaggtggaaactgccagcaatggctcagatcttgaaagacagccagaatctgcagtgtatcaggraatcccatctcaatagcaagcaaagaggtctctctaagtggaaaacctcccaactgttcttccaatatcatttcagtgttagcctgaaaaagaaggcatgaactggaagcagaaaacaatgttggtcacaagtcttatttggaagccaactattaatggtaaccagaattttctaaagcatgtgggatttctaacagcttcaagagccacaagacacacctaataatgtacaaatctaaccagggagacaaccctctcaatccagaaccacttgtaagtacttgcaactaaaaactgaag

SEQ ID NO: 70209 - DNA, 601 bp, Human
cagctgcagtggctcatgcctgtaatcacagcatgttgggaggccaaggcaggtggatcacttgaggtcaggagttcaagaccagcctgaccaacatggtaaaaccccatctctactaaaaatacaaaaaaattagccgggcatggtggtgggtgcctgtaatcccagctactcaggaggctgaggcagcagaatcacttgatcctgggaggcagaggttgcagtgaaccgagatcgtgccattgcactccaatctgggtgacagagcaagactgttgtttccaaaaaaaaaaaaaaaaaagcaaaagatttgaccagtcacttcaccaaagacatacatatgacaaatagcacaggaaaagatgcccaatatcattaatgacatgcaaattaaatcttcaattacatactactacatatttagaatggattaaaatgaaaacaaaatgacaatgcaacatgctggaaaggtggtggggtaactggaattctcataccttactggtggaaagcacaatagtacagccatttggaagagagtttggttgtttcttgaacatatatttaccataccccaaagtcccactcctaagtgaaatga

SEQ ID NO: 70210 - DNA, 601 bp, Human
cgtgttctagctgattagggtgtttgttgtctatggctttaaaacagaattcacacgcatcctataccctctgatgtttcaagtattggaaaaaagaaagcgctaacaaaaatgaaaaaaagcaccttacaatatttaggtctatggcatactgatgagagctaagaggcggaacgttaaacagagaatacagcttctaggtgcaggctgagtaaataagcaaactatatggacaacaaatctaccaacgtctattcatctagtttaaggcttaggcaagtcacctcattgttcctttcaygtcagcctttagactttcagtgctaatgagaaaccctatttaagataaaatggggaagaattaagtgaggtgaaaatctactttctttactctttatgggatctgggtgatttagtggagaaagagctatgtatcattccttaatgcaaagtaagtcatcctttggtatccttaggggattggttccaggacctccacaggataccaaatctgcagatgctgaagtccttacataaagtggcatagtatttgcatataacctacgcacatcctcctacatactttaaatcatctctagat

SEQ ID NO: 70211 - DNA, 601 bp, Human
ttagcctcccgagtagctgggattacaggtgcccgccaccacgcctggctaatttttgtatttttagtagagacggggttttgccagattggccaggctggtcttgaactcctgatctcaggtgatccacctgcctcagcctcccaaagtgctaggattacaggcatgagccaccacgcccagccacattagtgtttttcttgtttagagaatgagactaggccattaagtgctatgatctagcatgcctttagattagatatagtcacaagattttaagaacttttacccccaccattgsgccaatatccactatttaaatgttataatctaatactatcacatataaaagccaaaaaggagtcattttataatcatatggtctctcatgttcaaagatgataatcccactgctcctgaactataagaactgttttgatccttctatgatttcttctggaacaaagaccacaaaaacgtgttctagctgattagggtgtttgttgtctatggctttaaaacagaattcacacgcatcctataccctctgatgtttcaagtattggaaaaaagaaagcgctaacaaaaatgaaaaaaagca

SEQ ID NO: 70212 - DNA, 601 bp, Human
agacaaatatcaaagttcaaaactttgatacacagtctgagtattatgttctcagctgatgcttggaatacaatagccattatttaagcagctacaatatcaagtttgttggggaaggacaaatttaatatttttctctgaacagactatacgtaaaagtataatgaagcaatcctacaaattaactaaagggcaatgagcattcccacatgcttccacttggtgtgacagtattaataatttatactcagatgataagtcctaatatggcctttcttttcttggtgtgggaggaatgagratgctggagggaaggttactcttacatagctaccattttattataggttaagtattttaatccgagaaattcttaaacccaaaatctcattcaatttccaaacattattagctttaaatatacctactttccttaattaagcaataccatataccagattagtgtttgtttttgttttgtttttgagagggagtcttactcttttgcacaggctggagcgaaatggtgcgatcttggctcactgcaacctccacctcccgggttcaagtgactcttctgccttagcctcccgagtagctg

SEQ ID NO: 70213 - DNA, 601 bp, Human
cctgctgatgagcttcactgcaaacacttagggctatctgaccacaggtgagctgggctcttcctgtttgccaacacttgtgtctatccttttttgactcctgatcacctttactaagacagcttttgcaagcctttttctcctgccattccaaaccacttcccattatgccaagatgctaaccctacttcttaatctagagagatcgggccttcttcagagaagctgccctcattcccttaccctctagcctggtccgacgcaccatgtcagacacttgcatagctctctatacttctckttcatagtctgcaggtatctatttgtgttattacttgattaccatctgtcccccatccctatccactcaaagttctgtgagggctggtatagtgtttattaatctaatctctgtaaccaacaaaatgcctggcacatagtatactcaataaacacttgctggttgaatgatgagtatctattaaaacttttgtttttttaatctcacattttctctatctcccctaactttttttccttccctcctttctcaagggaagaattatctccctgtaactgtgcttttgatcctgccccctca

SEQ ID NO: 70214 - DNA, 601 bp, Human
ctgacaggctgggcatggtggctcacgccagtaatcccagtactttgagaggctgaggcaggcaaactacttgagttcaggagttcaagaccagcctgagcaacatggtgaaccctgtctctacaaaaaattagcctggtgtggtggtgcacgcctgtagtcccagctatttgggaggcagaggttgtagtcagccaagatcatgccactacatttcagcctggtcaacacagtgagaccttgtgtcaaaaaaagaaagattaaaaacagatttctttttcttcaatcacggaaatttttytttttttttaaggtacagtgacgtgatcatagctctcagcctcaacctgatcctcccacctcagcctcccatcttggtcttccatgtagttgagacaacaggtgtgcaccaccatgcccagctaatttttatattttttttttgtagagacagggtttcatcatgttgcccggactggtttcaaacccctgggctcaagtgatccacccacctccacctcccaaagtgctgagattacaggcatgagccaccatgcgcagccaatcagagaaattatatatggggaagctcacatttaat

SEQ ID NO: 70215 - DNA, 601 bp, Human
gagattttgggtggggaaacagctaaatcatatcaacctctttctaagaatgtactttaaaaagcttttcagatattagaaaatgaactttggattcttctttccattataccaatgaacttaatttttaatatacgaacctctaaatttcaatttgcaaacttcctaagtctaccttgcagaaataaatataatgattaaggttaaggacatatgcttcactgcaaggccccacttaaatattaacgtctataggagtatccttcaaaaaacctactactacaaaaaaaaaaaaaaaaaagcttatacaaaataattggggatttacttatcttacaaaaaatatgtcacctaacaacaaggcttcctcatcagaacagtattttgaactggctagaaattaagaatgtccaatccaaacactcactgtggatggggcatctgaggtccagaaaggtttctccctcattaaaatgtgggtttatctataaacaatttacgtatatgtatatagaaaggcaactaatgaataaaacaagtaacaagaatatataaagttcagtgataatctaccatttgaaataatttcaaaaggaaatca

SEQ ID NO: 70216 - DNA, 601 bp, Human
atgcatagagtatcactgactcccctgcctacaaaagagaaagcataagtagaatacactgtttgaaagataaagtcaatcaaaattttggagcaatattaaatgaaagcccactagtaatagtaacagaagaactaacataaatttgtacaaattcctaatttgaacttcatttcatctcattttccaaatctgctaaccctctgctccctctctatcgagctcttccacccagaacccagaaatctctacatacaaacactgtttagctaaatgtggtaatgtggaattatacaaggtrtattttatttttaatcgagttagcaccattgctatttcctcctcttctataggactttcaactagaatttattacaatcagatcagcaaaagctcagttaggtactgttagcctaccactggtaaatactaacagcttcccccaaaggggtcataaatttaaacaagaatgatttaaaaccctaaaatattcaggtggatcacatagttgagtatggtttagatctcaactctaaaaggacagtaagattttgaagtactgacttgatttggaatacctctcattactctgttctcacat

SEQ ID NO: 70217 - DNA, 601 bp, Human
attaatcaagaagaaacaggcgatttacttcttcaggttgaagcaaataaagaaaaaaaaaaaccacaaaatgcatagagtatcactgactcccctgcctacaaaagagaaagcataagtagaatacactgtttgaaagataaagtcaatcaaaattttggagcaatattaaatgaaagcccactagtaatagtaacagaagaactaacataaatttgtacaaattcctaatttgaacttcatttcatctcattttccaaatctgctaaccctctgctccctctctatcgagctcttccayccagaacccagaaatctctacatacaaacactgtttagctaaatgtggtaatgtggaattatacaaggtatattttatttttaatcgagttagcaccattgctatttcctcctcttctataggactttcaactagaatttattacaatcagatcagcaaaagctcagttaggtactgttagcctaccactggtaaatactaacagcttcccccaaaggggtcataaatttaaacaagaatgatttaaaaccctaaaatattcaggtggatcacatagttgagtatggtttagatctcaac

SEQ ID NO: 70218 - DNA, 601 bp, Human
atatttctaaaacacaaaaatttcacatgtggaatctttgatgtataggtgactccacaagagtaaaaatgattacctcaaaaatatgaaagctatttacacaaaaatgtgagtattttggttcttcactaaaaactgccagcaaaactggatttgtacagacttaaaagatgcttggaaaaacatacacaaaactctaaacaaggaaagcttactaaaggcataaccaatggacattaatcaagaagaaacaggcgatttacttcttcaggttgaagcaaataaagaaaaaaaaaaaccmcaaaatgcatagagtatcactgactcccctgcctacaaaagagaaagcataagtagaatacactgtttgaaagataaagtcaatcaaaattttggagcaatattaaatgaaagcccactagtaatagtaacagaagaactaacataaatttgtacaaattcctaatttgaacttcatttcatctcattttccaaatctgctaaccctctgctccctctctatcgagctcttccacccagaacccagaaatctctacatacaaacactgtttagctaaatgtggtaatgtggaattataca

SEQ ID NO: 70219 - DNA, 601 bp, Human
gagatgaggtctcactatgttgcccaagctggtcttgaactcctgaattcaactgatcttcctgctttggcctcccaaagtcctaggattacaggcatgagccatcatgactggcaatgaatatttaaaatgtgtattctcattgaattttttacgaaacaattatgtaagttatgctcacaaagatggtcactgaagcatggtttgcaatttccactaataaacaataaccaaaatatctactggtaggtcaatgattaaataaatcataacagagccacattaaaggagagggaaacascatgatctttcatgtcaaagacctaggtttaagacttagttatgctttttaatagctgcactaagtttctatttcttctgtacatttagaataatatcttttagaatcattgtagggattaatagaggtaacacatgaagcctgattaacagtagccaacaatatagtaagcactcaataaacattatcagcaaataaacgtatgcaactattaaaaaggatagtctgctcctgggtaatacaggacccactagctactgagcacttaaaatgtggtcagtgcaaccgaggaactgaatt

SEQ ID NO: 70220 - DNA, 601 bp, Human
tcaaaaataaagaaaataaaataaaaagaaagatggtcccttaaaaagaagtaacctggatactaatttgaataggaggaaagagaaaggaattaacatttaccaggtacctaccacaggtcagaaacagtgctaaacacatacacacattatcactgaattttcacaaggaccctgtgaagctggtactatttccattttaaggttgaggagacctaggtccaaaaagacgatgatactttctcaaagtcacatcactaataaagaacatccctggggtacaaacacaaaagcacgtgttcaagggcttgcatcttttttacaatatatgtaaaaaaccatgtgcttttagtataaagtatatttaccattaaacaccaaagaatacttccaaatagtggtacaacaggtcacttattttatttctgagttggattcatgaaaggtatagactattcctaacatcagagtgaatttccagagtggtgtcaaaaataattttgtatggaatgaaaagtgaatagatccattactttatctgaagcaaaacactttattaaatatgagtcattctgcttatttagctacaatccaatctact

SEQ ID NO: 70221 - DNA, 601 bp, Human
gcacagatgaagttgacatctgatctttcatgtcctaatgagaaagaagatacgaaaacaaatgaaaaatatccttaaacaaaatcacagttaacatttcatacattagcaaaacacacaatttattattactttttaaaaagaagaccgcatttcttggctttattttcagtctcaaaaataaagaaaataaaataaaaagaaagatggtcccttaaaaagaagtaacctggatactaatttgaataggaggaaagagaaaggaattaacatttaccaggtacctaccacaggtcagaaacagtgctaaacacatacacacattatcactgaattttcacaaggaccctgtgaagctggtactatttccattttaaggttgaggagacctaggtccaaaaagacgatgatactttctcaaagtcacatcactaataaagaacatccctggggtacaaacacaaaagcacgtgttcaagggcttgcatcttttttacaatatatgtaaaaaaccatgtgcttttagtataaagtatatttaccattaaacaccaaagaatacttccaaatagtggtacaacaggtcacttattttatttct

SEQ ID NO: 70222 - DNA, 601 bp, Human
tctttacatcaaatgtcaatccttagatgtctaatgtgttccatgggtaggcaatgtagtaactgctagagagctcaaaacaaacaaacaaacaagaaacaaaaaaccatgacacacatctctcctcactgtcaaagggcctggagcccagcagagagaaagacagtaattatagcccttcaaagagcctggcacacaaaatgtgttcaataggtacagaataaacacattaaaaaagtaaaagtactctgtgataagtgctatagtaagggtaggcaaaaggtgctatggagcccagagragaagaccagagggtaagaggaggggagggaaatgttgacagggtgctgggacaggctgcctggactgtcacaaaacctcccatggtcacaccagggcctgcaagcagaagtcttcctcttgattacatgatccatggatggtcagcatttttaaattccaaatatctaactgtatgctttctgtcattgataattatattctgatgttttctcacctgtctattttttctttcagctaatgcctgcacagatgaagttgacatctgatctttcatgtcctaatgagaaagaagatacga

SEQ ID NO: 70223 - DNA, 601 bp, Human
gatgatcattctacattttttaaaaggactgtattttaacaattagaaaggagcttctatcaatatgccaaagtatgtaattcttttaaaactacttaaaacaaagagaaacttaatttaacacacaagtttaaggttcctctaatgtctttacatcaaatgtcaatccttagatgtctaatgtgttccatgggtaggcaatgtagtaactgctagagagctcaaaacaaacaaacaaacaagaaacaaaaaaccatgacacacatctctcctcactgtcaaagggcctggagcccagcaragagaaagacagtaattatagcccttcaaagagcctggcacacaaaatgtgttcaataggtacagaataaacacattaaaaaagtaaaagtactctgtgataagtgctatagtaagggtaggcaaaaggtgctatggagcccagaggagaagaccagagggtaagaggaggggagggaaatgttgacagggtgctgggacaggctgcctggactgtcacaaaacctcccatggtcacaccagggcctgcaagcagaagtcttcctcttgattacatgatccatggatggtcagcattttt

SEQ ID NO: 70224 - DNA, 601 bp, Human
gtctgatcccaaatgtttgtgataataggatagagattgagagagggcccaaggactggaagatgcacctgtgtgtgggtgccagagcaggggtgctggtgaggcaaggagcagcacagagcctggcacctggcacaacgtggcaaggcccatgcctgctggagtgcttagagagccctgatcctgctattccttgaaaatttgcaacttgacatttcactcatagcctaaaacaaaattccaagccataactagataggcaatatataaatacatacatgtatatatactttatataaatatatatttaaatttatatatttatatatatttataaatatataaatataaattttatttacattagcccaactatactatctagagaataaaacattcaaattaagagtaacagcataggtgttactgacctcactgtcacaactacttcagttacttccacttcctataagctcaagtgcaaataagaagagaactccaaaactagccaacttgagggcattcactagcttctttcaagagagggagccagatggaatggaccagctagtggcttttcctagctatattgctcaaaaag

SEQ ID NO: 70225 - DNA, 601 bp, Human
gtggtactatttaaggaattccaggaagggccctctatgtctttaagctctcccaataggcctcacaatgggctttgtccccttaaagtgcaaataaacgtctgctaaatcaacaaacacccatctatatactgtgttataattgaaaagcattcaatctcttgtaaaagagctcttcctggtacctgtggaacttcagcaacccataggttccagtcaacctgattccgaagatctagagtacttttttaaaaaaagtgtgacccaggggaagttgtgggtttttttggtggggggaaaagggagagttccctggaatgacaagaaggtaagccatagcccttcacacacaaaggcacaagaaccatcaatgtctgttaagtttaacccatgaatagaatccagggtccttcaggctttccagatgacaactgggggttactttacaggcaggtatgaccacaaggaatgcctgaccctggcaaccgaggcaagggctgccctaaagtcagagttctccaccagggctcccagacacaagggtcgggtttcccaagtatgaattcaaggaagtttgcagccataaatgggtatgtcttcc

SEQ ID NO: 70226 - DNA, 601 bp, Human
gttaagctactgatatctcctgctgatccaacttgtgaacagtcagcggggcttgaaaccaccaagagagatttactctggttggctgacgtccaataatggagcagacaatggttgaaagcacacgtgcagatgaccattgagacatggggatgtttgggaggaggaagcccattgccaagatcaaggtctcaatccacaacagactgccacagcttaaatacaagagagtctggcaaatctctggatgtggggaaactatgcagtctttcctctctcttcaaggacaaacgaaaggatkccctgtggcaataagttacctcaaggacaactactgactgacaaatatttacttttagttgtgttgcattcttctcactttctatagaaaaaaaatttcctgggtttaatagcaatttaagtagacaactggttaagcagacatactaatgtaaagaacaaaagaacatataaactacatgtatacataaaacacaatatttaagaatcaatagtttcaatgggtacatgctcctcaaatccccagacacattatcattagcttgcttttattaatacagctacatatcaaaggcatcaa

SEQ ID NO: 70227 - DNA, 601 bp, Human
ggcccggtgtagaacacgggcccactaagaattcataatcaatcaatgtgtcatgataaacgtaatatcgagacaggaaagtttctgaaatatcctggtggactgttttttcatttttctctttcaaaagatttacaaaatgatgtggcagcatttaagaatgcagtttttgccatcgaacttctgggtgcaaaagggattgttcataaggaaaaacaaactgaggttatgttttgtttttatttatttttctgagaggaaagagtttttgttaactggcgttaaatttgtaagttttttwaaaaaaaaaaaacaaagttacaataatttaagattcaaagcaaaacgtatctgttcaatatagcaggagagtcatgggatgataaagtcagctcatgtcctatcctctctggaacaaaaattcccacaggttacagaggcttctctgtttcatattcccattcataactatacttcgagtatctgctcagagaaatctgtgtctgtttttggaggtgtttaaaaataataacaacttcacctaaagcctgtagtaaaatttacgaagtagaattgcttcttttggggaggctaatctgta

SEQ ID NO: 70228 - DNA, 601 bp, Human
acttttgcaagtttcttcatcacgttgtccagccgggactgagtgctctccaattcgtgagagaaatcttccaacatactagagagaagcagacacagaaggtcgctggtaagcacaaagccttggcagtgcacttgcactgggttaaaaggaccaggcctccattttagcaaacaaaataggcaacactgggtttcaggacctcactctgttatccaaaatccttgggacaagataggattttgattttggaattctcgggattaaaaaaagcctaaattacatatcctttgtattagtygacaccactaggaggacaccaccaggagggtctggggcagtccccgtaatcagatacttaatatttctgcagagaaaactatgaggaatcacagttggagtcagttcaggtaaggtttttctgtaacatgagcttgcggcaaatttaaagaaaaaaaaacaacgagatttctttagagcttcctagatttcagaactgcaagactatagacctgtctatacaataacacaaactcagtggcagtgcaatgtggtagaaacaatgctatctgaggcagacaaccaggctttgccacttgtt

SEQ ID NO: 70229 - DNA, 601 bp, Human
gcacctgtaatcccagctactcaggaggtcaaggcatgagaatcgcttgaacccaggaggcagtggaggttgcagttagctgagatggcaccactgcactccagcctgggtgaaagagtgagactctgtctcaaaaaaaagagaaagggatctgtaaaaaataagaaagggatctggatgggcataactatgagacaacacccccaagacagagttctagaattaagtacaaatgcttaagctttaaacgccatacataccactggtcatatgagatacttttgcaagtttcttcatcacrttgtccagccgggactgagtgctctccaattcgtgagagaaatcttccaacatactagagagaagcagacacagaaggtcgctggtaagcacaaagccttggcagtgcacttgcactgggttaaaaggaccaggcctccattttagcaaacaaaataggcaacactgggtttcaggacctcactctgttatccaaaatccttgggacaagataggattttgattttggaattctcgggattaaaaaaagcctaaattacatatcctttgtattagttgacaccactaggaggacaccacc

SEQ ID NO: 70230 - DNA, 601 bp, Human
tccacacatgccatcttattctgaagtagtaggtatttttctatcaatgaaagaatgttcaggagaaacagtaactggcttaactgttgttttacataagttccctattttggcaaggaaatcttaaaaaaccagtaaaataaagaaggattttgtaactgcaaagaaagttattctactgggctgggcgcggtggctcacgcctgtaatcccagcactttgggaggccgaggcgggcagatcacgaggtcaggagatcgagaccatcctggctaacacggtgaaactccatctctactamaaatacaaaaaattagctgggcatggtggcgggcgcctgtagtcccagctacttgggaggctgaggcaggagaatggcgtgaacctgggaggtagagcttgcagtgagccgagattacgccactgcactccagcctgggcaacagagtgaggctccatctcaaaaaaaaaaaaaaaaaaaaaaaaaaacacaacgaaagtgactctactgggaaaaaaaccaaacacggtgggggatcacaaagccttaacttttcccaagttaaagctacaaggagaagataaagactgcacatacaag

SEQ ID NO: 70231 - DNA, 601 bp, Human
ggtaggactcaacatatttttacagataagaaactgagccccagagaactgttatgtaacctatgagttaaacttctgaaaagtaaacctgcatatgtatttaaatattgcttcaaaaagctaacctattagaccttataacatgtacctgacagtaggaaaccaacagaagaaaaggtgtcaagaaacagggcatgttctaacacaagggaggtgctctacagtcagggaacattcagattacctcaaggagcatctcagtttctccttccaccaagcaacccccaccagataaagaagagatactggattttttaaaatttaaaatatattatttcccatgtaaagagtcactggaacatatcttatacagtaactattatgaaaattgtttattcatcctcatcctggtgcaaatttgctgaaatatttcagtattgatttaaacataacaatttaaaatagatccacacatgccatcttattctgaagtagtaggtatttttctatcaatgaaagaatgttcaggagaaacagtaactggcttaactgttgttttacataagttccctattttggcaaggaaatcttaaaaaaccag

SEQ ID NO: 70232 - DNA, 601 bp, Human
agttaagcacttctactttactggtatttcatttaatcctcacaattacctggagaggtaggactcaacatatttttacagataagaaactgagccccagagaactgttatgtaacctatgagttaaacttctgaaaagtaaacctgcatatgtatttaaatattgcttcaaaaagctaacctattagaccttataacatgtacctgacagtaggaaaccaacagaagaaaaggtgtcaagaaacagggcatgttctaacacaagggaggtgctctacagtcagggaacattcagattacmtcaaggagcatctcagtttctccttccaccaagcaacccccaccagataaagaagagatactggattttttaaaatttaaaatatattatttcccatgtaaagagtcactggaacatatcttatacagtaactattatgaaaattgtttattcatcctcatcctggtgcaaatttgctgaaatatttcagtattgatttaaacataacaatttaaaatagatccacacatgccatcttattctgaagtagtaggtatttttctatcaatgaaagaatgttcaggagaaacagtaactggc

SEQ ID NO: 70233 - DNA, 601 bp, Human
ctggtgcctgcttcccatatatgcacagtttcaggcaatgaagagcccgctagaaacaaagatacttgtccctaaagagaaagaagaaaatgactctagataggagcttctctttgttttggatgtaataggtccattgcgccttggggccattacaatttttgttgccttacaatttcttaaaaacatttactaagtaccaataaataaatggtaaacgcagttaagcacttctactttactggtatttcatttaatcctcacaattacctggagaggtaggactcaacatatttttacrgataagaaactgagccccagagaactgttatgtaacctatgagttaaacttctgaaaagtaaacctgcatatgtatttaaatattgcttcaaaaagctaacctattagaccttataacatgtacctgacagtaggaaaccaacagaagaaaaggtgtcaagaaacagggcatgttctaacacaagggaggtgctctacagtcagggaacattcagattacctcaaggagcatctcagtttctccttccaccaagcaacccccaccagataaagaagagatactggattttttaaaattta

SEQ ID NO: 70234 - DNA, 601 bp, Human
gctggtgcctgcttcccatatatgcacagtttcaggcaatgaagagcccgctagaaacaaagatacttgtccctaaagagaaagaagaaaatgactctagataggagcttctctttgttttggatgtaataggtccattgcgccttggggccattacaatttttgttgccttacaatttcttaaaaacatttactaagtaccaataaataaatggtaaacgcagttaagcacttctactttactggtatttcatttaatcctcacaattacctggagaggtaggactcaacatatttttayagataagaaactgagccccagagaactgttatgtaacctatgagttaaacttctgaaaagtaaacctgcatatgtatttaaatattgcttcaaaaagctaacctattagaccttataacatgtacctgacagtaggaaaccaacagaagaaaaggtgtcaagaaacagggcatgttctaacacaagggaggtgctctacagtcagggaacattcagattacctcaaggagcatctcagtttctccttccaccaagcaacccccaccagataaagaagagatactggattttttaaaattt

SEQ ID NO: 70235 - DNA, 601 bp, Human
atggaggagagcagagacgaatacaaattgcttgtttgtcaaattgaagcagaaagcaccaagcaggaagaggtccttagggagtatttctttgggtagcaagcaaagattaaaatgaaaacacaagcaacctgtcaaaagtgaagcaccgttcaggataaatgctctgtttcctggctctttttcctatacaaatataaccaaagttattacattgcttccccaatttttcttttgggaaaaagtagaataaagcataagcaaacttcagtgctatttatacacactgggtcgcttctcrcaatgcaagtacttttctaaattattcatacccagaatgctgggaaacaaagacagtgcatctttgttcacttgctcttccccaaacagaactggtgctgaagtagctacttgactttgcaactactacatacatgagtgagaggcctggagtttaaactggttatacaattcttcattaaaacaccttttttttgtttattgttttgtttttaagtagaggggagaaggcagaagagagaacagagggaatcagaaaagactttgcaaacctttctctaaatgtgtgacagatgaacta

SEQ ID NO: 70236 - DNA, 601 bp, Human
agtggctaagctgcctctacgaagcatgaactaggtaaccccagggagctgttaccccagcagacttctcagcacttcccgcagaggcttcatgcatagaaggaacgggtactaaccacaggggctcttgtgacctcaagtggaaagttttaagcagcattgcaagctcaggacctgcctcaaaaagtcagaggggaacaaaagaactccaatggtagttttttctctctctcaaaatatttttctcccctaaagagaaaagattaatggaatgttggaaagtaagagggaaaaaaatctyagtatctacttaaaataaaatacttctgtgggtaggagaatacaattagtgtctctcttgggtcattcaaaaaagtaaatgtggagtcttggttggtttctccccatgaagcagacagccacggggagcggagatggtccgcctgtgtgcctgtaactacttaatcacacttcgctgtgcctccataggcttcctttatgtacaggtttgattactaaagcagtgaacttctgcaaaaattatggaggagagcagagacgaatacaaattgcttgtttgtcaaattgaagcagaaagcac

SEQ ID NO: 70237 - DNA, 601 bp, Human
aacggagaaagtattccttctccaaccccgccctcaacctcacacactcctatgtttacccccttccctcaggcatctcgctattctcagcaccagatttccaacactgaaccagatttccattttttggctttccatcagcctctactcatgcctcctaccaccctccaatcaccttctcttccacaactgtattaagtaggaattttcaccaaggagaagcatataccacacaagccagcacaacccgaggatgttcttttaaagccgttttcctctgaagtggctaagctgcctctaygaagcatgaactaggtaaccccagggagctgttaccccagcagacttctcagcacttcccgcagaggcttcatgcatagaaggaacgggtactaaccacaggggctcttgtgacctcaagtggaaagttttaagcagcattgcaagctcaggacctgcctcaaaaagtcagaggggaacaaaagaactccaatggtagttttttctctctctcaaaatatttttctcccctaaagagaaaagattaatggaatgttggaaagtaagagggaaaaaaatctcagtatctacttaaaataaa

SEQ ID NO: 70238 - DNA, 601 bp, Human
tgctaagtgagagaagccaatctgaaaaggatctgtgatatatgattccaaccatatgcaagctggaaaagcaaaactatggagacagtcaaaggatcagtagtttgggggttgggggaagggagggataaacaggtggaacacaggattttttagggcagtgaaacagctctgtgtgatgctacaatgatggatacatgtcatttatacatttgttcaaacccagagaatgtacaataccaagagtgaatcctaaggtaaacaacggtctttgcggatgattaatgatgtgttagcgtargctgattgtaacaaacgtaccaccgtgatgcttgatgtcaatagtcagggaagttatgcatgggggaagggggctatatgggaactctctgtacttcctgctcaattttgctaggaacctaaaactgttctaaaaatagtttattaattttttaaaaagattaaaatgcttacaataatttaaaaccactttgctaaaatgattagttgcgattctttcaggacaaaaacggagaaagtattccttctccaaccccgccctcaacctcacacactcctatgtttacccccttccctcagg

SEQ ID NO: 70239 - DNA, 601 bp, Human
gtcagactctgtctcaaaaaaaaaaaaaaaaacaccatgaaagagctgccagggaagcatacgaaaagatgttcaacattagatgtcactggggaaaggcaaattaaaacaagaaacaatacacacctattagaatggtcaaaaccccaaacagtgacaacaccatatgctagcaaggatgtggagcaatattaactcctagtgggaattcaaactggtacagccactttggtagacaggttggcagtttcttacaaaacccaaacatactcttaccataaccattcagcaaccacatacmttgttacttatccaaatgaacttaaaaacttatgtccatataaaaacctgcactttttttttttttttttttttttttttttgagacagagtctccctctgtcacccaggctagagtgcagtggtgtgatctcggctcactgcaacctctgccgcctgggttcaagcgattctcctgcctcagcctcccaagtagctggggttataggcgcacgccaccacgcctggctaatttgcacatgggtgtttataacagctttattcatcattgccaaaacttggaagcaaccaaggcgtcctt

SEQ ID NO: 70240 - DNA, 601 bp, Human
aaatgtaaaatgcaaaattatcaaactcctggaagaaaacacaggagaaaacctagatgaccttgggtatggcaatgactttttagatgcaacaccaaagacactatatatccatgaaataaataattgaaattgggatgtcattaaaattaaaaacttatgctctgtgaagtcactgtcaaaagaatgagaagacaagccacagattggggtagaatatttgcaaaagattcatctgataaaggactgttgtccagaatgtattatacaaagaatttttaaaactcaccagtatgaaaatagcttgattttaaaaatgggcaaaagacctgaacagacacctcatcaaaaaagagatggggctgggcaaggtggctcacacctgtaatctcagcactttgagaagccatggcaggcagatcacttgaggctaggagttcaagaccagcctggccaacatggtgaaaccctgtctctactaaaaatacaaaaattagctgggggtggtggcgcaggcctgtaatcccagctacttgaaaggctgaagcacaagaaccacttgagcctggaaggcaaaagttgcagtgagctgagatcgcac

SEQ ID NO: 70241 - DNA, 601 bp, Human
actacacaaatgaagaatgcccctaatgggctcattagtaggctaaacacagctaaggaaaggatctctgagcttcacaatttgtcaacagaaacctgaaaaaagaaaaaaagactgaaaaaaaacctggcacagaatattccagaaatgtggaacaactataagacttaccataacatcaatcaagataatgtagtattaggaaaatagacaagcagatcaatggaacagacagtccagaaataggctgacataaatacagtcaactgatctttcacaaaggagcaagtgcaatacaacrgagcaaagagagtcttttcaacaaatggtgctgaaacaactggacatccatgccaaaaaaatgaagttggaggcagactttacaccttaacaaaaattaactcaaaatgtatccacagacctaaatgtaaaatgcaaaattatcaaactcctggaagaaaacacaggagaaaacctagatgaccttgggtatggcaatgactttttagatgcaacaccaaagacactatatatccatgaaataaataattgaaattgggatgtcattaaaattaaaaacttatgctctgtgaagtcactg

SEQ ID NO: 70242 - DNA, 601 bp, Human
caagaacacatggataatgtaggcagagacatggaaattctagaatgaaaaaaatagagatcaaaaagactacacaaatgaagaatgcccctaatgggctcattagtaggctaaacacagctaaggaaaggatctctgagcttcacaatttgtcaacagaaacctgaaaaaagaaaaaaagactgaaaaaaaacctggcacagaatattccagaaatgtggaacaactataagacttaccataacatcaatcaagataatgtagtattaggaaaatagacaagcagatcaatggaacagayagtccagaaataggctgacataaatacagtcaactgatctttcacaaaggagcaagtgcaatacaacggagcaaagagagtcttttcaacaaatggtgctgaaacaactggacatccatgccaaaaaaatgaagttggaggcagactttacaccttaacaaaaattaactcaaaatgtatccacagacctaaatgtaaaatgcaaaattatcaaactcctggaagaaaacacaggagaaaacctagatgaccttgggtatggcaatgactttttagatgcaacaccaaagacactatata

SEQ ID NO: 70243 - DNA, 601 bp, Human
gaagcttagaagtcatcactctgtcgtaacaagtaaaaagctgaacaaactgaaaaagcaaaactcttcttagatccatcagagaagtgaggtcacatggtaaactgctgcccctaaaactgcagaaacctacagatgcatacagagaatcacagcttatcagagcagaaacccacgaagcaacaaactccataggaaccagtgttctggtaggaaaaccttagctttaattgatgagtcgctgaaggctcagtgtggacaagtctgagatgaaaaacaaacaaacaaaaacactccaggkggacccaggcgaaggggacccccacacttctgtgggttttacctccaggagcttgaccaggttctcagcgaatattgggaaaaatcccctcatgcttccagcaggcggaggggaaaaagaatcactacgaaatactccagagcactctgttctaaacaaagtctgccctcaaaagaaactaaccagagtctgactaacctgggggaaggaaaatacccaactccagtcttctctagccatccagttccacctaacagtagaaaaactgggaagcactagtgaagttcacgggccaggggc

SEQ ID NO: 70244 - DNA, 601 bp, Human
acacacccttcaacactgctggttcctctgaagccattcctcacaagaatctctgttcatatgtcagttttgttgtcacaaagatgtatgttttacagagcactttaattcatttttgaagaagtaatatgagaaaatgtggttcccatatgtcctcgcacatgatatgtcagccttgcatgatggcagccttctctgtctgtcccctgaaggcagctgctgtatgggggaaatggggaatactcagggcagccttcagaacacttgggttattcatcacttgagaattttgcattctgtrtatatataaggtgtaactaagcaacaagataaacaatgcctcacacctcagccctgtgcctaaggacatctggctgtgcaatccatgtaagataatgggtattgatagaagtcacatcatgggaaggaagagaaaacacatggcccttaaggaaacttaaaggatacaaggcacagacttcattcccagtgagggggaggagtgataatgtagctttggggtctgtttcttctgtgaacctagtgttctggagcaaaaggggctcatcactcaatgcgctagaagccaatactatgacac

SEQ ID NO: 70245 - DNA, 601 bp, Human
aatactcagggcagccttcagaacacttgggttattcatcacttgagaattttgcattctgtgtatatataaggtgtaactaagcaacaagataaacaatgcctcacacctcagccctgtgcctaaggacatctggctgtgcaatccatgtaagataatgggtattgatagaagtcacatcatgggaaggaagagaaaacacatggcccttaaggaaacttaaaggatacaaggcacagacttcattcccagtgagggggaggagtgataatgtagctttggggtctgtttcttctgtgawcctagtgttctggagcaaaaggggctcatcactcaatgcgctagaagccaatactatgacactggattttgagaaaaagaaaggttttattgcaaatcgacttgcagggagacaggagggtcaagctcaaatctgtctttttgttctggctttttgaagtagtagttttattagaaaaagttgtggcaggggtgggttctaaaggggagggctggaaagtccttggacgtgggcagttatctccgcattctatctcaggggtcacgtgtggaaattcaaggggagttagtatgaaacatg

SEQ ID NO: 70246 - DNA, 601 bp, Human
cacttgagaattttgcattctgtgtatatataaggtgtaactaagcaacaagataaacaatgcctcacacctcagccctgtgcctaaggacatctggctgtgcaatccatgtaagataatgggtattgatagaagtcacatcatgggaaggaagagaaaacacatggcccttaaggaaacttaaaggatacaaggcacagacttcattcccagtgagggggaggagtgataatgtagctttggggtctgtttcttctgtgaacctagtgttctggagcaaaaggggctcatcactcaatgygctagaagccaatactatgacactggattttgagaaaaagaaaggttttattgcaaatcgacttgcagggagacaggagggtcaagctcaaatctgtctttttgttctggctttttgaagtagtagttttattagaaaaagttgtggcaggggtgggttctaaaggggagggctggaaagtccttggacgtgggcagttatctccgcattctatctcaggggtcacgtgtggaaattcaaggggagttagtatgaaacatgtggtagaaattcaggctgtgacattagcaagctcattct

SEQ ID NO: 70247 - DNA, 601 bp, Human
cattctgtacagattccagtcggccatatcggttccagtcgatttcagccagttctcttatcttataagcagagggagtttcagtgtttcagcaagttatttccttctttatctgccatcctgcaaactcaatttctgttcatcattggtttctgtaactctttggaacatggtttcactggttcctccaccctgctgactcaatagacagaatgagatgggtgggggaggctggaaacgaattacttgtctccccgtgggggaaatgggggatatcaaagatactggacagaatagagcmagatgtctgttactgctctggaacaagcgtgtcctatccatcctgctggggaggagaaattgtttgccccaaacagatcactacagcaagcatgtttttgagtaactttgtcatacgctctgggcaatgagagggaataacacacagttttgttctcaaatgagacacacacacttaaggagagaacaaagagcagttttcctggcatgacacaattatggtcaagtaggagacaattttgtgggtacagctagtttccaaagagggagaattattcaatcaaagcactataatctctgt

SEQ ID NO: 70248 - DNA, 601 bp, Human
cttccaaggaatggtagaaacaaatccacaagaaaaaattgaataaatttttttggtatttctgctctacagttttagatcatgatgatgccctacaaacaaatcctactttggaaataaatagcagtgaaaatatctcttctcccatcttttggtatgaaaagtatcattctctgttgcagtcatttaaaatatttaataattgtatatcttttactgtttctttctttcacttgcactgtttaacttcacaaatatttagtgagcaaataccaggttctgagccatgaaaatatgatgkatagcaagttagaaacacagctcccttccccttagagcttacagtctagggtagaatttggatgaataaacaatcgcaatggagccttaggatactaacaggaaaacaaagacataggcaggcccaccaggaggagcgcatagcccacatgcagtgttgggaaggccccttcgggaagtgttatttcctctgataccattatgtatttgctcatgcacaatgtatgagtgagtgctatccaggctcaacgaaggggtaggaagaaaaggaagcactaagactaagtaacccacagaaaga

SEQ ID NO: 70249 - DNA, 601 bp, Human
tttccttggcaggttccggagtctcaccactgcatttttcagagacgccatgggcttcttattaatgtttgacctcaccagtcaacagagcttcttaaatgtcagaaactggatgagtaagtgggactgagtaatgtgcattggccgctttgggactcaactgctttaggtgcttgttggtcttgcaagatgaaaccagattgggtaccacagattaactttcaaagtcatgagtttagtgttgcctgtgccactgtgtcaccttcaaagtggtggcctttatgtggaccaccctaggtascttggaatagtattttctaaatatctaaaaattgatatttttagaggaagcctatgtagctttatcaccacttgtatttaagatctttattattgtcattgaaaggccattgattccacttttccagtaagtcttgaaggacttcttaaaactaagtgagctactacatttgacctggagagatcacagggaaaatcggcagtattttctgaggggacactggcactgaaggtgtgttaaacactagtgggttaattaggtgtgaaaccagagcagaccagtcgcatgatgataaggtga

SEQ ID NO: 70250 - DNA, 601 bp, Human
tgagaaatactcccccaggatccagttgcctcccactaggccccacctcccacattggggattacatttcaacgttggacatagatccaaaccatatcacttctacacccacttcaagttttacccaaaccttatttgtctcttgactgaccaccccatctgaaatagtactcatcactttgtatcccctcaacacgctttagagttcattcagtcccagccatcacctgacatgatgtgatgtatttttggtttacttgtgtttttgatgctttctaccactagaatgtaagctcttatragagtgcagacttttccattttatttcaatgcaatatgccatacctgggtgagtgcctggcacagagtagatgctcaaaatagatatatttcttatcactacatattatacaaaattgataatgtattttgtatataattcatgattatatataataattatatagaaccactctcggtgtgggttcaataaccttgtaactaatggggaaacaaattctgactttcataattgcttctccaaatgaacgtttatcttaggatctgtcctttatttccatttaatattgtatttcattac

SEQ ID NO: 70251 - DNA, 601 bp, Human
gaaaggataatcagactttcagttatattaatatttttaacatttttgtgcacatagctatcttcaataaaattgttttaaaaggtattattttaagatacactaaaatgatcaagggattcaagactaaacaactcaattagttgcaccaataaaaaacacttaaaaaaactgtcagtgtccaacctgtacttaataactcacagatttttaaaacttttcttttcaggagaattttggttgggcctagagaagatatactccatagtgaagcaatctaattatgttttacgaattgagytggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaa

SEQ ID NO: 70252 - DNA, 601 bp, Human
agacttgagcgttgctaggagattcggcaggcgggcggagccagactcggcggggcggggaggggtggggctaggctcggcgaggcgaggaagggtgggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctycttctgcgcggctgcagctcgggacttcggcctgacccagcccccatggcttcagaagaggtaagtggtccggccccatattccttatgccccccggctggagctgcagcgccagcctcccgccctaccgccgtttccgtgggctgagccgccctgcggccacccggtcccgcgccagtcagtgcgccgccttcccgggggacacctcactcgccccttgctgcgccgtcggctccccagcgcttccactcgacctcgcaccccactcgcctgctgggctcgagcgggggtgtgcggcga

SEQ ID NO: 70253 - DNA, 601 bp, Human
ctgcagctcgggacttcggcctgacccagcccccatggcttcagaagaggtaagtggtccggccccatattccttatgccccccggctggagctgcagcgccagcctcccgccctaccgccgtttccgtgggctgagccgccctgcggccacccggtcccgcgccagtcagtgcgccgccttcccgggggacacctcactcgccccttgctgcgccgtcggctccccagcgcttccactcgacctcgcaccccactcgcctgctgggctcgagcgggggtgtgcggcgattatccgtgcargcggtgcggggagtgggtctgggagagcggccctttgcgcgtgttcctcaggccctttctgccctggtttcccagccagtggacaggaagcttcattcaagcaaagctgggtgcaaacatgagtgtcgttcttggtagagggcggttggaaggtgagttctcagtgctagcacttgaattctcctagtcaggttttctctacacacgaggagctgtgttactctgggcaagttgtttagcttctctgtgtcgcagtagcatccatttcatagggttgttaaaaaatatgatttctaggtg

SEQ ID NO: 70254 - DNA, 601 bp, Human
tttgtttttgttttttaaactcaaaatcttttctttaaatgaagaaaaactatgaggtttgtgtgttccagtattaatctgggtatcttgtgacaagtcttttaaggtaggtcttgggtactatgtgcccctaggagataacttcacagtcttgcaggtggatagctcagtgttagtcctcttgaaagtagagatcgttctcagtttaggcacttagaaatatacatttgagggcacttgatttttgttttgtttgagataaaattcaagtttttaaccattttaaagtgtacaattcagktatttgttttttgtttaaatatattcacagtgtagtgcagccatcaccactgtctagtttcaggacattttcatcactccagaaagaaaccatgtagtgtgttttaaacaattgcttcccattcctccctcagcccctgacaactactcatcttgtactttctgtgaatttgcctattgtaggcatttcatataaatggagtcacgctgtatgtggccttttgttttttggctccttcaacttagcactaacattttcaagttcatccatggtgtagcgtgtatcagtacacatgctctt

SEQ ID NO: 70255 - DNA, 601 bp, Human
aaagtttctccacatcattatcaacatttgttattttctggggtgttttatttttctttttcggtttatgataccatcctactgggtgtgaagtggcatcttgggaatttgatatgcgtttacccaatgatgaagatgttgagcatctttaatgttcttggtgtccatttctgtgtctttggagaaatgtgtgttgaattcctttgcccatttttgaggcacattggtgttaatgcctcctagtgaaaaattaggaaataggaagataaagcttgaatgccttatgggtagggataaaagrgaaataaaatttttatatacgtaaaacaaacacatgccaagaaggcaaggaaaattacatgataaattagataggaaactaggacatcttaaagtatttgtgcagaaaaagcatcaaaggaatcacctttgttggtttcaagtctgccaataacagaactgaggaactgtctcagttttaagttttttcagtggatacttcataataaaaagagtactttagagtcaaaactggcaataaagagggcttgggaattcagccattgggggaatcccttgcctaattcgaagtacctttctc

SEQ ID NO: 70256 - DNA, 601 bp, Human
cttgttgcccgggctggagtgcaatggcgcgatctcgggtcactgcaacctttgcctcccgggttcaagcgattcttctgcctcagcttcccgagtagctgggattacaggcacgtgccaccacacccggcaaatttttgaattttaagtagagacgggctttcgccgtgttggtcatgttggtctcgaacccctaacctcaagtgatccacccgctttggcctcccaaagtactgggattacaggtgtgagccactgcacctggccagagttgaactttttataccatgtcatctgttayagataggcaaaactagggcatctgagttaaatgagataacaaaagacttgtagtaaaagaaaagaattagttctgttattgcattttataagactattaagaaacaggctttcaaactctgttgtgcgtctgatattctgagttataaagcactaaaagacttttttaaattgagcttttgatatcaagctgtgacacaagatttttttggtcaagttggtagtgtcaagccagagtgtaaagttattgtaagaaaagtgaaacagctgtttggaaagatcttgtgtatttgcagtatgt

SEQ ID NO: 70257 - DNA, 601 bp, Human
gaacagggagaattagagagatttgagtgtgaagggtgagtcgtacattcagcaagtcaaaaaggaggggaacagcatgagcagagaatgtgaatagagagttggaaggcatgatctattttgaatattgttaatagtgaaaagcatgtgtatgtcgtgcttaagagatgtactatatagtaatataggaaattgcaccgtgtactcagttgagtataggaaactggtctgaaggtgttgaggattatggtattttaaccaggaacatagatttgtgttgagggagaaacttgtcaatccrgaggatggactgactgaatgggaagaaactattaataaatgaagttctctggaccccactagggcattttttcatcaacactgtttctttttaattttcgagggtacatagtaggtgtatatatttatggggtacatgagatgtttgatataggcatgcaatgtgaaaaacgtcatggaggatggggcatgtttctattctataggactaagtgagcaatagtcagggatatgtatgtatatattcttgataaacagaagatgcttttttgtgaagttttttattttctacaaatgtgat

SEQ ID NO: 70258 - DNA, 601 bp, Human
ttacaggtgatactcaaatatagttggattcgctgtcttactgcacccttctgcatccgctagtcccataggtagagtaccaaaagatccctagtattgatcattgtttaaaagacctgtacattgcccttctttctcactttcaaatgcctcaccttgccccatactgccttatacgacttggtttcttgcctatccccgacccctcttattatattactgtctttttcagtcactaaaatccagccactcctcctgctcctcaaacacaccaagatgatcccatcttggagccattctrcatgctctgccaactgccttctcctgaccttaggcttcggctcagatttgcctcagagaggccttcctaatgaagttcctgcccccaccccccattaacacccgctttgtcttgatagcactttccaggatatcagggtattcaagttttacttatttatggtcttttcacaccatgaatgttcagattttggcctattcatacaagtattactggcacccaaaataagtctatacatactagggacttgatcaattgaatagataattgttttataaatattcatgcttatctccatgt

SEQ ID NO: 70259 - DNA, 601 bp, Human
cggatggcaaagtcaatggatcccacgaagccaatatgttaagtaagttactcgctctcctacaaaacccgtcctaggcggccgcggaagattcgggagggacagcaggtattcgccgggacacaggctcaccttcctgagcccaggccactgggaccaagctgatactcagaaacagccgggcgggttgggtggagatgcatctatatggcgtgcgcacacgcacccctctcctgggcatgaggaattgcgatttctcaggtgtatgttacctagaggctggtgcccagacgggtaccttgttttcagtttgctctagcctcaaagacgagtccccagccatgacaggagagaacaaaaaactcatttcttctcactcaatttgtttaccttctgcttatgaactagcctggcatttttcattaggcatcaaaggcagcccttctccctatccataactgaagttattttttgaaaagaagaatcaaatcccaaatacttccctcttccatccgctaccataaacctcaaattaatattgtatatgtatatgtatatatgtatataagtctatgtatacaatgtatacacataggtagat

SEQ ID NO: 70260 - DNA, 601 bp, Human
atgttcctaacttgctccatctcagaccaacgactccacgggccattgggctccttcttacacaggctccagaggagcgtggacaccaccggcggtctgaagatttggcagccagcagtctccagaggggggtcggaggcgcgcaagtgggtaaggcggtaggctggctagcctcctccggtgggttaagggggcctaatgcggaagacctgatggttcatgctgagagaaaagcaggtctatgcccgcccctctgcgcctgtctagtctatctgatcgcgctgattcagcagcctgcggygcacgtggtgagggcgcctggagcgcccagctggagagagggccctccgcacacgcaccagcgagtcccagggcctccctcacactcccgagaggaatctatttccatattttagagtttatttcactcatcgaataactgctcatttgggggataaagggcaagatctgttggggtgaaatggaattttctgagatttgaggaataatcagtaacatctatttatttccattcgtccttctcattttgtctcaacggtcttttgactccatcagccatcacagcttattcccacttccg

SEQ ID NO: 70261 - DNA, 601 bp, Human
tatgtgaggaaatgtgtttaaatctcctaagagaggctgagagggctggatcaagggccacagaggatacctcagtttgatctcatcttctatttctactgtatgtgagttagtgatgatagaaaacctattctttttgttacaaccctgatacttcagaaaagtcaaagctttgccatgaaactgcattctaacaagttattttaaacctaataatattctgtagtatttgtctgatagaacagataatcatatgtgtttcgcaaactattatttgacagtaaactttttttttttttttgcaaattgcaaatgttttctggtttcaccatgagaagtgcaccatggccatggactttcaaacataatttgtttagtttacatggaccaattaatatactcttagcttctcttacacaataattatcccaagttttgaacacagaaaatgaaatcaagctcattgtatataaatccttattatgaggaaatactgtggaaaaatgaagaaatatgaacaaggcaagatagatgacccaactattgcatggaaacaaatggtttggtttaatttatacgccttcaagtttaatgtcaatac

SEQ ID NO: 70262 - DNA, 601 bp, Human
agatgcgttgttgaaagcttctgaatacatggaatatctgtgcttttctatattttattcattaacaaaagagagaaaaaggaaaaatgtgtatagttgtatcaaccactatcagtagagccctattatattaagaaatctgcagaggactaagtcaaaaatctagaaatatgtttttttttacggaagtaagcttacatcataatgcataagtggaatagactgtgtgtataagctgagagacaccaagacattcttgccttcttcagcctaggtgtcaatgctgaaattccacaaagagaataattccttctgttaagcattctcctcttcttttgaccctcttaaatgggaacaccttaagaaaaataacacactgtctgtagcactttaatgtgaatttatttacactgagccacccgtccaccccgtgccttctcaagcaggagaaggccacagtagcaggagagtactaagacacctgtccatacttgtgtatgcatggggtgtcctgacaagagaaaagagaggtagtgagaggatcaaagaaggcagtcaaatttagcaaacagtcattgactatataccatctacaagacaa

SEQ ID NO: 70263 - DNA, 601 bp, Human
ttgaaatagacaactaataaaacacattatagctctattgagctaaaagtctctttttaaaaattttgaaatagacaactaataaaacacattatgctcttttcatgttcatataaaatacataaatttatgttaaataagcaggctttctaattaagtgcagactatgtgttttatcttattaaactactctatgaacagtggtgtgtaattctcttgatccagtggacgtgaattttgaaattactgtaggagacagagggacattgacttcataatgctaactataaaatacaaaatwtatacaacaatgtaataaattatttcattaatttttttctaggaaatgattcaaaatgcaagatgtctcaaagcataatccattaaacatttcattgaaccaataatttcaagttatttataatgctttcagtatcttatatgtagtctttaaatgcagtcactaaaagactgagtatggtatatgtttatttgtaactaccattataaccttgataattagagtagaggaatttatttaatgtaaataagtattattttccagactttcaaatagttatactagtcttgagcacagatt

SEQ ID NO: 70264 - DNA, 601 bp, Human
accctgggtaacagttaggtgacctttgaaaaatctgaagtccaaatagccatctccataaagggctcctcttaagaaagaactttagaatatgaatctcgaggaaaagaggaggaaaagagaaagattttagatgaaacaattgtagggggtggggcaggtgggtttcactcatatgaaagatcctaaaatggaaatgatatagattcctgttttaaaaaaagaaatgctgtggtgtgtgtctgcacatgcacctgtgcatgagtgtgtgtgtgcctgtcatctacattagttaaaaatkacatgttctttctttattttcttgggcactgttgggggaaaatattaaataatgtagtacattgtaaaaacctaactctgtcaaaattgagtaaagcaatcaccgctgtttttgtgaaacagagctggaagtcagatcaaggcataatgtattacacattttcaaaaatgtcattcaactgcattttaagaaaaaaaaaacccgagacaagataaatatacctgatactctttttaatgaaatgtttcacacctttgtaaaattcttgtgatctgtttatagagccagaaacattctaga

SEQ ID NO: 70265 - DNA, 601 bp, Human
acagagcaagaacctgtctcaaaaacaacaacaataacaaaacaacaacaacaacaacaacaaagaaacaaacaaaaaatacttgccttcagcctgctcgagatcatatccagagattcaccagtagacttgtggaagatctacatatatggcttcataacctgccaatggaactttgttgattgaactacacttaaatataagtaactccagtaaactattgtacataaagtgaatgtgctgttggaaatgctctgatattggttggcttctactactgtcagtaacctgcactgctcaraaactccatgtggacttcaacagtggatctatgtagattgccttgcaatattcagatttttagatttctgtgttatgatcagtatttcaaagaaaagtttggcattattagaaaaaacaaggaaaaaaaggccattttattcccgtataaaacttcttggtttgatatagaagtatgtagcttttagtgtttttatatataggggacaaaatatttggtattctcaaacacgggaattctgtgtaaatagtactccttgaaattatgaaacctggtagtcttaactagtacaggaattct

SEQ ID NO: 70266 - DNA, 601 bp, Human
aaatatttggtattctcaaacacgggaattctgtgtaaatagtactccttgaaattatgaaacctggtagtcttaactagtacaggaattcttaattctttgggggttatgggctctttcaagtttgatgaaagctacagaatcctcctttggattctcataacagccctattgttgtaagtgttatggataaggaggctaaggctaagagcttaattggcagaactggtttttgattgcatgtctgactccaagttcacactcttcccccattctcccacatattccttcaaattttacwacatggcaaactaagctctttcagagctggtgctgacctacattgtctggctcatctccttacttcccacatgcatcctaggtagaggtcacgctgaactacttacaggtatttgaaagtgtcatgttgacctttcaacaccctgttccttctccctgaaaatcctttcttattttgccttcctctctaatgctagttagagaacattcctagttgtacttgaagactcagctcaaatgtcaccttttataggaagacttttctgccctcttcttggccacctccaccctcttagatgcc

SEQ ID NO: 70267 - DNA, 601 bp, Human
gcaccatgacggatgtctacttgtctgcttttccactattctgtaagcatttcaagggcagatattttgtgtgtgtgtaagatctggccaaagtgtagttagtaactcgagtgacttttttcttcttggagttagatatactttcctgtaatgcctgagtaaagatacgttatttttttctaaagaactctaacacgtgcaatattaatgggggccatatgctacttctctctcagcagcctcaatcacactgataacattgaaaaaatgcaagcttgtttcaaaggaataattttgaccycatttctgtgaacaggaatttatattttaccaggcaatcatttcttagtaatatagttccatttattttcttagtgagttaggaggaaaaacagtatgtaaaaagatttgtaactatacatttcaaagtatttaaacaatagtaacagggtttaaatgtatcaagagttctggttacttttatagtcatcgatattatgtcaccaagtaagtagggaacagaaatgtgttacaaagataaatgaagtagaaatatagaaagaaaaatagtaattttaaagcaactttaaaataagcaaac

SEQ ID NO: 70268 - DNA, 601 bp, Human
tcctctgaagttcttttgtactggggtagttatttttaaatgttaccttgataaacgctaacaatgcttttgctttgaggcagagcacacatacctctaaagcgcatcctctcagctgatgagcaacaggaaataactctttttttcctttttagagccgtcatctaaacattcagatggtattatgggtagaatattgtgtgtgtaaatgttgcatatcacaaaatagaaccagaaagtaccctacttcctttctctttggccaaagaaatgcagtatttgttgactcaaaaaaaaaaaaattataagcaacctttgccctgtcatctctggcagttacataaatacttggagttaattttggctgtgcccatgaggtcaccaaaatctcatgccttatggttccaactaatgtgttgatatggcattcttacagatttcaagtgcttgttattcacttaatgtaaatcaaaattcctccacaacttctggagatatcctttcagagaccctgtgattggaaatttgggcctcttctcctcttactcctccacctttttcctctgtgaccatcccaaagcctaaaaatagaatttaaaaa

SEQ ID NO: 70269 - DNA, 601 bp, Human
tgcttgttattcacttaatgtaaatcaaaattcctccacaacttctggagatatcctttcagagaccctgtgattggaaatttgggcctcttctcctcttactcctccacctttttcctctgtgaccatcccaaagcctaaaaatagaatttaaaaacaaaaaacttgaagtgattttaaatctcactagtttgaactttttttgtagaaaataaatttgaagccttcattttctaaatgatttaatccctgctgtgtaggtagcagttgcttttaagacagaattcgaattttaccccaygggccaaaggaagttgcctggttgggttttattactcatgtaaactaacttgaaacggcagtggaaaatcatttgacagaaaggttaaatgttacgttttggtgacagattattgctttaaaatgaaattttatttacctctttaattcaacccaggctattatttgcgtttcctaaattatttgcagtttgctttctgagtccctataatggcattcaaaattatgtaaaaaacaaaactgaattttaataaagatcttactgaacaaattcttaagtccctaagagcatcactgcatt

SEQ ID NO: 70270 - DNA, 601 bp, Human
tgtaggtagcagttgcttttaagacagaattcgaattttaccccatgggccaaaggaagttgcctggttgggttttattactcatgtaaactaacttgaaacggcagtggaaaatcatttgacagaaaggttaaatgttacgttttggtgacagattattgctttaaaatgaaattttatttacctctttaattcaacccaggctattatttgcgtttcctaaattatttgcagtttgctttctgagtccctataatggcattcaaaattatgtaaaaaacaaaactgaattttaataaakatcttactgaacaaattcttaagtccctaagagcatcactgcatttgtatttgatataataggattactggatgatatagcgagaggtgtcataggctaaatgaagaaggaagcctctcaaattgcatttgtcttgtgttatacaaagggtgcacatggagacagacacattcgatgtttttcttcttctgtttttctttcaaagtggatgtccagtgtaataattaccacttatttttttggaggggcataggaaaaggaaaaatgtgacacatttttctatccaggaagcattccatc

SEQ ID NO: 70271 - DNA, 601 bp, Human
attttaagacctgcttaaaaaataaatgtggtgtgggccatccgaggtgacactgtttaattcacagagcgaatgagtcgtgctctggatctccctggagaggatgctccccatagctctgtttcatgcagatgctagttggaaatgagatttattaactggctctctgcccactgcatctttgtttgtatactccaggcttttaagaatgaatgtataagtctagaggactatttccacatgggtgttttgagcatgcgactacagtagcacatgtttctgaatactttaaaaaaaaaaattacttggccccaggaaatggattgcagagaaaagcaaaactaaaatttaagcctaaagcattggccataacatccagctttgccagttttaaaaaacatgctgttgttaaggaaaacaaagagaaatatcgtaatattgtgcatgtgtgtgtgtttttttgtgcacgtgtgtgtataaaagagttgtgaaagtgtgttccattcaatagaggctattgtaacatggctcacttttatcagaacataggcttcacatcacattccccaaaacagcagttatagattgcaaaagtctacgt

SEQ ID NO: 70272 - DNA, 601 bp, Human
ttatagattgcaaaagtctacgttcatgtctttattatgtatttgttagtatcatctaggtttaatactgtcaaaggaggttttccaaaaataaagatttttgtccttactatttttcttagtgtttgtaaaaatcagaagattacttgatgctttagtacatgcccaactctggaacttcttttacggattttcagagcttctgttaatggaatggtcttccgggtgctcttgctttggggagaggctcactcctgctctgtagctggtatctgttgacagtgcattatcttagagcagtgctgtgagattgtcctctggaattcagaaggttgatttccttatgcagcatcttttctttatttacagggacctcttgaagctgcagtgaataattctagattaattggaaggggaaatttgggactaatttaaatattctgtttggtttagagaattaattaattttacaaatatttgaaagtctgctctggccaaggtctgtgctagatgccccttgaaggatcttgagtcctagtaaagtccgatggaaaaccgctcattttgtaaaagacttacagtgttggtattttgcttagtc

SEQ ID NO: 70273 - DNA, 601 bp, Human
atgtgcagagatcaggactaggtagatgttctctggctcaggatgtctttccttgagtagaagcaatgaatgcagctttgttccataatgagactggtacttagcccagacagtggcttttatatttgcagatgcccacttcatagctatcagtctaacttttaggagtggcaagtgtggagagctgccactattctgatcttcccaaacaatgaaccaggtttctggttcattatgaagcatcttcccttggcatttaatgatgtaaaaagttccgatgtggctgatgaaactgctcagracactccctgtgactttggggccaattcctctgacagttagaaggttatcaccttggtggcagactccagagtggatggagtttaccctaaatagtgtgtgtgtgtttacttcttattttagtcaatttcactttaaaggacaaattgattttcttctctcctgtgagaagtatcttttttctacagtgaattaagttagaatatatatctaagaacagttttattcttcctgacttcaggccatctttcagctagctgcctctgtaatactacattgagtatgtcaaacttagccaata

SEQ ID NO: 70274 - DNA, 601 bp, Human
acctccaggggcctggacagtgggcgagagtacgtggtgggagggatgtgagatggagaggttcccacacctgaccccagagtatacacagggtgtgtgttttgttttttgctgaggtgtggctgtcattggttcagaagtcttcctgatacttgtctgaataaaagtaattttgtgattattgtgttgatacttgggaagggcaaaattatcactcctataattttcaaaagctttcagaaatgtagcgtgtaagtaaaaatgtgtgtgtaccctactatgacctctatatttgtcttaygaacatagccttgaggcacaagcttgggcattgttgagtgatttttgtggcaggaagttcatttctgcttttcaaaaagtcgaggaaaagtaaaaggcttatttatctgttttgctcttccaatttttatatttgtattggtcatcactaggttaaaaatatttcagtatgctattacataaaaagtgaaaatgagatcatatattcatactttattcatagagaaactgaaaggatataaactaataatggtaagaactgggaagattaatcactgtgtacctttttatgttttttttt

SEQ ID NO: 70275 - DNA, 601 bp, Human
atcactgtgtacctttttatgttttttttttctaaactgaaactaaatgcattacctcatcaatcagtgatgtttcaattagccctttaatagcataggtttttaaaattaaataagtttcagtttgaacttaatgaggtttacatgttgaaatatgttaggaaacatctgatagatactcatgaacttaccaaagtcacatggatgacagtaaagatttgcctaatgcaagtaccattcttacattaaacatcagtagtcacaaatgaaatgtgctcctatagcatctgcctcatttagycctttgaggtttcacacatagcaatccatagtggagattttgtttcattttctccagagtacattgaagctgcctgtgtgttttgtgatgcgtccagcctgtttagtatgctctgtgaatcttacactaactgcaaaataatactctgtgaggattattttaaaatatcctctttgcatttttgttttcttctcatttatcaagctcctgccatttatcaagtacagcaaagggccctaaaactgagattgcaggtaattgccaattttttggccactctgagtgcagtcctctgtcctc

SEQ ID NO: 70276 - DNA, 601 bp, Human
atagcattgtcataacaatgactttaagatgtcagcatgtacctatttccagcctgtatgataagtgtgtcactgctacctctactccagttcaaaatttggtctgtaccgaaaagggaacctggattgtcccctacctcctttcctaacctccaggaggaccagttggggtcctcaaagtgcacagccaggaagttgcttgaagaggcagtgaggtatagtgggcaaagcttggctctggtgtgagacttttactttctgtcccagctccatccctttctagggcaacatttttttagcytctctaagcctcattttcttaccgtgcatatggaaataatagtagcatcaacttcccagggttcttatgcagattaaatgtgttacagaacataaggtgtgccaaacggtgcctggtgcaaagtaaatgcctcaaagaatgttagctagtattatttcttgcagcttaaatctactcttttaccctgtattgataaaaatctataatctttttgttctaagtaccctgtacaatactttgcacatagcagatgttcattaaaagttcaaattgaacctggaaaaaagtcaaacaaattat

SEQ ID NO: 70277 - DNA, 601 bp, Human
cctttcctaacctccaggaggaccagttggggtcctcaaagtgcacagccaggaagttgcttgaagaggcagtgaggtatagtgggcaaagcttggctctggtgtgagacttttactttctgtcccagctccatccctttctagggcaacatttttttagcttctctaagcctcattttcttaccgtgcatatggaaataatagtagcatcaacttcccagggttcttatgcagattaaatgtgttacagaacataaggtgtgccaaacggtgcctggtgcaaagtaaatgcctcaaagartgttagctagtattatttcttgcagcttaaatctactcttttaccctgtattgataaaaatctataatctttttgttctaagtaccctgtacaatactttgcacatagcagatgttcattaaaagttcaaattgaacctggaaaaaagtcaaacaaattatactatagtcttttttccccctcatcaactttattaagaatttatgtacagtaaactgcagccatttaaagtgtctgagtcagagttttggcagtgtgtccaccctgaagccatcaccacagtcaagatgcagaacattt

SEQ ID NO: 70278 - DNA, 601 bp, Human
aggaccagttggggtcctcaaagtgcacagccaggaagttgcttgaagaggcagtgaggtatagtgggcaaagcttggctctggtgtgagacttttactttctgtcccagctccatccctttctagggcaacatttttttagcttctctaagcctcattttcttaccgtgcatatggaaataatagtagcatcaacttcccagggttcttatgcagattaaatgtgttacagaacataaggtgtgccaaacggtgcctggtgcaaagtaaatgcctcaaagaatgttagctagtattattkcttgcagcttaaatctactcttttaccctgtattgataaaaatctataatctttttgttctaagtaccctgtacaatactttgcacatagcagatgttcattaaaagttcaaattgaacctggaaaaaagtcaaacaaattatactatagtcttttttccccctcatcaactttattaagaatttatgtacagtaaactgcagccatttaaagtgtctgagtcagagttttggcagtgtgtccaccctgaagccatcaccacagtcaagatgcagaacatttccatcacccccaaaagac

SEQ ID NO: 70279 - DNA, 601 bp, Human
taagcctcattttcttaccgtgcatatggaaataatagtagcatcaacttcccagggttcttatgcagattaaatgtgttacagaacataaggtgtgccaaacggtgcctggtgcaaagtaaatgcctcaaagaatgttagctagtattatttcttgcagcttaaatctactcttttaccctgtattgataaaaatctataatctttttgttctaagtaccctgtacaatactttgcacatagcagatgttcattaaaagttcaaattgaacctggaaaaaagtcaaacaaattatactayagtcttttttccccctcatcaactttattaagaatttatgtacagtaaactgcagccatttaaagtgtctgagtcagagttttggcagtgtgtccaccctgaagccatcaccacagtcaagatgcagaacatttccatcacccccaaaagactccttgtaccctttgcagtccaaatcttctctgcccaaagccccaggagccagtgatctgctttctgtcaccacagattagattacattttatataaatgggatcacagagaatgcactcattagtgtctgactactttgactcagca

SEQ ID NO: 70280 - DNA, 601 bp, Human
gggatcacagagaatgcactcattagtgtctgactactttgactcagcacaatgattttaagattcatccatatgggatgtctcagtagttcatcactctttattgctgagtagtatttcattgtatggctataccatattttgtttatctgctcaccagttgatgaacatttatgtttccagtttttaggaattatgaagcaagtttctatgaatattgttatacaagtctttgtggaggtgttttcatttctctggggaaaatacttaggagtggagtgattgggtcatatggctggtrtttaactttttgagaaactgtttggcaaacagttgtccaaaatggttgtaccattttacattcctagcagcacagtatgagagttctgattgtttcacatccttggcaacacttactatcagtctcttaaatgttggccatccttatggatgtagaatggtatctcattgagattttaatttctattttcatgatgactaatgatgggtatgttttaatgtgcatattggccatttgtgtgtcttctgtagtaaagtgttcaaatctttttccatttaaaaaaataggttatctttttaa

SEQ ID NO: 70281 - DNA, 601 bp, Human
atgtttccagtttttaggaattatgaagcaagtttctatgaatattgttatacaagtctttgtggaggtgttttcatttctctggggaaaatacttaggagtggagtgattgggtcatatggctggtgtttaactttttgagaaactgtttggcaaacagttgtccaaaatggttgtaccattttacattcctagcagcacagtatgagagttctgattgtttcacatccttggcaacacttactatcagtctcttaaatgttggccatccttatggatgtagaatggtatctcattgagrttttaatttctattttcatgatgactaatgatgggtatgttttaatgtgcatattggccatttgtgtgtcttctgtagtaaagtgttcaaatctttttccatttaaaaaaataggttatctttttaaatagaattatacacatatgttttgcataataatatagtcttgaattgtattttaatatgtacaggtcttatattcttaacttgaatataaagtcccccccccacacacacaaaaagacctagtctttgttcacaatgacttttacagcaattagttacatggtccatcctcag

SEQ ID NO: 70282 - DNA, 601 bp, Human
cactaatgatttcacaaatgtcctaggcctactactagatttcgtgggtgccacttatttcgtttaacatttattcattttattgccaaaaggttcaggccgaatttcaggtgagtcgctgcctccatggtggcggcagtcagatgattctctctgttctggttgggactgagtggaccacagccactcaaggatcccttgagagttgcgagtgttctttttgatttgaggatgtgccgtgaacggaagccaaatactaatagacaggacatcctgtgattcccttagtttacgatggccraggatgtgtgggtttttttgtttgtttgtttcttttttttgataagatgattacttggtttttttcctgttaacaagggagcctagatgatgatgtccatttggcttttaggactcttaactagcaaacaactaagcccctgcaaaatcacatgaagacattggaaaatctttttatgtaaggcagagatgatttggtcatagttcgcaatgaagtgaccgtcagttctattggcttgaaataataatgaaccaaagaggggaaatgaccgaagtcgaagttcttgaaattaaggatgtt

SEQ ID NO: 70283 - DNA, 601 bp, Human
actgttctgtctttatcccaagtttaacaaaacattctcaattcagtaatgacccctatccctaacatttgttaaactactgcagtatactgtattaaaaattttgtcctttgctcctgtaagtcctcatagcatagcgctgcagaatctaaagaggagactgcagttcaaaaagcttccctgcttccactgtccttcccaaacccatggtcttaccatgtatctgcccctctgtttttttgtttgtttgttttgttttgaaacagagtttcactcttgttgcccaggctggtgtgcaatrgcgcaatctcagctcactgcatcctccgcccccctggttcaaggtattctcctgcctcagcctcccaagtaactgggattacagacacatgccaacacgtctggctcatttttgtatttttagtagagatggggtttctccacgttggccaggctggtctcgaactcctgacctcaggtgatcaacccgcctcagcctcccaaagcgctagtattacaggcatgagccaccatgccctctgttatttctatacctgatttggttcaaacatggcacaatttttatctgctttttactgga

SEQ ID NO: 70284 - DNA, 601 bp, Human
atgcagccaaccctgccaagtgctggaacaagctgctcttccgtggcatgaggtcttgagccccagttatccctaaggatgaaacttgaggctttgctctgtcatttgtttcttattatgagaagatttagaaaaagcagacaccgaagtacctgagaaggaactagcaccaccaagagtacaagagagctcagaaccaggaggtggggaccactcctacaaaatgtgtgcaccacaggactttgcctagtggcagcatgattgtttgatgaccgcatatgcttctgctatattgcatgcrcctgattttatgcagtggactaacaactgagcatgaccacccactatggtaccagcagcacctatgtcctgaaaggttgacccagggccctgctcgttgggggcagcgtgggcatgactggaaaagacctgggatcatgggaaagagctaaggtcagggtaagagggaacgaggccaagtagggctgggaaagtaaacagaaggcatatggtcaagaaggagtggatgtgctgggagctgagttggcgggggagggggtactgagaaaagttggtgccctgaggagaccagccaagccct

SEQ ID NO: 70285 - DNA, 601 bp, Human
ttcatatccatggacgttatgaatgctacaaagaacttttttagaattccaaaattttgtcataccctggataggagccaaatttccaagtcatttcagggctgtagctattgacttgttaagtctgagtttagaaaacaaaacaaaaatccacccgtatatgctgttttgaaagtttgtcttttttgtttagttacgatagggtggctagccaaactaagccctgtatgcaaggagctgcctaatgaatagtagtggatgaggttaatgcagataaataacaatgaggctgttaaaaatsgagttgattttcaaggtgacttacggaatgtcctattgtaggcggttggagacacctgtgttttaatgatattctgttggttttttttcttaaaacatatgtagaatacttggtgatatggcaagaaagagcttaatctccgtgttttgaaaaataatcattaatggtaaaagggatgggcaccctgaaaaagagtattatttttatgttcattctctcttggaggtggcagttattagctgtcgttaggagtttgattgtcagactaaatggaactttgtatgcacattaaaagcatta

SEQ ID NO: 70286 - DNA, 601 bp, Human
gtggatgaggttaatgcagataaataacaatgaggctgttaaaaatggagttgattttcaaggtgacttacggaatgtcctattgtaggcggttggagacacctgtgttttaatgatattctgttggttttttttcttaaaacatatgtagaatacttggtgatatggcaagaaagagcttaatctccgtgttttgaaaaataatcattaatggtaaaagggatgggcaccctgaaaaagagtattatttttatgttcattctctcttggaggtggcagttattagctgtcgttaggagtctgattgtcagactaaatggaactttgtatgcacattaaaagcattatcattaagaagtgactgataatgaagagcacattcatattggaatgataggcagcctggaaaagcctgcagtagagagcaagcacctcaaacctgataaaactcacatttatctcatcttcctctaaacagcatagttttgaagattcttacattggtcttcttcactagttctaaaccatcaatgcctaattttgagagaaaaaaatagtatatttcagtgtctatattttaataaagtatgtgcatgttgtc

SEQ ID NO: 70287 - DNA, 601 bp, Human
gccagagcaggacttttacatgccctggagtcctgccaggatcttgacctcgaataggtatcttttgtgtttctgagttaatttccttgttgttaaataaactttgttttttttctagttggggaatggcggtcaatgtgtattctacctcgataacccaagagactatgagcagacatgacatcattgcatgggttaatgacatagtatctttaaactacacaaaagtggaacagctttgttcaggtaagacatattcttttaagtgtttacctaaatatttacagtctgtcatgtggartgtgattttatgaaccacagctgctatattttgggtaggaaaaagtatatattgctattggcatgtaattaaagggggaaaaactcagatataactaaaggacgtattgggaaaagtgtttatgagcatccaggagcacaagcagagccacacggacacgtattggaaaggtctcttgcttgagcttcgtaatgcctttcactggctcctagcctcttctctgtcatcccatctgccatcacacttgcctcctgaaaacaccaattggttcttacaacactcctcctttaaaacctctag

SEQ ID NO: 70288 - DNA, 601 bp, Human
gtctctcctggttagtgacgaacaccataaataaggggaaattagaaaaacaggcttagggaaaaatagatcacctggaatgccattgttttattgaagactaacaatatatatactgaacaaaaaatcaaggaacatgtgatcacagttaactttatatagtgccttaacaggaataagtgaatcagtgacatattagaaacaggattaataattgcctttgagaagtctcaataagttctctctctctctctcacagatacgcgcgcgtgcgcgcgcacacacacacacacacacacayatacacacacacacacacaattggtacaaagcagtaccattagtgggaatctcatatttttttccccatatgtgagaaattcccagatgtcatagttgagtgcagtctttgaggttcttattgagtatatcactaattcacaaatgctattgtatctaccctactatagtaagaccctgctgagatttacctgcccccaagccatgaataggtgggtggttgtgagcctagagatgaaaactgttgtaccaagggatgggtcatcaaaagaaatctaagttggatacagttaatgagagt

SEQ ID NO: 70289 - DNA, 601 bp, Human
ctctcctggttagtgacgaacaccataaataaggggaaattagaaaaacaggcttagggaaaaatagatcacctggaatgccattgttttattgaagactaacaatatatatactgaacaaaaaatcaaggaacatgtgatcacagttaactttatatagtgccttaacaggaataagtgaatcagtgacatattagaaacaggattaataattgcctttgagaagtctcaataagttctctctctctctctcacagatacgcgcgcgtgcgcgcgcacacacacacacacacacacacayacacacacacacacacaattggtacaaagcagtaccattagtgggaatctcatatttttttccccatatgtgagaaattcccagatgtcatagttgagtgcagtctttgaggttcttattgagtatatcactaattcacaaatgctattgtatctaccctactatagtaagaccctgctgagatttacctgcccccaagccatgaataggtgggtggttgtgagcctagagatgaaaactgttgtaccaagggatgggtcatcaaaagaaatctaagttggatacagttaatgagagtga

SEQ ID NO: 70290 - DNA, 601 bp, Human
ttagtgacgaacaccataaataaggggaaattagaaaaacaggcttagggaaaaatagatcacctggaatgccattgttttattgaagactaacaatatatatactgaacaaaaaatcaaggaacatgtgatcacagttaactttatatagtgccttaacaggaataagtgaatcagtgacatattagaaacaggattaataattgcctttgagaagtctcaataagttctctctctctctctcacagatacgcgcgcgtgcgcgcgcacacacacacacacacacacacatacacacacacacacacaattggtacaaagcagtaccattagtgggaatctcatatttttttccccatatgtgagaaattcccagatgtcatagttgagtgcagtctttgaggttcttattgagtatatcactaattcacaaatgctattgtatctaccctactatagtaagaccctgctgagatttacctgcccccaagccatgaataggtgggtggttgtgagcctagagatgaaaactgttgtaccaagggatgggtcatcaaaagaaatctaagttggatacagttaatgagagtgatactgaaca

SEQ ID NO: 70291 - DNA, 601 bp, Human
ggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaatmcatacgttctgaaaattagaacttaaaaatggcattctctaaagacgtttgtgcccagaaatcagcattggtttgcctaccaaattagttaagcttcttcttttcctggcatttaaagccttgagcaatctagctgcattccacctttccaacatttatccccacagcctccctacccataacctgtatttcctcaaacgcacgtttcacttatatgccctgattccttgtctttgcttggagtatctcctttgaaattcatatcaaatgccactttgccctattcttcctgatcacatt

SEQ ID NO: 70292 - DNA, 601 bp, Human
agacaaaaataaattccacatggattcagaatttaaatgtaaaacttgagaccataaaagtacttgacagaaatatgcatatttatgtattcttggttcgagaaagttgataagcaagatataaaaataagaaagccattaaaaatattgatagagcatattaagtgactcagaaagagaattatgatctgttgagtttcagaaagtttacattaaaaatgggtataatgtgattacatttttaaaacaggatcacatttttaagaaaatacacacacacacacacacacacacacacacrcacacacacacgcacacacacactcctttccaaagaggattagaatggcatataccagaatatttcgagtggttctctggatgatgacactagagatgatttttccttccttccctcactatatggaagagggttttttttttttttcaaaagctgttatttctttttaaatctgaaacatgaggaatttggttggttggtttgtaagagtatatagtatctgggtctccatagataaattttatgctaaactctacaaaagcgaaaataacttctaagaccaggtaatgaggcagttgt

SEQ ID NO: 70293 - DNA, 601 bp, Human
agccattaaaaatattgatagagcatattaagtgactcagaaagagaattatgatctgttgagtttcagaaagtttacattaaaaatgggtataatgtgattacatttttaaaacaggatcacatttttaagaaaatacacacacacacacacacacacacacacacacacacacacacgcacacacacactcctttccaaagaggattagaatggcatataccagaatatttcgagtggttctctggatgatgacactagagatgatttttccttccttccctcactatatggaagaggtttttttttttttttcaaaagctgttatttctttttaaatctgaaacatgaggaatttggttggttggtttgtaagagtatatagtatctgggtctccatagataaattttatgctaaactctacaaaagcgaaaataacttctaagaccaggtaatgaggcagttgtgtttcaacaatcccatccatataaaaataatgttaaagtggcaattggaatttgctccatctggcggtccttcaaaagaaagaactggatagtgggtgatgactcaaagaataccctccagatcatgatgttt

SEQ ID NO: 70294 - DNA, 601 bp, Human; identical to SEQ ID NO: 37363

SEQ ID NO: 70295 - DNA, 601 bp, Human
ctggcattactttttgaaatttttttaatatttaaaaataaatatttttaaggataacatgaatactcatactcactagtatgaattagatgaattcttcatctgccttaaaatagtactcatgtagatgaagaggaatgaacaactctgggagagttgttaggaggcaaaatagactggatgttggtaatggctgaatgctgggataaaagagaaggagatgttaaacatgacttcttgtacaactggaaggatttggggttttgttcaagaagtgctgaaagagaaccagatttgggargaaatcttgagtttgttttgaacatactaagtttgagattcttttgtgacatttaagagaagatctacataggcaatttttgtgttgggggtggtgcacatgtgtgtctggagctcaaaggagttataggctaaagataaacatttgtgattcttccacatattgatgtaatggaagctggaagcaaatactgaatgataaagggtagagtgtcttgagaaacttggacatttactggttgagtagaagaggaagggcttgcataggaagcagagaaggtgccagaaagaatgaaggaaa

SEQ ID NO: 70296 - DNA, 601 bp, Human
aagatccaactttggagccataatgggtgagcctatatagaataaagaaaactaagcacagatctttggaaatacatacatttaagggggaggaggaagaagaggaagctgcaaaaaagatgaacatcaggaagaaaaccagaagagctcagcatcagagaacaaaaaccgtaggaaatttgtagaaagaggggtcaccaacagtgccaaatattaattgtggcgatatcaaataggatgaagcctgaaaaataggccaaagtctgactcctaggaggtgattaatagtccctcagagaawtggtccattaaaatactgagggcataggcctagattgcagcaatttaacaagggcttgtggaagtggaggcagtaagagtagattcaacctttaacaaatgtgtcagaaaaaaatggaggaaaataaaaacatttggtttgtgtagggaaaagagtgatagtagcttcaggaaataagattggaaggaagatgttattttttttcaactgttcttgtttgcttttaggataaggcaatgtaagcaggtttgtaagatgggagacatgtctgtggagaaggaatcattgaaaatagaaaaa

SEQ ID NO: 70297 - DNA, 601 bp, Human
gtagaaagaggggtcaccaacagtgccaaatattaattgtggcgatatcaaataggatgaagcctgaaaaataggccaaagtctgactcctaggaggtgattaatagtccctcagagaattggtccattaaaatactgagggcataggcctagattgcagcaatttaacaagggcttgtggaagtggaggcagtaagagtagattcaacctttaacaaatgtgtcagaaaaaaatggaggaaaataaaaacatttggtttgtgtagggaaaagagtgatagtagcttcaggaaataagattggaaggaagatgttattttttttcaactgttcttgtttgcttttaggataaggcaatgtaagcaggtttgtaagatgggagacatgtctgtggagaaggaatcattgaaaatagaaaaagaggggaaattggagtatgacgctaaagctgaaaggaaaaggtgagatgtcaagggcatagataaagtgttagaaaggaaaagagaggatatttattttcttggagccaaagcgataggagaggctgggtaaaaattaagccacaaagagtttgggaaacaaacattgatggcagtttaga

SEQ ID NO: 70298 - DNA, 601 bp, Human
agaaattacaggaaaagttgtttatttcatatttttactattttcaacgttcttcatttctgaacacccaagttccctagcggtttcatttctcttcagcctgaaggacttttgttaggatttcttatcctgcaggtccagtggcaaaaattattttagattttctttttctgtaaatgtctttattttaccttcattcttaaagaatattttcacttgataaaggattcaagctgggttttgtttttccttttgttttattttttgcctgtaagcactttaaagatgttattccactgcwtgtggcctccaaagataagaagtgcatactcattctaccctggaatggaatacatagtttttctctgagtgcagtcaaaattttctccttatctttggttttgagtagtgcgactatgatgtgcctaattatggttctgtttgaatttatcttgtttcagagttcattatgcttcctgagtctgtgaatttatgtctttggaaagattccaagcattattttttcaaatatttttttcagctccattctttctcctgtccttctgggacttcatttatccatatgttagagcttctgaaa

SEQ ID NO: 70299 - DNA, 601 bp, Human
tttatggagatttctgagattttagtgcacccatcacctgagcagtatacactgtacccaatatgtactcttttatcccacactcagcccccaaccttccccacccccgaatccccaaagtctgtcatatcactcttatgcctttgcatcctcatagcttagctcccacttagaaatgagaacacgcactatttgatttttcattcctgagttatttcacttagaataatggtctccagctccatccaagttgctgcaaaatatattatttcattcctttttatggctgagtagtattccrtgatgtatatataccacattctctttatccactcattggttgatgggcacttaggttggttccatatctttgctattgtgaattgtgctgctataaacatgtgtgtgcatgtgtctttttcatataattacttctagaaaatgtttcttaccagttcctactttttggattccttgctctttttgtgaaagctttacctgaattctcagtcattcttttttactaattgatttagtttgtcaacaaatgtttgttgaagcactgtaagagattctggagatacatagtgattctgacaag

SEQ ID NO: 70300 - DNA, 601 bp, Human
cttcattcccacgagattggtgtggctagtgcctgctgtgtggagctgcccctagctgctcaaggaggactgcccactcttaagagcctccactgaaaaggaagagctgcagacctcaccactggctgcactggtcagaacagaagtcctaagggctgtaaactgccaatttcagaattaaaaaaccagcctcctagtgatctcatgaatcagagcatcccagaaccctgttaaagtttcatttggatggaaatctgtccactgaggtgcttttttgccctcagctcagagcagattacaraatctacaaagtgacagtacggaggcagttttgaaggaaagactaggtcaatataacttgaatttgcagtaatcagaattctgtagggactggcaaccctattgcagtatgagggctgtggtgtcagttcagttactgaggaagtcctcttcctatggaattcactctcctcatcagtctagcccataccctttctccagcaatgacattacttttttttttaaccaagctcatcatctgttaaaaaatataatctctttgccaaggtgcaggggataagaaagtaatatcaaatccatc

SEQ ID NO: 70301 - DNA, 601 bp, Human
ctcaaagggatccaggaggtgcacgtgtgtgtgccagtgggaaagccctggggccctaggccaccacctgacctttgcctgattcgtgagcacagatgccattttagggccgagactctgctgaaccacagcttggtgagtccaagccacacaggcaggttgaagttgggctctgttaacagaaagggatatttcctcaggggaagaaaacaaaacaaaacctgtttccccaagtggctgtgtgtggctagaagggggagagcatcagtaactgcagcagctgtgccctccctccctgccrtgagccatgctgagcgcctccagcggccggggattctccctgcgtgtctcactgctctcctggccagtgtcctctgcttcttcatagttgctcttccccgataacgtggctttgcccaggggtttggcttgccatgaccccttctacatcttatcaaacatttcagtttttttttcaagctctgtttgataataccctgagaatataattagtggtagccctttattgtaagcaatcagcttctgtttcttccatgattttttctttttaaattgacatcagactggataaggccagata

SEQ ID NO: 70302 - DNA, 601 bp, Human
cccgataacgtggctttgcccaggggtttggcttgccatgaccccttctacatcttatcaaacatttcagtttttttttcaagctctgtttgataataccctgagaatataattagtggtagccctttattgtaagcaatcagcttctgtttcttccatgattttttctttttaaattgacatcagactggataaggccagataccagaacatgagtgtgtctgatgatcctagctcagttattgcaacgacttttttgttgctgacctgcctatgaaagactgccagggtgggtgggtcrtcacatgctatctagggaagccccctctgcaaggctgtgtccctcaggaggggccagtgagcatggcacaggcttggacagcccagcatagaccactcagagttaagcatatactgactgagtttactccacctctcctaattgtgtaggtaaggagcctaagtaatttacagaaggtaatcttaagaggaaaccaaggaggagctctctttctgggaggctgatggtttttatttggtttccttcttgtcttgctggttctttgtgtctgtgactttgacattggcatcagctcctcaa

SEQ ID NO: 70303 - DNA, 601 bp, Human
cttccatgattttttctttttaaattgacatcagactggataaggccagataccagaacatgagtgtgtctgatgatcctagctcagttattgcaacgacttttttgttgctgacctgcctatgaaagactgccagggtgggtgggtcatcacatgctatctagggaagccccctctgcaaggctgtgtccctcaggaggggccagtgagcatggcacaggcttggacagcccagcatagaccactcagagttaagcatatactgactgagtttactccacctctcctaattgtgtaggtraggagcctaagtaatttacagaaggtaatcttaagaggaaaccaaggaggagctctctttctgggaggctgatggtttttatttggtttccttcttgtcttgctggttctttgtgtctgtgactttgacattggcatcagctcctcaagcttcccctggtgtccttaccctggagagatgcctctgctaggtcttatataatgaattataaaaactattattgaatttctctgggttaggcactgtgattggtggtgagagcataaggtgactaaaacagatgaaacacctatgtcctag

SEQ ID NO: 70304 - DNA, 601 bp, Human
gattctttgccagatcaggtgtcctcaccctgcctcccctgcctgcttgtctacttgttttctttacccagttggtttgcctttgggttaaagaacttggtcagcgggacatggaagtagtgttccaggagtgttttatatgggcttcaacagagctgaagcccatataccagtcacaaagcaaaacgtcagctctctggaaccctggggaagctcttctgcacagatttaccctgagaatattcaaactattttaagtctttcccaatttaaccattctcattttaaagtatattaggcmcctccctgtgtttttaaagaagtttattttttaaaaatttttaacagaaaggcttatatttaaaggctgtaatgctgtcagtgcttctagggggtgtgacttgcatccggagctaatgaccccaggcacctgaagacacaaatataaattttatggtctttctgtttgctactttgtaattaggatgttggttgaaacttgtaactgctgtcacatacctgtctttataacccttcggctcttgctaatctcttggtactaataaactgtgaagttggaaataaactgtaaaattggaaa

SEQ ID NO: 70305 - DNA, 601 bp, Human; identical to SEQ ID NO: 37364

SEQ ID NO: 70306 - DNA, 601 bp, Human; identical to SEQ ID NO: 37365

SEQ ID NO: 70307 - DNA, 601 bp, Human; identical to SEQ ID NO: 37366

SEQ ID NO: 70308 - DNA, 601 bp, Human; identical to SEQ ID NO: 37367

SEQ ID NO: 70309 - DNA, 601 bp, Human; identical to SEQ ID NO: 37368

SEQ ID NO: 70310 - DNA, 601 bp, Human; identical to SEQ ID NO: 37369

SEQ ID NO: 70311 - DNA, 601 bp, Human; identical to SEQ ID NO: 37370

SEQ ID NO: 70312 - DNA, 601 bp, Human; identical to SEQ ID NO: 37371

SEQ ID NO: 70313 - DNA, 601 bp, Human; identical to SEQ ID NO: 37372

SEQ ID NO: 70314 - DNA, 601 bp, Human; identical to SEQ ID NO: 37373

SEQ ID NO: 70315 - DNA, 601 bp, Human; identical to SEQ ID NO: 37374

SEQ ID NO: 70316 - DNA, 601 bp, Human; identical to SEQ ID NO: 37375

SEQ ID NO: 70317 - DNA, 601 bp, Human; identical to SEQ ID NO: 37376

SEQ ID NO: 70318 - DNA, 601 bp, Human; identical to SEQ ID NO: 37377

SEQ ID NO: 70319 - DNA, 601 bp, Human; identical to SEQ ID NO: 37378

SEQ ID NO: 70320 - DNA, 601 bp, Human; identical to SEQ ID NO: 37379

SEQ ID NO: 70321 - DNA, 601 bp, Human
cagccccacccaagctccttccaccctctgagaagcctcagctgctaacaacccccagcgcctatccttgacaccacggactcgactcaccactttcagcctccccgcctgcccagtggagtcgggacactggtgggccagggcgtgaaaaggtcatcatctttttttcctctgcaggtgtgagaaccaaggtctggtggaggcagctccaggcactgcccagtccgacacaacctgcaaaaatccattagagccactgcccccagagatgtcaggtgagggaccagggctgagggacacrggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccat

SEQ ID NO: 70322 - DNA, 601 bp, Human
cccaagctccttccaccctctgagaagcctcagctgctaacaacccccagcgcctatccttgacaccacggactcgactcaccactttcagcctccccgcctgcccagtggagtcgggacactggtgggccagggcgtgaaaaggtcatcatctttttttcctctgcaggtgtgagaaccaaggtctggtggaggcagctccaggcactgcccagtccgacacaacctgcaaaaatccattagagccactgcccccagagatgtcaggtgagggaccagggctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactaga

SEQ ID NO: 70323 - DNA, 601 bp, Human
gctgagggacacaggggggggcgcctctgaaaatgccttaatgctccacatcttaaaaaaaatggggaaaagatgaacacttccctcccagaattgggcaagaagaaagttccttacagaaaaaattggagtatctctaggctagtttacacacacacacacacacacacacacacacacttttaaaattatatatactgtaatactatgtcaaggaacacatcccacactgagatgtaatgataactactattgtcatcattttgggcttaccaacattacacaatccgtttttttttttcacacaatccattaactagaccaaacacctctttattagactatatacttttattattagacagaagattcccatttgactctttcttgactgtttcctgtggactgattggcttgctagcctagtagatgactattgtttctaatgactgtaacatcactaattggcagaaggttcactgtgtgtgttgggcactctgtaaccactttacatttactaactcatttaatcttcttaatgatgctatgaagtagattctattatcatcctcatggactgaaggaagaaaccgaggctcaa

SEQ ID NO: 70324 - DNA, 601 bp, Human
ctgaagaagcaaggagccagccatggggttatctggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgarcaggagggcacccgcaccacccccaaacatgccgatccatgatacatgtaatcccagtactttgggaggccgaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactc

SEQ ID NO: 70325 - DNA, 601 bp, Human
tggggagaaagtgctccaggaagagggagcaaccagtgcaaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgagcaggagggcacccgcaccacccccaaacatgcsgatccatgatacatgtaatcccagtactttgggaggccgaggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaaaaaaaaaaaaaaagttagcca

SEQ ID NO: 70326 - DNA, 601 bp, Human
aaagaccctgaggcagggggcatggggaggagcagaggcaagtggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgagcaggagggcacccgcaccacccccaaacatgccgatccatgatacatgtaatcccagtactttgggaggccraggcgggtggatcacctgaggtcaggggtttgagaccagcccggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaaaaaaaaaaaaaaagttagccagacagtcccagctactcaggaggctgaggctagaggatc

SEQ ID NO: 70327 - DNA, 601 bp, Human
tggtgagttgccaaagcatgcggtggggtgtgggaactaaagaaagatgagccagcctgggcaacacagccagaccccatctctacccaaaatgttgttccaagttagccaggcagggccaggtgcagtggctcacgcccaagctcccatcctgcacgcacaagcctgcccaatcctggtctctgagcaggagggcacccgcaccacccccaaacatgccgatccatgatacatgtaatcccagtactttgggaggccgaggcgggtggatcacctgaggtcaggggtttgagaccagccyggccaacatggcaaaaccccatctctactaaaaatacaaaaattagctgggcgtggtggcaggcacctgtaatcccagctactcaggaggctgaggcaggagaattgcttgaaccgtggaggcggaagttgcagttgaactgagattatgccactgcactccagcctgggtgacagagtgagactctgtctcaaaaaaaaaaaaaaaaaaagttagccagacagtcccagctactcaggaggctgaggctagaggatcacttgagtccaagagttcatgagcctgcagtgagctatgatt

SEQ ID NO: 70328 - DNA, 601 bp, Human
tctggggccctcatcattgtttgggtctccatctctttcctgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtgagcctggggcagggagaagagagraaggatggggagggagggatggctggcagggagagactgtgggccagatgaaataaaaagaccaaaacagaggcagacagagactccgctgccagtcagtgtcacaactagagaagagggaagagactggaaaacccagaagcagagaaatgaacacagaagctcaataaaccagcagcaagcaggagaggggcggggccaggggaaaggcgagaagaaggcaagaattcaagaagcagcgggcctgaactgggggccttccttcctcaacactctgcctcccttcctacaggtaccaat

SEQ ID NO: 70329 - DNA, 601 bp, Human; identical to SEQ ID NO: 21308

SEQ ID NO: 70330 - DNA, 601 bp, Human; identical to SEQ ID NO: 21309

SEQ ID NO: 70331 - DNA, 601 bp, Human; identical to SEQ ID NO: 21310

SEQ ID NO: 70332 - DNA, 601 bp, Human; identical to SEQ ID NO: 21311

SEQ ID NO: 70333 - DNA, 601 bp, Human; identical to SEQ ID NO: 21312

SEQ ID NO: 70334 - DNA, 601 bp, Human
acaccacatcacaatgcatttgtggatattttcctcgggattgctctgaaatcatttttcactgtaagccatcttggttactaggctgtaagctctttgagagcagcaaaatcctgtttgctttgccacagtctctcctgtatcattcttccctactcccctaccccacttctctctctctctctctctctctcacacacacacacacacacacacacacacacacactgtgagctctgcattgcccactgaatggtgagaaattcagaaggatgttgcattccctttgttttccctttcytccagctccaggccaggcttctgtcccttaggagacataatcccacctgggctgaagcaccccaggacgcaggcacttccctttacctgttcaggctacctttaccctctgttttcccaacacaggtagccacccagtaattactactagtcacagcaatataaaaactttattgagtgctttctatttgctacaacctattcccctgatggactgtcaaagctgtgggcagggattttgttctctgctgtaatcccagcacctatcacagtgtctagcccagagcgcacacttaataaa

SEQ ID NO: 70335 - DNA, 601 bp, Human
ttttctggagctgagcgcaggagctgagacctgctaagcaaggaaaggcagtggactaaggctcacctccttccccagttcctcctcctcccaactggtgctccaggacaccacatcacaatgcatttgtggatattttcctcgggattgctctgaaatcatttttcactgtaagccatcttggttactaggctgtaagctctttgagagcagcaaaatcctgtttgctttgccacagtctctcctgtatcattcttccctactcccctaccccacttctctctctctctctctctctcttacacacacacacacacacacacacacacacacactgtgagctctgcattgcccactgaatggtgagaaattcagaaggatgttgcattccctttgttttccctttcctccagctccaggccaggcttctgtcccttaggagacataatcccacctgggctgaagcaccccaggacgcaggcacttccctttacctgttcaggctacctttaccctctgttttcccaacacaggtagccacccagtaattactactagtcacagcaatataaaaactttattgagtgctttctatttgcta

SEQ ID NO: 70336 - DNA, 601 bp, Human
atccctgccgccatcccatgtgtcagttcatcttgcgaggcctccccctgtgatctctcagtcctctccgcattcctgggttgcctcacacctgggttattgcaagtgtcttctagcctctctcctgctcccatccgtcctacacactttttaaatcttcattcaggctttaacttgcacgcacaagtgtgtgaaccttcctctccatctccagggcctggctccaaacagcatttccatggtcatggaaatgatctgaagacttccacagatgcctcactacttttttttttttttttttgaaacagggtctcactctgtcacccagggtgaagtgcagtggcacaatcatagctcactgcaaccttcaccaccaggacggaatgtagtggtgtggtcagggctcactacaacctccacctcctgggcccaagccgtcctcccgagctcagtctcccgaatagctgggatgacaagcacgccccaccatgccccgctaatctttgtattttttgtagagacagggttttgctgtgttgcccaggctggtctcgaactcctggactcaagcaatccacacacctcggcctcctgaagtgct

SEQ ID NO: 70337 - DNA, 601 bp, Human
tctccttttgagaaccactgatgagtgaacacagtgtgtctgaatgatacaaaggcagaaagaagttgcagcacctctcctccagcttggtaggcgcacccttccacatgaccatttccctgacccttaacatgccccagacggaattcatccatctcctcacctagacaaatgacacaccatcgacttcccggacgaatgctgagaacttgccacgctctctccccagggccccatccctatccctgccgccatcccatgtgtcagttcatcttgcgaggcctccccctgtgatctctcrgtcctctccgcattcctgggttgcctcacacctgggttattgcaagtgtcttctagcctctctcctgctcccatccgtcctacacactttttaaatcttcattcaggctttaacttgcacgcacaagtgtgtgaaccttcctctccatctccagggcctggctccaaacagcatttccatggtcatggaaatgatctgaagacttccacagatgcctcactacttttttttttttttttttgaaacagggtctcactctgtcacccagggtgaagtgcagtggcacaatcatagctcact

SEQ ID NO: 70338 - DNA, 601 bp, Human
tgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtcctctcarctcccagaaccagacctccagactgggagcagataaatatggatcaactgatcgatctaatgatacatctgtcttccactctagtagaagccagtgattcccaaagagggaggtgaggagacagcacccctggtaggaatatatttatctccgggggagagttttcagaccatccccccacctccccacacacaagcacacacacccttacttaagagtctggtgtgctcctctccttttgagaaccactgatgagtgaacacagtgtgtctgaatgatacaaaggcagaaagaagttgc

SEQ ID NO: 70339 - DNA, 601 bp, Human
tttaatgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtccyctcagctcccagaaccagacctccagactgggagcagataaatatggatcaactgatcgatctaatgatacatctgtcttccactctagtagaagccagtgattcccaaagagggaggtgaggagacagcacccctggtaggaatatatttatctccgggggagagttttcagaccatccccccacctccccacacacaagcacacacacccttacttaagagtctggtgtgctcctctccttttgagaaccactgatgagtgaacacagtgtgtctgaatgatacaaaggcagaaagaa

SEQ ID NO: 70340 - DNA, 601 bp, Human
acaggggaagccacacacagaaacacaacagcagcccccgcaggtggaggcgtgtgcccctgctcagaggacaacaaccttcccctgcccgcaccagccaacaccgtgccacctctgctgagaacaggactggggcttccagggcaacaggaagggtttggggtggtgatgggaagaacttcccagtcctgaaagtgtggttcctttccccgaagaagccactggagcacctaaggtcactggtactttgaatcccatccagggggcttgaggcagagtcatgatgaagaactgggggacsccagccccagacagccttaaagggagcttttcagggacctctggccagtgggggatgagcctccctggagggagggagggagagaggctttctcaggccacgtgttcccttctctttccagcactctgggggttaagtcagatccgggaaagggaaatcttttcccagcaactccgccccagtgactcaggccagagggagggagacctagggaggggagagggaactagcagcttccccagctcctcaagggtcatgagtcagcagaaaggcagaaggcaccagcctgcatgcaagtgg

SEQ ID NO: 70341 - DNA, 601 bp, Human
acttcttcagatttgaagagcaaggggaaggactgcctggtgtcttaacgaagtgtctcctactcagccagtaggaccctgagcactctggggcatcctggcatctgttgcccagctaatggttcccaccagtcacccgtcccaacccatgccaccatccagtgcccagcagctctcagagatactcacttactacaggagacacactcgttttctcttagaaagaaacctgcatggcaggtgcacacggtgttctgtttctcctggcctgtagggagaagtgcggcacagctaaaggagragcgcctgcacccccaccccacaggacagaggaagtgacgagggacagggtgggggcggccagagaggagttggttgtcagacccacagaatacaggagggggaaggaaaggaagtgccaccgcatggggaaggggccaacccctggggtggggagagggcttggcctcaggagagctgcgctcacaggagaggtgcacggtcccattgaggcagaggctgcaattgaagcactggaaaaggttttcactccaataatgccggtactggttcttcctgcagccacacacggtgtcccggt

SEQ ID NO: 70342 - DNA, 601 bp, Human
tcccagctacttgggaggctgaagcaggagaattgcttgaatctgggaggcagaggttgcagtgagccgagatcgcgccactgcattccagcctgggcgacagagcaggactctgtgtcaaaaaaaaaaaaaaaaaaaaaaaagaagattaatggaaaataaatagttttgtgtcagacgtgttgtaggttttgtttgtttctttgtttttggttctcacaaattcaccaaatgaatgtcattatgcttactttaaatataagaaatctaaggcccaggccaggcgtggtggctcatgccsgtaatcctagcactttgggaggctgaggcggaagatcgcttgagcccaggagtccgaggccagcctgggcaatatagtaggaccctgtctctacaaaaagtaaaacattagctgggtgtagtggtgtgtgcctctaatcccagctactcaggaggctaaggcaagaggatggcttgagccctggaggtggaggctgagccacggttgcaccactgcactccagcctgggtgacagagtgaaaccctgtctcaaaaaaaaaaaaaaaaaaaaaacaccaaaagaaaagtcaggctcagaga

SEQ ID NO: 70343 - DNA, 601 bp, Human
ccatgtcctccctcacccccaccagctccctctccctcccaaagcccccactcaccaatggagtagagcttggacttccaccgttggtagcgatacattaaaccaatgaagaggagggataaaaggcaaagaccaaagaaaatgaccaggggcaacagcactgtggtgcctgcagacaaagcaggtgttggtcagaggagcgggcagaggggggccgcagggatagatggatgggtgggatggatggacgggtgggggcaagaagagggagagggcaggtgagcatgggcaccaggtcacytctcctcacctgagtcctcagtgcccttaacattctcaatctggggtaggcacaacttcgtgcactccaggcttttcttacagctaaaagaagagacggcactggtgaacagaggccctaccattggaggaacacagaaaaacaaccacacagattgttggacatcctttctttacaaatatttttgctgtctcttgatataatttgttttgggaactgatgcagaagaatgaaacacagttaatcatagaatcatttaattttagaattggcagggatcttgaaaaggctgtgtagaaa

SEQ ID NO: 70344 - DNA, 601 bp, Human
tggagtgggactgaagcttgggtttggggccaggggcttagtagtagttccttcaagctccccctgaaagagagaaggtggcgcagcattagtgcggcagcgaaaaccagccccggccctctttattctacgtgggggttgggacttagagggaatgaggcgagcccccggaaagtgaaggatgattccaggggatctgagcattaggcaattataaggaatggtcagggacatttgggagtaactctctcatttcatctcacctctttttcaggtgtcgatttcccacaaactgaggaaraagaaagaaagcatcataaatttcacttcctctctcagccctggcaccctggactcagctggcagtggggacttgtggtgacatgcctcagggcctatgtggccccagggacgagagagctactgatgcagctcgacatctccccagccatccagggccaccttctgcccagagtccccagcggtatgaactgaggggacactcctcacctccctccacacatgtccatcgcacccacccatgtcctccctcacccccaccagctccctctccctcccaaagcccccactcaccaatgga

SEQ ID NO: 70345 - DNA, 601 bp, Human; identical to SEQ ID NO: 21433

SEQ ID NO: 70346 - DNA, 601 bp, Human; identical to SEQ ID NO: 21434

SEQ ID NO: 70347 - DNA, 601 bp, Human; identical to SEQ ID NO: 21435

SEQ ID NO: 70348 - DNA, 601 bp, Human; identical to SEQ ID NO: 21436

SEQ ID NO: 70349 - DNA, 601 bp, Human; identical to SEQ ID NO: 21437

SEQ ID NO: 70350 - DNA, 601 bp, Human; identical to SEQ ID NO: 21438

SEQ ID NO: 70351 - DNA, 601 bp, Human; identical to SEQ ID NO: 21439

SEQ ID NO: 70352 - DNA, 601 bp, Human; identical to SEQ ID NO: 21440

SEQ ID NO: 70353 - DNA, 601 bp, Human; identical to SEQ ID NO: 21441

SEQ ID NO: 70354 - DNA, 601 bp, Human; identical to SEQ ID NO: 21442

SEQ ID NO: 70355 - DNA, 601 bp, Human; identical to SEQ ID NO: 21443

SEQ ID NO: 70356 - DNA, 601 bp, Human; identical to SEQ ID NO: 21444

SEQ ID NO: 70357 - DNA, 601 bp, Human; identical to SEQ ID NO: 21445

SEQ ID NO: 70358 - DNA, 601 bp, Human; identical to SEQ ID NO: 21446

SEQ ID NO: 70359 - DNA, 601 bp, Human; identical to SEQ ID NO: 25130

SEQ ID NO: 70360 - DNA, 601 bp, Human; identical to SEQ ID NO: 25131

SEQ ID NO: 70361 - DNA, 601 bp, Human; identical to SEQ ID NO: 25132

SEQ ID NO: 70362 - DNA, 601 bp, Human; identical to SEQ ID NO: 25133

SEQ ID NO: 70363 - DNA, 601 bp, Human; identical to SEQ ID NO: 25134

SEQ ID NO: 70364 - DNA, 601 bp, Human
tctcagggatcgaggcaggggaccgggcatccgggtcaggttgttgtggtccaggtacagcctctccaggtgcctcagcttggagaagaccttcctgcccaccttatcactggtgatctggttgccgtggagagcaatccagagcagccctgtggcattgtcaaagacgccttcctggatggaggtgatctggttgttctggaagtacacatacttcatgcgggagggaacgaagggcaggtacttgaggttgcgattgtcacagtacatggccgtggggaagttgggtgggcagtcgcaytcctgggggcagtcgcggggatctggaggggatggagagccgtaggtgtaggctggcccttcatccaccccataggggtaaggctcgtaggtctcatacgggtaagggtcatagggatcgtagtaggtggactgctggctgcggaggtagtggaaccaccaatgagggtcatcttcatactgggcctgggagagggagaagagccctgccagcagcaggagggaggtccactgcattttgtctctgcaagaagcgggagagaacagagcaagccagcatgagtgagactccacagaggca

SEQ ID NO: 70365 - DNA, 601 bp, Human
caatccccaccttgggaataaaaagaccccaaagaaagagagattttaataaaaaagagtttaggccgtacatgatggtgtcaggcacttcaaactaaaggtgccagacagatgcctctttgccttgcccacccgactgtcaactcccaaattgccctctggggctggtgcctctctcactcagagggctgcccagcttgttaacatcttgctcaatgactgatctgttccctgagcacaggggagaaaggaatgagagggagagggtgacgactctgttcttctcagcgctttgatggtrcggttctatctcagcaggctccacttcaaagccctttgccagtggtcgttaatgagtcctcccttctccagatggaagaggactttgctgacaggaagggaggtcaagtgctggctcagtaccttccagctgggattaagacatcagaagccctggggtaatgtaagcatgttctgaatactagatcctaagactaaagggagctgaaaatcagctagataattccatctgaaatgaatatttcttagagtcagggaggcagccttttttttttttcctttgggcattgcaaggaagtgc

SEQ ID NO: 70366 - DNA, 601 bp, Human
aaaaaaaaaagacgtcttagaggacccctcaatccccaccttgggaataaaaagaccccaaagaaagagagattttaataaaaaagagtttaggccgtacatgatggtgtcaggcacttcaaactaaaggtgccagacagatgcctctttgccttgcccacccgactgtcaactcccaaattgccctctggggctggtgcctctctcactcagagggctgcccagcttgttaacatcttgctcaatgactgatctgttccctgagcacaggggagaaaggaatgagagggagagggtgacractctgttcttctcagcgctttgatggtgcggttctatctcagcaggctccacttcaaagccctttgccagtggtcgttaatgagtcctcccttctccagatggaagaggactttgctgacaggaagggaggtcaagtgctggctcagtaccttccagctgggattaagacatcagaagccctggggtaatgtaagcatgttctgaatactagatcctaagactaaagggagctgaaaatcagctagataattccatctgaaatgaatatttcttagagtcagggaggcagccttttttt

SEQ ID NO: 70367 - DNA, 601 bp, Human
ggggtttgaatgaagttacccattgggtcttgagggtaggattgtccatggacacatccctagcagctgtaatacttgggtagacccagagctggggcttgctgttgtaccagaggcatccatcggcttgcagcagtggtcaggaggtgcgtcagtctggggccaggcacgaggagtgggggcagggggtgcttttctaactctattcttaggtgtgaccatgagggctccccttgggagaggttataggtatgaagaagacagttccaagaaagacagcatggagagcttaaagaggctratgaaaaaagtgtttttaaattagcattttcaatggttttcagtctctgttaagcactgaccaagataagatgaggtgaggttgcagcaaattaacttgtattgcaggcataacacagaaaatctaggcctaaagaaaattagacactgagaaaagtagcggaaactgggaaatactcgtctttggaaaacactcctggtggggtagaatttctggaatacttttggatgtttcctttctggtcccaaggactagattaagtggcctctgagtgagcaggttgggggcagagcctagacc

SEQ ID NO: 70368 - DNA, 601 bp, Human
agctaaaacttcaggagagacggcaaaagtcaccattgaaagctgaggaagcctcgtagggctgtctttaccatggtgaatgaggctttcaggaaacttgctcctgttgtcattctctgcaaagggggtttgaatgaagttacccattgggtcttgagggtaggattgtccatggacacatccctagcagctgtaatacttgggtagacccagagctggggcttgctgttgtaccagaggcatccatcggcttgcagcagtggtcaggaggtgcgtcagtctggggccaggcacgaggagygggggcagggggtgcttttctaactctattcttaggtgtgaccatgagggctccccttgggagaggttataggtatgaagaagacagttccaagaaagacagcatggagagcttaaagaggctaatgaaaaaagtgtttttaaattagcattttcaatggttttcagtctctgttaagcactgaccaagataagatgaggtgaggttgcagcaaattaacttgtattgcaggcataacacagaaaatctaggcctaaagaaaattagacactgagaaaagtagcggaaactgggaaatac

SEQ ID NO: 70369 - DNA, 601 bp, Human
agaactcagctaaaacttcaggagagacggcaaaagtcaccattgaaagctgaggaagcctcgtagggctgtctttaccatggtgaatgaggctttcaggaaacttgctcctgttgtcattctctgcaaagggggtttgaatgaagttacccattgggtcttgagggtaggattgtccatggacacatccctagcagctgtaatacttgggtagacccagagctggggcttgctgttgtaccagaggcatccatcggcttgcagcagtggtcaggaggtgcgtcagtctggggccaggcasgaggagtgggggcagggggtgcttttctaactctattcttaggtgtgaccatgagggctccccttgggagaggttataggtatgaagaagacagttccaagaaagacagcatggagagcttaaagaggctaatgaaaaaagtgtttttaaattagcattttcaatggttttcagtctctgttaagcactgaccaagataagatgaggtgaggttgcagcaaattaacttgtattgcaggcataacacagaaaatctaggcctaaagaaaattagacactgagaaaagtagcggaaactgg

SEQ ID NO: 70370 - DNA, 601 bp, Human
ggacaagaggagcacgggtcagggagagaagcccagattacgaacctgaagccacagtgagattagcctttgtgaagcagcttagataaaggggtggaagttggggatggagggcagatgttttccaggattggagtcatacttactggcgccactaggggcagaactagggacagagtgaggactgtgcctgcgtctgcagctcacctcctaaccaccaacctgaactttactctgcaggcccaggaatgttcttaagcgtccttccctctgggacatttttttttttttagcaggatargggggcaggtgggcagctgtgggcagcagtgggaagcagagggtagccaaagaccaaccgtagacaccttgaaatacttgattgtttttggagagggagggctttgctgaattgctgtgagaaagaagactggggaaatggagggacttaatactttacagatagaaaaagtggcaggaaattaaagagagaaagcctgggccgagagacaagtgtctttgtgtgccagggctttgagtgggttgcacgtctccattctaaatactgccagagcagtgagcaaggctctgagtttaaagg

SEQ ID NO: 70371 - DNA, 601 bp, Human
ctgctgatggagaactctgtggggacaagaggagcacgggtcagggagagaagcccagattacgaacctgaagccacagtgagattagcctttgtgaagcagcttagataaaggggtggaagttggggatggagggcagatgttttccaggattggagtcatacttactggcgccactaggggcagaactagggacagagtgaggactgtgcctgcgtctgcagctcacctcctaaccaccaacctgaactttactctgcaggcccaggaatgttcttaagcgtccttccctctgggacatttttttttttttagcaggataggggggcaggtgggcagctgtgggcagcagtgggaagcagagggtagccaaagaccaaccgtagacaccttgaaatacttgattgtttttggagagggagggctttgctgaattgctgtgagaaagaagactggggaaatggagggacttaatactttacagatagaaaaagtggcaggaaattaaagagagaaagcctgggccgagagacaagtgtctttgtgtgccagggctttgagtgggttgcacgtctccattctaaatactgccagagcagtg

SEQ ID NO: 70372 - DNA, 601 bp, Human
ttcttcattatttagggcttcactgggtaggagggagagaaaaacggctttttccaacctgcacagtgtcttctcagcagctttcaatttctgtctcactggtccaaaccacttggcttttggaaagaaagaagaaagcgacccagttcccaatccttgaaggtcctaattcccagctctggggacagttcatttttttatttttttttcctgcaggcagccagaaaaatatttttctttaaagccgttctgaaattattccaaccatttaggttggcaaaaggtcctgtggcagaggagaaaaaaaaaaaaaggcagcagttccttaagcagttggggaggggaaaactgaagggcggcccctctcctgctcccctgctcattcctctctattaatagagagggtctgtcccaaggcaggcggggtgtagggagatcaggggtcccacacacagctgatcttcacagtcacctaagggctggagagggaggagtgtggagggcttactaaaaatacagatgtcggctctcactgcagatctactgaatcgagacccaggaatcttgttttaatacttcaggagattctgatggtccacca

SEQ ID NO: 70373 - DNA, 601 bp, Human
ggccagtgtcccctcacctgttgcagaaagcatcggtgagaagttggtgaattagaaagacagaacaagctttccctaggtggctggggacttccagagtctcctcagttagttgtttctgagacccaagtgtgatctcacaagccacaaaggggaggaagttgctctgtgtggaagagctggtaccccactcacaaggatccctgccttcgagcagtgcatgggggctgccctctagccaggctggagggaaggagaccccattactttgaaataatatcaacaagaccttaacattcasaaaacactcactttgcatgtattaactcatttaaccctcaaaacagaaaagaaggtgttagtatccccattttatagagcagaaaagcaattgctttgcctaagcctacctagctaagcatctgaatgaagaactgcaggattgggtctcagatctataatcactcaaggcatcagacacactcttctaggctttcttcaaggcttggagatgctgggggaatggggcagaggatatggtaggtggcgggctgtcagagaagagtcgtctcaccctggtttcttccccaccgctcagaat

SEQ ID NO: 70374 - DNA, 601 bp, Human
ttaaaaatcaaggagtccttggggcgctgtggctcatgcctgtaatcccagcactttgggagactgaggaggacagatcacttgagctcaggggttggagaccagcctgggcaacatggtaaaaccccatctctacaaaaaagacaaaaattagccagctgtggtagcacatgcctatagtactagctgctcaggacgctgagatggaaggatcacctgagcccagggaggttaaggctgcagtgagctgtgattgcactactgcactctagcctggtcaacaaagggagaccctgtatcmccaaaaaaaaaaaaaaaaaaaaaaaaaaaaaatcaaggagtctctctagagaatctgctgtttataaacaaataaatgagtaagtaagcctctgccacttgcagagattttgcactttataacatgccttcaaatgcatgatctcatttgatcctcacacagatgaggagcccgggttggagagtcagagccaggagtcaagcccagatccacaatagttggaattgaaattagaatttaaaactctcttagaggctgggtgcagtggctcacacctgtaatctcagcaatttgaaaggc

SEQ ID NO: 70375 - DNA, 601 bp, Human
gggtgcagtggctcacacctgtaatctcagcaatttgaaaggccgaggtgggaggattgcttgagcttaggagttcaagaccagcctgagcaatacagtgagacccccatctcatttttgtttaaagtgaaaaaagaaaaaaaaattaagattctcttaggaaacgttctttaatgtggagagtgaatgttgggttgggcaaagcaattgcctttctcttccgtgaagcagcagcttttccagaactgatggtggagagcagaactgcatgcagttggctgttgtaggtggtcaacaaacyttcactgattgagcaatgagcagagcccagtagaaagctgtgggtggagaagtgcacttgtgaaagcataagaaaaatttaaaaacacacacatggacccatcctaaggaatcttatgattggacagaagtttctagaaggcaggagcatagagtgtgggtctgaggctttgtaggagggactatgactacccatggagtccaggtaccctcagtctgtcacacagattctggtttcagagacctaggacatcacggagcactgccagagagaatggctgtgctgtcagctgtcagaact

SEQ ID NO: 70376 - DNA, 601 bp, Human
agcaggctcagcttccccacataacttgctcctgggagcatttcctggggaacctcctgttggctctgggagcagcttggctaggcccagaggtttggaatgtaaacgggtcagaggactagtgaaaagataagttcccaaagggtctggtgctgcacatggggatgaggaaggcctgtgtttactgtggatgagaaggcgcgcacagccagcctgctgggtggagctgtgagtaacctgcctgttcctctcacccctgacaatgaagaccagggctgccctggcactgagccaaggaaaccccgccccgcccagcacaggtcacagccacagtgcctcactgcttttgctggaagccctgggcaaattggtgcccagtccctggcatatgctttcggtgacaaaggcaatgaagggatatagaaaaactcccgccagtgctgggagcctccttgggacagggcttctcacagtatgaaagatttctagatcatttctaggcttctgggtgattagaaaataaatttttttttttaaatcagggtcacaaaaattgaggcttttagaaatgtttgttttagaataccaatgctttaactac

SEQ ID NO: 70377 - DNA, 601 bp, Human
ccaccttagagggaggtggagaaagacagtctctgccttccttcccttccgccttccttctttccttccaatactcagtgtactgcgtatgggctcatatacgcacacagaggataagtgagtgagtttgcttatgtgcatgggacctgaagaggtgtgtgtgtgagtgtgcagactggatctgctgttaaacagcatcttggccttggcgagccacttcttccttccagtcctcagtttttgcaaatggtggggtctggagttgattggtggatttcaagccatttttagcaaagaaacrtgtcccctgcccctcaacaaatgaatgcttcggctaaacctcaatatatataataggtttttttaaagagagctgctgaggttggcacagggatgggttgagggtaccccagggccatctcctcagtctcctccccacaggggtatgtcacagaaatgaaagcagagttggaaaaccactaggttataggatctttaaggacctttctggatttaaccaggacgctaaggttcatacatcctaacatccctctcatgaagacactgatgattttctcatgctgtgaatgggaggactgag

SEQ ID NO: 70378 - DNA, 601 bp, Human
ctgtataattttaccctggagacagcacactaaaataaaacacattacccccaggaagctatgaggccaaaatacagacagaagggataccttgattaataaatggctgataggtctctaccagattgtggaagaacaggttgctggaggatatcccaaccttctaaggttgaagtcagagaactcacacctcacccacatgagcccaccccatccagcctgtctcctgtgccttttacccgacagaatgggctgagtggggcctaggtcagtggggtgattacgttcttcacaatgaccrtaatgctgccactggtactgtctttaaacagcttacaaaatgcctttgccaacattctctcccctgattacagggcaggcaccactcttaccatttcacagattgaagaactcagcatgagggtggctaggccacagccccaagctcataagagaaaacccccgtgtcagggcccttctgctactccaatggcaaagaagaaagacgaggaaaaggaagaggaagacaattacaatgaagatgatgcctactcttcctcctcctgctcctccataaatgataagtgaggcaaggcttagg

SEQ ID NO: 70379 - DNA, 601 bp, Human
agcacactaaaataaaacacattacccccaggaagctatgaggccaaaatacagacagaagggataccttgattaataaatggctgataggtctctaccagattgtggaagaacaggttgctggaggatatcccaaccttctaaggttgaagtcagagaactcacacctcacccacatgagcccaccccatccagcctgtctcctgtgccttttacccgacagaatgggctgagtggggcctaggtcagtggggtgattacgttcttcacaatgaccataatgctgccactggtactgtcyttaaacagcttacaaaatgcctttgccaacattctctcccctgattacagggcaggcaccactcttaccatttcacagattgaagaactcagcatgagggtggctaggccacagccccaagctcataagagaaaacccccgtgtcagggcccttctgctactccaatggcaaagaagaaagacgaggaaaaggaagaggaagacaattacaatgaagatgatgcctactcttcctcctcctgctcctccataaatgataagtgaggcaaggcttagggagaataaaacagttcatttaaa

SEQ ID NO: 70380 - DNA, 601 bp, Human
accagtcgcagccaacctggccaacaagaggagtcctggggctccacctgacgccatgggccctggggtgctgttaaaagcgctgttggtctgagtgctttccctggtgccgttgcacagggattcactgttccaaacagcccgtccaacctactctacagatgggactcccaagacactacggggatcccctgtgtgccaagtcccgggggaagctgctagagaaggctgggacgtccttgctcacctctggcagggacagatcagagtcctctgtgtgacactctgtgtccccagttgrggaaggcggaaggagctgcgggctcctttggtattctaggctggagagccacctggctaggtgggaccctggacactcagcccatctgctcctctggtcctacaagccgcccaccctccgagaacccccgcctataatgcagtttacccctccccgtgccagcacgcagagttcctggcctctcaccggggaaagctctgccccgttcctccggagcccagtgcgcccctggccaagttctcccagcgtccactctagggcctgctagcaccctctcgggcggcgcgccctctgcgtacc

SEQ ID NO: 70381 - DNA, 601 bp, Human
agggtttcaggggattccagatcttgattaagggccctgctgcagctgagggctttagaggaagacagacctcaactcaggacaagagttggaggcagggtttgagtttaggacaattgactaccagtttgcctccggagagattattctggggccagaataatctgctggtgaaccgtgccttaccctaaaatagatccattccaatctagtcaggactttaaaagtgccataataccttgcctggatttacagcaggtttcaggaaagtacagtattcccctgtttgtttgtttgtttgttttagatggagtcttactctgtcacccaggctggagtgatcgccacctctcagtttcaagcgattctcctgccccagcctcctgagtacctgggattacaggcacctggctaccacacccagctaatttttgtatttttagtagagacagggtttcaccatgttggccaggctgctctcgaactcctgacctaaagtgatccgactgcctcggtctcccaaattgctgagattacaggtgtgagccaccgcagccggtccctgactcctgttttagtacagctcctgggctacaaacgg

SEQ ID NO: 70382 - DNA, 601 bp, Human
aagcaattctatctcagcctcccaagtagctgggattacaggtgcccaccaccacgcccggctaatttttatatttttagtagagatggggtttcaccatgttagccaatctggtctgaaacttctgacctcaggtgatccacccaccttggcctaccaaagtgctgggatcacaggcgtgagcccccacgcctggcctcactcaacattatttttaagacctcatcagttgatatccccatgaagtcctctcctcttcaattcagtttccttgaggaattgagaatgccagatatgaacratttattaccgttttgtctttttgtttgctgtccctattgtttttatacccatgggttcaggttcagattgaatgagaggaaagaggttcccccttgccttcaggggctctctcccagttttagcaaagaggacacttggaaataaaaggtctgtaaatggatttccagaacactctctgccggcatcacttgaaatatcttcgtgtttccccaaggatccatacctccagtgtgaagatcactaccacacagcatttagatctccgtttttgggtctcgaacctgttccagagaccaat

SEQ ID NO: 70383 - DNA, 601 bp, Human
tgcatctcttaatgtgataaacagtactctactgcccatcccccgcaatggatttatattttcatgagtgaatattgtttggttgagaaaaggttcagcattatttctgctcttatttttgtttcttataggtcaaagggctgggaaaccctgctcaaataagcagctgggaatggaggcagtttttaagagcaatgccacttaattcttcgcactcctttctgtgcatccaatcccatggtgctctatcactcagccctccctccctccctttctttccttcttttttttttttttttttgagaaggagtctggctctgttgcccaggctggagggcagtggcacgatatcagctcactgcaacctccacctccctggttcaagcaattctatctcagcctcccaagtagctgggattacaggtgcccaccaccacgcccggctaatttttatatttttagtagagatggggtttcaccatgttagccaatctggtctgaaacttctgacctcaggtgatccacccaccttggcctaccaaagtgctgggatcacaggcgtgagcccccacgcctggcctcactcaacattatttttaag

SEQ ID NO: 70384 - DNA, 601 bp, Human
gtaatcataattattattagtgtcccaactgattaaaacatttcaaatgtattatacattatgaaaagtaattgttaaacatcaaaagtaaaattgtatcagaaatgcatctcttaatgtgataaacagtactctactgcccatcccccgcaatggatttatattttcatgagtgaatattgtttggttgagaaaaggttcagcattatttctgctcttatttttgtttcttataggtcaaagggctgggaaaccctgctcaaataagcagctgggaatggaggcagtttttaagagcaaygccacttaattcttcgcactcctttctgtgcatccaatcccatggtgctctatcactcagccctccctccctccctttctttccttcttttttttttttttttttgagaaggagtctggctctgttgcccaggctggagggcagtggcacgatatcagctcactgcaacctccacctccctggttcaagcaattctatctcagcctcccaagtagctgggattacaggtgcccaccaccacgcccggctaatttttatatttttagtagagatggggtttcaccatgttagccaatctgg

SEQ ID NO: 70385 - DNA, 601 bp, Human
gccgagatcacgccactgcactccagcctgggcgacagagcgagactccgtctcaaaaaaaaaaaaaaaaatttattctggattgagtaatcataattattattagtgtcccaactgattaaaacatttcaaatgtattatacattatgaaaagtaattgttaaacatcaaaagtaaaattgtatcagaaatgcatctcttaatgtgataaacagtactctactgcccatcccccgcaatggatttatattttcatgagtgaatattgtttggttgagaaaaggttcagcattatttctgstcttatttttgtttcttataggtcaaagggctgggaaaccctgctcaaataagcagctgggaatggaggcagtttttaagagcaatgccacttaattcttcgcactcctttctgtgcatccaatcccatggtgctctatcactcagccctccctccctccctttctttccttcttttttttttttttttttgagaaggagtctggctctgttgcccaggctggagggcagtggcacgatatcagctcactgcaacctccacctccctggttcaagcaattctatctcagcctcccaagta

SEQ ID NO: 70386 - DNA, 601 bp, Human
cagtgagccgagatcacgccactgcactccagcctgggcgacagagcgagactccgtctcaaaaaaaaaaaaaaaaatttattctggattgagtaatcataattattattagtgtcccaactgattaaaacatttcaaatgtattatacattatgaaaagtaattgttaaacatcaaaagtaaaattgtatcagaaatgcatctcttaatgtgataaacagtactctactgcccatcccccgcaatggatttatattttcatgagtgaatattgtttggttgagaaaaggttcagcattawttctgctcttatttttgtttcttataggtcaaagggctgggaaaccctgctcaaataagcagctgggaatggaggcagtttttaagagcaatgccacttaattcttcgcactcctttctgtgcatccaatcccatggtgctctatcactcagccctccctccctccctttctttccttcttttttttttttttttttgagaaggagtctggctctgttgcccaggctggagggcagtggcacgatatcagctcactgcaacctccacctccctggttcaagcaattctatctcagcctcc

SEQ ID NO: 70387 - DNA, 601 bp, Human
actaaaaatacaaaaaacaaattagccgggcgtggtggcgggcgcctgcagtcccagctactcaggaggctgaggcaggagaatggcgtgaacccgggaggcggggcttgcagtgagccgagatcacgccactgcactccagcctgggcgacagagcgagactccgtctcaaaaaaaaaaaaaaaaatttattctggattgagtaatcataattattattagtgtcccaactgattaaaacatttcaaatgtattatacattatgaaaagtaattgttaaacatcaaaagtaaaattgtaycagaaatgcatctcttaatgtgataaacagtactctactgcccatcccccgcaatggatttatattttcatgagtgaatattgtttggttgagaaaaggttcagcattatttctgctcttatttttgtttcttataggtcaaagggctgggaaaccctgctcaaataagcagctgggaatggaggcagtttttaagagcaatgccacttaattcttcgcactcctttctgtgcatccaatcccatggtgctctatcactcagccctccctccctccctttctttccttcttttttttttt

SEQ ID NO: 70388 - DNA, 601 bp, Human
ttttaaagctagccagtggaatctaaataccatgatgatttgatatccaccatcagtaacatgaacaaacttttctataagagtcaggtatttaggcggggtgtggtggctcacgcctgtaatcccagcactttgggaggccaaggtgggcagatcacctgaggtcaggagctcatgaccaacttggccaacatggcaaaaccccagctccactaaaaatacaaaaattagctgggcatggtggcaggcgcctgtaatcccagctactcaggaggctgaggcaggaggatcgcttgaaccygagaggcggaggctgctgtgagccgagattgtgccactgcaccccagcctgggtgacaagagcgaaactccatctcaaataaagaaaacaaaacaaaaaagagtcagatattatacagagtttctttttcttgttgaacacctatctccatccccacctggcagaattttatcctaagggaacatacatttttatgcttgatcaccttcacattcttttctgcaacaacaacaaaaagtttaaatttaaattatttattttggctgggcgccgtggctcatgcctgtaatcccagcactt

SEQ ID NO: 70389 - DNA, 601 bp, Human
atacctccaaagacatattccaacttataaatattgagatttaaaaataacacctggcagtgtggcccaagcctataatctcagtactttgggaggctgacacaggcgaatcccttgagcctaggagtttgggaccagtctgggcaacaaagtgagacctcgtctctacaaaaaaataaaaaaaattagacgggagaatcacttgagcctgggaggttgaggctgcaatgagctatgatagcgccactgcattcctgcctgggtgacaggagtgagaccttgtctcaaaaaaaaaaaaaaatctctaaaaataagattgttatatcattcttttaaagctagccagtggaatctaaataccatgatgatttgatatccaccatcagtaacatgaacaaacttttctataagagtcaggtatttaggcggggtgtggtggctcacgcctgtaatcccagcactttgggaggccaaggtgggcagatcacctgaggtcaggagctcatgaccaacttggccaacatggcaaaaccccagctccactaaaaatacaaaaattagctgggcatggtggcaggcgcctgtaatcccagctactcag

SEQ ID NO: 70390 - DNA, 601 bp, Human
taggactgcgttcccgcaagacttcacaaaaacgaaacctcacatgtacccccaaatatgtacagatattatcaaaaacataataaaacaaacaagacaaaatattttacaaaagcaggccagccatttgtttttggattcctgccgtatttccccatgtatgttcttatctaaacatttcattttaaatttgaatacctccaaagacatattccaacttataaatattgagatttaaaaataacacctggcagtgtggcccaagcctataatctcagtactttgggaggctgacacaggygaatcccttgagcctaggagtttgggaccagtctgggcaacaaagtgagacctcgtctctacaaaaaaataaaaaaaattagacgggagaatcacttgagcctgggaggttgaggctgcaatgagctatgatagcgccactgcattcctgcctgggtgacaggagtgagaccttgtctcaaaaaaaaaaaaaaatctctaaaaataagattgttatatcattcttttaaagctagccagtggaatctaaataccatgatgatttgatatccaccatcagtaacatgaacaaacttttcta

SEQ ID NO: 70391 - DNA, 601 bp, Human
aacaacaacaacaaaaaacaaacctatctattccaagggcaagcactgtttttccttatggggacaggtagtaaatatttcaggctttgccgtctatatggtctctgccacaactactcaactctgcccctgcggctcagagacagccacagagactgtgaacattaatgggtaggactgcgttcccgcaagacttcacaaaaacgaaacctcacatgtacccccaaatatgtacagatattatcaaaaacataataaaacaaacaagacaaaatattttacaaaagcaggccagccatttgtttttggattcctgccgtatttccccatgtatgttcttatctaaacatttcattttaaatttgaatacctccaaagacatattccaacttataaatattgagatttaaaaataacacctggcagtgtggcccaagcctataatctcagtactttgggaggctgacacaggcgaatcccttgagcctaggagtttgggaccagtctgggcaacaaagtgagacctcgtctctacaaaaaaataaaaaaaattagacgggagaatcacttgagcctgggaggttgaggctgcaatgagcta

SEQ ID NO: 70392 - DNA, 601 bp, Human
ttaactgcatctttcccagtgtttggccagttcaacttctggaaagaccccactaggcaaagttggaaattccctttttcattgtctcaaatctgggacagtttggtttgataacaggaaactttgtgaaatgaaaaacttcaaaaagaagaagttgggcactgaccttagacatccatgacttgaagtgaaacttctctgtaaaaagaaaaaaaaaattaggtctgggcgcatcacagtaatgttgagtctatagcaaagtagggcactttagaactgatttgcattttcgaaaactggrctaaatttaaaacaccaaaaatggtgttatataatgcagaatgcaaaaagaaactccgactcttcctggttttgtaccccaaattaatgtgaaaaagtatatactattagtcaatggtgttgaaagtcaggatggtggttatgcctactgggtcggggtgcagaaagcacttccgggatgctgctcatatcctgtttcttcaactgggcgctggttaactgagtgtgtttagattgagaaaattcgtggaaatgcatactcaatgatttgtgcccctttctgtatgaagttatatttcgg

SEQ ID NO: 70393 - DNA, 601 bp, Human
acaaaatacagaaatgaatcccagggcttggaaggctgtcagccaagttaatcacttgggaccactatttggaaggaatttacttaactgcatctttcccagtgtttggccagttcaacttctggaaagaccccactaggcaaagttggaaattccctttttcattgtctcaaatctgggacagtttggtttgataacaggaaactttgtgaaatgaaaaacttcaaaaagaagaagttgggcactgaccttagacatccatgacttgaagtgaaacttctctgtaaaaagaaaaaaaaaattaggtctgggcgcatcacagtaatgttgagtctatagcaaagtagggcactttagaactgatttgcattttcgaaaactggactaaatttaaaacaccaaaaatggtgttatataatgcagaatgcaaaaagaaactccgactcttcctggttttgtaccccaaattaatgtgaaaaagtatatactattagtcaatggtgttgaaagtcaggatggtggttatgcctactgggtcggggtgcagaaagcacttccgggatgctgctcatatcctgtttcttcaactgggcgctggtta

SEQ ID NO: 70394 - DNA, 601 bp, Human
caatgtgctttgaaaacaaaatacagaaatgaatcccagggcttggaaggctgtcagccaagttaatcacttgggaccactatttggaaggaatttacttaactgcatctttcccagtgtttggccagttcaacttctggaaagaccccactaggcaaagttggaaattccctttttcattgtctcaaatctgggacagtttggtttgataacaggaaactttgtgaaatgaaaaacttcaaaaagaagaagttgggcactgaccttagacatccatgacttgaagtgaaacttctctgtraaaagaaaaaaaaaattaggtctgggcgcatcacagtaatgttgagtctatagcaaagtagggcactttagaactgatttgcattttcgaaaactggactaaatttaaaacaccaaaaatggtgttatataatgcagaatgcaaaaagaaactccgactcttcctggttttgtaccccaaattaatgtgaaaaagtatatactattagtcaatggtgttgaaagtcaggatggtggttatgcctactgggtcggggtgcagaaagcacttccgggatgctgctcatatcctgtttcttca

SEQ ID NO: 70395 - DNA, 601 bp, Human
actgtttttttacaatggttgtactaatttacattctccacaatgtgctttgaaaacaaaatacagaaatgaatcccagggcttggaaggctgtcagccaagttaatcacttgggaccactatttggaaggaatttacttaactgcatctttcccagtgtttggccagttcaacttctggaaagaccccactaggcaaagttggaaattccctttttcattgtctcaaatctgggacagtttggtttgataacaggaaactttgtgaaatgaaaaacttcaaaaagaagaagttgggcacygaccttagacatccatgacttgaagtgaaacttctctgtaaaaagaaaaaaaaaattaggtctgggcgcatcacagtaatgttgagtctatagcaaagtagggcactttagaactgatttgcattttcgaaaactggactaaatttaaaacaccaaaaatggtgttatataatgcagaatgcaaaaagaaactccgactcttcctggttttgtaccccaaattaatgtgaaaaagtatatactattagtcaatggtgttgaaagtcaggatggtggttatgcctactgggtcggggtgca

SEQ ID NO: 70396 - DNA, 601 bp, Human
actaaacataatgacctccagttccatccatgttgctgcaaatgacagaatttcattctttgttatggctgaataatattccgttgtgtacatacaccacatttgctttacccattgataggcacttaggttgattccatatcttggctattgtgactagttctgcaataaacatgagggtgcagatatccctccaatatactaatttcctttcttttggatatatactcagtagtaggcttgctgggtcatatggtagttttgttttgagtttttgatggaacctccatactgtttttttacaatggttgtactaatttacattctccacaatgtgctttgaaaacaaaatacagaaatgaatcccagggcttggaaggctgtcagccaagttaatcacttgggaccactatttggaaggaatttacttaactgcatctttcccagtgtttggccagttcaacttctggaaagaccccactaggcaaagttggaaattccctttttcattgtctcaaatctgggacagtttggtttgataacaggaaactttgtgaaatgaaaaacttcaaaaagaagaagttgggcactgaccttagac

SEQ ID NO: 70397 - DNA, 601 bp, Human
ttttgggccaggtgcagtggctcacgcctgtaatcccagcactttgggaggctgaggcgggtggatcacctgaggtcaggagttcaagacccacctggccaacatggcgaacccccatctctactaaaaatacaaaaattagccgggcatggtggcagacacttgtaatcccagctactcaggaggctgaggcatgagaatcgcttgaacccagaaggtggaggttgcagtgagccgagagtgtgccactgcacttcagcctgggtgacaaagtgagactctgtctcaaaaaaaaaaaaaatattttgtactcaggaatcagtttatcttcatccctgcttccctgcccttcctagcttctgctagtcaccattctactgtctttcttcatcagatccacttttttatctcccacatacgagtgagaacatgtaatatttgcctttctatgcttggcttatttcactaaacataatgacctccagttccatccatgttgctgcaaatgacagaatttcattctttgttatggctgaataatattccgttgtgtacatacaccacatttgctttacccattgataggcacttaggttgattc

SEQ ID NO: 70398 - DNA, 601 bp, Human
aatacgctggacgtgcgtgtgagtttctttttttttttgagatggagtttcactcttgttgcccaggctggagtgcaatggcactatctcggctcaccgcaacctccacctcccgggatcaagtgattctcctgcctcagcctcccaaatagctgggattacagacatgcgccaccaagcccggctaattttgtatttttagtagagatggggtttctccatgttggttaggctggtcttgaactcccgacctcaggtgatccacccatctcggcctcccaaagtgctggaattacaggcrtgagccaccgcgcccggcctatgtgagtttctagtgaaattaatccggagtgaaggcagatgctcccaggggctgctctgagcccatgagcaacccctaccccccgcaacaatccaaagacagaccttggcttccaggctggaccctcagatggcaggaatggggcaggggcttctacagagtctcttgtaaacttcacaaccacccagaggggtaccggctttgtcccaaatttacgatcccacattacacagagagtaacagcggagccacaatctgaggtcagccaaacacagcttc

SEQ ID NO: 70399 - DNA, 601 bp, Human
tgcctttattaccaatttagtcaactaccaatatttctcagagtcctcagaaaatacgctggacgtgcgtgtgagtttctttttttttttgagatggagtttcactcttgttgcccaggctggagtgcaatggcactatctcggctcaccgcaacctccacctcccgggatcaagtgattctcctgcctcagcctcccaaatagctgggattacagacatgcgccaccaagcccggctaattttgtatttttagtagagatggggtttctccatgttggttaggctggtcttgaactcccracctcaggtgatccacccatctcggcctcccaaagtgctggaattacaggcgtgagccaccgcgcccggcctatgtgagtttctagtgaaattaatccggagtgaaggcagatgctcccaggggctgctctgagcccatgagcaacccctaccccccgcaacaatccaaagacagaccttggcttccaggctggaccctcagatggcaggaatggggcaggggcttctacagagtctcttgtaaacttcacaaccacccagaggggtaccggctttgtcccaaatttacgatcccacatt

SEQ ID NO: 70400 - DNA, 601 bp, Human
ggcctctcaccttgccaagccctctgtgccccacagcaagggccacggaggccagcccctgccatgagaagcttgctgatgcatgacacatggactaaccagagggaggcggccagccagggcaggggctggaccctggtggctcggagaagatggaggcgggaagaggagatgcatggggttctggtgtccagatgggcacagggaacataacgttttggatggctctgtaggagagacctgggaccaatgggaaaatctggggcgtggggaaggaagggagtaaactttagcccaatamagaggaacttttgcatcctccagagcagcctagagaagtgctgacctccctggcccctcaaaggaagagggctggagagatgccgagaggaaacagaggcagggatgtgcttgtggtggttttgtggaccttttgagttgttcttcctggtgtattgtctgggagtgtggccgttttgcagggagaggatggagattgccaggcatacctgatttttcacaggtgagacaaaatttccttttttccgccagtccacggaaggtgggtagggaccagtacctcgaaggtagttacttttgg

SEQ ID NO: 70401 - DNA, 601 bp, Human
ttaggtgtggggggctgcagcctgcctgcctggttcacatcccagctctgccacacaccaggtgggtgacctgggcaagtcacttcccctctcgaagccttggcttcattgcttgtaaagtgggaatggcgagggttcctgcttgcagggcgctagcagggttaagtcagattctgctggtcaggcagtcacccccgtgggcacaatgctggtggctgctgtaaggatttctctcaggttcatctctgtttcctcaccttgctggttcagtcttccagcttctacttctgaaatgtctcttaagtcccctacctgcctcccaggtcatcaccctaggttgacactggcctcacccaatctcttcccttcacatatctctctcagctgggggagggagggacggcctggtgagagggtccatgagacagtcaacgaggcagacgtggccacttcgggggagactaagctcactgctgaaggaggcggagctcggctgacccttgggtgctcgacttggggcaggggcctggttttgagtcccctttgtcacttacttaccttggacctcaggcaaaccaccctccctctcaggctctccctc

SEQ ID NO: 70402 - DNA, 601 bp, Human
aatgagcttgggaggctgggactttagtgagttcatctaaaggccaaccctgtatctgtgtgtggatctcgggtttggaggatgatgtgtaatggtgtgttgctcactctattaaattcttttggccacactcccagaggccttggtggcgggtgaggccaaccgcactgtggagagccaggtgatacagtggagagaggacagaggcctggactcagattccagctctgccctgtcctggctatgagacctggccatgtgaggtgaccacccctgtacaacagagaccattttgccatcrcccagggcagtggtgggttatatctgtggcagacccagcacacactggatcctgtcgaagcggtcagtgggaaatgaggaagttttgggccccttctggtcagagacgtacccttggcagccgtgattattgaagtcctgggcgcagtccaccagctgctgttccgcctggaagaaggacacaacccagtgacctgccagctgagaagccgtcaaggctttggcgtgaggcgctaagcctccctggctgagccacatctgaggccccgtcagtgctgtgtcaaggtgaccaaattataaa

SEQ ID NO: 70403 - DNA, 601 bp, Human
tttgggaggccaaggtgggtggatcacctgaggtcaggggttcgagactagcctggccaacatggtgaaacccccatctctactaaaaatacaaaaattagccaggtgtggtggcgcacgcctgtaatcccagctccctgggaggctgaggcaggagaatggggtgaacccgggaggcggagcttgcagtgagctgagatcgcgccactgcactccagcctgggcaacagagcgagactccatctcaaaaaaagaaaaaataaataaataaataaataaataaataaaaaaaaataaaaayggtgggaccccagagtgcccaaatgtcagactcttgttatgggttgggtttctaagctgtggagtggaaacagaccaaaagtaaggggacactgagcatgatggtggatctgagagcaggctacgacgtcacccctgggtccccaggacttggctgcagcacggctccctgcaggaggaagagccagctcagaggggctggggtctgggagagggatgtgccccagggaggtggaggggagtcgaggcacggcaccccaagagcctggctttatgcacaccatgtgccaggtgagcaaag

SEQ ID NO: 70404 - DNA, 601 bp, Human
gggtctggtagcagatggtcctgtgctggctttggcagaggtgggcacacatggtgtgtggtgggagcctgaggaggggcctcacccggcctgaggaaactcactgagaagtggaggccgagtcagagcctgtgaggcaggggagtggggacagtctcagcccaaaaaacaatgctggcaagaggcaggtgcaggggtaaggtcacaaggagggaagcgcagccctttcaaggcaggagagaaggcagcaggacaagggacagaactagagggagggtaggacctggcatttaggaaccarcatgtggctgggcctgggcgtgaggttaagaagggagagttggccgggcacggtggctcacgcctgtaatcacagcactttgggaggccgaggcggtagatcacgaggccaggagttcaataccagtctggccaagatggtgaaaccctgtctctactaaaaatataaaaagttagctgggcgtggtggcgggtgcctgtactcccagctactcaggaggctgaggcagataactgcttgaactcgggaggcggaggttgcagtgagccgagattgcgccattgcactccagcctgggca

SEQ ID NO: 70405 - DNA, 601 bp, Human
ttgaggcccaaattcacctgtccttgggatatcatggcccagagcagccagcttgagtgacagcagcaacattctgaagagggtgacatcctgagtacaggatttgcgctgtatgttgtcaaggcaatgagccctggttctggaatgacacattcttagttcaaatccagcatctatttcctagctctgtggccttgggcacattacttaaccacttggagcccccgtttcctcacctgtcaaatgaggtaataaggatactcatctcctagggccagttcgggtctagaggggatagtgygtattgagggttggtacagcacctagaagtactccatcaagttaagatgttattgctgagagcttggcacatgcttcaactaaatggcagccgctgtcattacacagacatcacgtttgtgaactgtacatacattcgtgggcgcacacacaacctaagcgatattcctccactcctcacacaccctcccacacttgcatgcatgcacactgcagtcacgaaggcgttcattcacgttccagttctctctgggagaagcagggtaagaccacacttccctattcacttgaggtcaactgt

SEQ ID NO: 70406 - DNA, 601 bp, Human
ctaaccaagagacctctgggagctgaaatgaggggggaagttacctgtgctgaggccagggccctactgaaggaaagcaagtgcaggagggacggggcgcccagcctccctcagtcctgcctccctagaggggtggacagagacccagctgtgaaaagcaaacaggtgcctggcaagggagtgccctccttcctggtatgtggacaaggccttgtgagcccaacaggtcagggcatatctgagacatggagggcacagaggccagcccagcacaggggcgatgacttctgcaggtggcacyatttccaccccatgggcctgcccaagagggctgaatgctagttctggcctggtcgtcagggccctgcaggtgtcaccaatgaggctctcctggggaccatgcaaagggatacctttgaggcccaaattcacctgtccttgggatatcatggcccagagcagccagcttgagtgacagcagcaacattctgaagagggtgacatcctgagtacaggatttgcgctgtatgttgtcaaggcaatgagccctggttctggaatgacacattcttagttcaaatccagcatctatttcctagct

SEQ ID NO: 70407 - DNA, 601 bp, Human
tcccacgagtggggtgtgaggaggcccaccaagcccctccccactgtccctcctggctcctgggaccctgactcacctggagtagatgcccgttctatacatcatgaagtcctgagtcacctcaaaggcaaagctcacagggttgtagagggccacagcctccaccatcgcttcctcgtcatactgtggaaacaggaccgagacagaaacacatggcctgtcacctccccactcctttcacagtacagccttttgcctcaagctaggggctagaggcccagagcagcatggatggccagargcagctcccctgcggcctctctcccttcctgtctctggctgggtctgtctggccatctctcgttcctctccccaactctgctcctaggaaaccctgcaccctctgagatagggaccacggggtacagcgtggacctactcattcagtcattcacatccattccctgaggtcctctcctgggccagcagctctcacccctacacccataaacccagagtctacaaagctttgctgctagaacacaggggttataaaccatggacgggtaggtcccagatggcggtggaaacgagaagaccc

SEQ ID NO: 70408 - DNA, 601 bp, Human
ccatccaacaacgcctctttgagcgctttagagcaatgttccccacagcggaccagggaggcatgtaaggtggtgatgtaatcacatttagtctccgtgagagaactcctttcagttctttttttcttttgagacggagtctcactctgttgcccaggctggagtgcaatggtgcaatctctgctcactgcaaccttcacctccagggttcaaacgattctcctgcctcagactcccgagtagcctgattacaggcgtgcaccaccacacccagctaatttttgtattttgggtagagacrgggtttcatcatgttggctaggttggtctcgagctcctgacctcaggtgatccacccacctcggcctcccaaagtgctgggattgcaggtgtgagccaccgcacccggccctttcagttcttttggttcttctgcttctgtcaggagaatctccatatggtgctggcccgtgtctcacccctgacactttctactccctctttcctggcaaggagagagccaccttcctgctgcaccttctgtaggcaacagtgtctggcagactttaacacagctttgctttgttgccactgcatttat

SEQ ID NO: 70409 - DNA, 601 bp, Human
atgcccccagggcctccaggcctgagcaacatccccctcccagaagtgggacctgggagctgcttacccgttcattccccactggggaccccaagagtttttcacgatccagtaagggatcccatttttttctccatacccaacagccagtactgcatggtttactttatctggagttttatggcaggaagtactggaaaacaaaattcaaaaagaggtgatcatatgggaaggataaaagcaatgacagtcccatccaacaacgcctctttgagcgctttagagcaatgttccccacagyggaccagggaggcatgtaaggtggtgatgtaatcacatttagtctccgtgagagaactcctttcagttctttttttcttttgagacggagtctcactctgttgcccaggctggagtgcaatggtgcaatctctgctcactgcaaccttcacctccagggttcaaacgattctcctgcctcagactcccgagtagcctgattacaggcgtgcaccaccacacccagctaatttttgtattttgggtagagacagggtttcatcatgttggctaggttggtctcgagctcctgacctcaggt

SEQ ID NO: 70410 - DNA, 601 bp, Human
tcaaagacggaccctcccagacactgatttcgtgccagcagagttccaagttctgagctgttttcctagcagtccttctgagccagctggcctcctgctctccctgcagcgtcctaaagacctggggccctgtgagggctgcaaatgggggcttggaaatgtggaggctacattctcatgctccctttccccctggcctggcctagggcttggctgaccagctcgtctgtggaagccgtaactctgaggtggaagtgatgcccccagggcctccaggcctgagcaacatccccctcccagmagtgggacctgggagctgcttacccgttcattccccactggggaccccaagagtttttcacgatccagtaagggatcccatttttttctccatacccaacagccagtactgcatggtttactttatctggagttttatggcaggaagtactggaaaacaaaattcaaaaagaggtgatcatatgggaaggataaaagcaatgacagtcccatccaacaacgcctctttgagcgctttagagcaatgttccccacagcggaccagggaggcatgtaaggtggtgatgtaatcacatttagt

SEQ ID NO: 70411 - DNA, 601 bp, Human
ccccacaacttcctccagggcaggatttccacccaggcccaggctgcccgttcctctccttctccgccagtctgcgctgcggctgccacggctcacaccagagggatggggtaggaggcgcaggcagccaggccacacatgttctttccgcgctcgatgaggaagtacctgggcagaaagaggagctgaggcccggccggcggtctccccaccacaggcctttctagaatgttttgctgctcaccaagagctgacttcaggggtgagaccctctaaatttattcataaaacagtagcattyggcttatttgatcaccggcaaatcacggacctgactttgtgaagaattcattcttccctctccttagctgccaaatgaatgatccatatcccacttctcccgaaaatttaccgagggccccctcttagccctggccgggccctcacacagctattttatcaccaggagcccgagggaacaggaaagctctccttttcagacaaggacatggaatctgggaggacaggacaaaggcacagcagcatatacacccaggccgccccatgccagccttttctcccggaaggaggggctgtcagt

SEQ ID NO: 70412 - DNA, 601 bp, Human
catgctagaaaagccagaggatgtcaaaaataataaaatatttttaaaaatgcattgtaaagttacatagttaaaataacttatgatgacaccaaggcggaaaggtcaaaatcagataataaatttagtatataatttgggaatttattatatgaaaaagatgacatatcagagaagaagagacggattattcaataaatgttaggaaaacttctagctgtttggggaaaaagtaaatctgtattcctttttctccttacaataaaataacttccatgtggataaaatacagaaatgaagragatgaaatatgaatgggccgggtgtggtggctcacacctgtaatcctagcactttgggaggccgaggtgggtggatcacctaaagccaggagtttgagaccagcctggccaacatggtgaaaccgtgtctctactagaaatacaaaaatagcccggtgcgatggcagatgcctgtaatcccagctactcaggaggctgaggcaggagaatcgcctgaacctgggaggcagaggttgcagtgagctgagatcatgccactgcactccagcctgagagacagagtgagactccgtctcaaa

SEQ ID NO: 70413 - DNA, 601 bp, Human
aatcctagcactttgggaggccgaggtgggtggatcacctaaagccaggagtttgagaccagcctggccaacatggtgaaaccgtgtctctactagaaatacaaaaatagcccggtgcgatggcagatgcctgtaatcccagctactcaggaggctgaggcaggagaatcgcctgaacctgggaggcagaggttgcagtgagctgagatcatgccactgcactccagcctgagagacagagtgagactccgtctcaaaaaaatagaaaaagagaaagaaatatgaatggattgaagaatawtcttggagtggggaagatgcttacaactgtgacacaaaaccaaacgcctaaaagaaaaatattgatctattttaactacatacaagtttatcactatgacagccaacaatcccattggtagaggcagaagacagctcgcagggaaaaaatatttgcagcacattagacaaaagacttatttccttaacatacaaataacttgaataaattggtttaaaaaatgaacttgacagaaaaagttgtaagggacataaacaggacataaaaagaattataaatgtccaataacatcagaaggtg

SEQ ID NO: 70414 - DNA, 601 bp, Human
aggccgaggtgggtggatcacctaaagccaggagtttgagaccagcctggccaacatggtgaaaccgtgtctctactagaaatacaaaaatagcccggtgcgatggcagatgcctgtaatcccagctactcaggaggctgaggcaggagaatcgcctgaacctgggaggcagaggttgcagtgagctgagatcatgccactgcactccagcctgagagacagagtgagactccgtctcaaaaaaatagaaaaagagaaagaaatatgaatggattgaagaatattcttggagtggggaagrtgcttacaactgtgacacaaaaccaaacgcctaaaagaaaaatattgatctattttaactacatacaagtttatcactatgacagccaacaatcccattggtagaggcagaagacagctcgcagggaaaaaatatttgcagcacattagacaaaagacttatttccttaacatacaaataacttgaataaattggtttaaaaaatgaacttgacagaaaaagttgtaagggacataaacaggacataaaaagaattataaatgtccaataacatcagaaggtgctacaaggttggacaca

SEQ ID NO: 70415 - DNA, 601 bp, Human
acaaaaatagcccggtgcgatggcagatgcctgtaatcccagctactcaggaggctgaggcaggagaatcgcctgaacctgggaggcagaggttgcagtgagctgagatcatgccactgcactccagcctgagagacagagtgagactccgtctcaaaaaaatagaaaaagagaaagaaatatgaatggattgaagaatattcttggagtggggaagatgcttacaactgtgacacaaaaccaaacgcctaaaagaaaaatattgatctattttaactacatacaagtttatcactatgayagccaacaatcccattggtagaggcagaagacagctcgcagggaaaaaatatttgcagcacattagacaaaagacttatttccttaacatacaaataacttgaataaattggtttaaaaaatgaacttgacagaaaaagttgtaagggacataaacaggacataaaaagaattataaatgtccaataacatcagaaggtgctacaaggttggacacagtggctcacacctataatcccagcattttgggaggccaagatgggaggatcatttgagcccagaagttcgagaccagcatggg

SEQ ID NO: 70416 - DNA, 601 bp, Human
gcaatttaaaacaacatccatttattatctcacagttctatatgttagaagcctgaaatgggtcacacagcactaaaatgaaggtgttgttgggactgcattcctttctggagactttgggaagaatcctcttccaagcccttttaggttgttggtagaatttagttccttgtagttgtcgaattgagttcttagtgcttgctggctgccagcagaagctgtctttggctcctggaggtctctgcctgtccttgtatgtggcccctgcatctcagaaccagcaatgatgcatcaaatcttwcttatgcttggaatctctttggcttttctttctgggggatctcttttctgccattctcttctccctccagctgaagacatttctctgcttttaagggtgcgtgtgattaaattgggcccacctggataacacgggctaatccctgtgttttaaggtctggaaccttaattatgtttgcaaagtctctttcatcatgaaacacaatacattgacaattcccaaggattatggtgtatacattttaggaggctgttgttctgcctaccacaggggctaggagtatggctacatcagggatgg

SEQ ID NO: 70417 - DNA, 601 bp, Human
cctgtgttttaaggtctggaaccttaattatgtttgcaaagtctctttcatcatgaaacacaatacattgacaattcccaaggattatggtgtatacattttaggaggctgttgttctgcctaccacaggggctaggagtatggctacatcagggatggtagcatttggcatcagatagcaggaaagaggtggggaggggccaaaaacaggaggctaacctgagcctggagggcaaacccacacgtggagaaagaggccctagccaaagaagggctcctactgtctctgggtttttctttyttttttttttttttcctgtttacctcctctccctcaattaaagaactaatacttatgagtggctcagagagcaaacattaggaacaactcagaactgctatggaaaacaagatagcaattctccaaaaaattaaaactagaactaccacatgctccagcaatcccatttctgggtatatatccaaaggaaatgaaagcaggatcttaaagaaaggtatctatacacccatgttcactgcagtactttttacaatagccaagaggtagaagcagcccagtttccattgacagaagaatgaa

SEQ ID NO: 70418 - DNA, 601 bp, Human
aataaggaaagagaaaaagaggagttgtttaatgtgtagagtttcagtattgaaagatgaaaaagttctgaagatgtttcaaaacaatgtgaatattctaaccactactgaactatacacttagaaatggttaagatggtaaaaaccctcagatttccaattgtaaacattcttatcacaaagttttatgtgttctttttttctctctgccacacaaaaccacatacacactcaaacataaataagcaatcaagtcattgcatttctacaaaactgtatacgtgattatgtgtatgattartttattacagtggtatgatcaagggagaagtcattagttgcaatttcaacgcattaccattgaagatgaaagaatggctggtttcttaggtcttttatattctatctaggagtgttgcaaccctaccattgtttcagatgaatcaacaatctatgttgcattagtatttcctttgtttgcaaattttgaatatctctgttcagacatatgttctaccacttcacccttgatgaaagggcctgatatcttattggtttgtactccttggacttagagtcccttgtcatatgttgcctgtag

SEQ ID NO: 70419 - DNA, 601 bp, Human
tgaaagatgaaaaagttctgaagatgtttcaaaacaatgtgaatattctaaccactactgaactatacacttagaaatggttaagatggtaaaaaccctcagatttccaattgtaaacattcttatcacaaagttttatgtgttctttttttctctctgccacacaaaaccacatacacactcaaacataaataagcaatcaagtcattgcatttctacaaaactgtatacgtgattatgtgtatgattaatttattacagtggtatgatcaagggagaagtcattagttgcaatttcaaygcattaccattgaagatgaaagaatggctggtttcttaggtcttttatattctatctaggagtgttgcaaccctaccattgtttcagatgaatcaacaatctatgttgcattagtatttcctttgtttgcaaattttgaatatctctgttcagacatatgttctaccacttcacccttgatgaaagggcctgatatcttattggtttgtactccttggacttagagtcccttgtcatatgttgcctgtaggtccacagcaagcactcaggaagcccacaaattagaatgtcttagaacgt

SEQ ID NO: 70420 - DNA, 601 bp, Human
tgtcctcaatcagattccttctgaccactcttgttttcaatattttataatattttaaacacatatatatttctaaagacataaaatactccctttccactcctagtgggcatactggaatacagttctgacactaactacccagcattagcatcagattccacaggattaagggttcagtcctctgcaaaactgccctcacttcagatgtcagttcaagtgtcgggaatcacctgcacttctggccaactggctataaatttaggagttttcatgaccctctgaaattaaagaattcccyagaatgattcacagaactcactgaaagtgctatccttatgaatgcaagtttattatgagggatacccatgggcaagctctggaagggtcctggacccagagcctccatgccctctccctgtggcatcagggcacctcaccctcctttgtgtcagtgtgttcaataaccaggaagctcctctgagcctcagtgtccagaattgtaattggagttccattatgtagacacgaatgattgattaaattatttgttacatgattgaactcaatctccagcccctctttcctcctcagaggtctg

SEQ ID NO: 70421 - DNA, 601 bp, Human
tattttaaacacatatatatttctaaagacataaaatactccctttccactcctagtgggcatactggaatacagttctgacactaactacccagcattagcatcagattccacaggattaagggttcagtcctctgcaaaactgccctcacttcagatgtcagttcaagtgtcgggaatcacctgcacttctggccaactggctataaatttaggagttttcatgaccctctgaaattaaagaattccctagaatgattcacagaactcactgaaagtgctatccttatgaatgcaagtktattatgagggatacccatgggcaagctctggaagggtcctggacccagagcctccatgccctctccctgtggcatcagggcacctcaccctcctttgtgtcagtgtgttcaataaccaggaagctcctctgagcctcagtgtccagaattgtaattggagttccattatgtagacacgaatgattgattaaattatttgttacatgattgaactcaatctccagcccctctttcctcctcagaggtctggctgaccagagttgcaaccctgtgatcacagggctaatctttctggagac

SEQ ID NO: 70422 - DNA, 601 bp, Human
ttcatgaccctctgaaattaaagaattccctagaatgattcacagaactcactgaaagtgctatccttatgaatgcaagtttattatgagggatacccatgggcaagctctggaagggtcctggacccagagcctccatgccctctccctgtggcatcagggcacctcaccctcctttgtgtcagtgtgttcaataaccaggaagctcctctgagcctcagtgtccagaattgtaattggagttccattatgtagacacgaatgattgattaaattatttgttacatgattgaactcaatmtccagcccctctttcctcctcagaggtctggctgaccagagttgcaaccctgtgatcacagggctaatctttctggagaccagccatcattctaaggctatctaagggtctaccatgagtcaccccaattgcatcacaaagtcactcctatcactcaggaaattccaagggtttttgaagctctatgccaagaaccagtgcaaagaccagatacattcctaattatactacacatctataactcacattaaggcacacagtttccaatatatattcttttatttttgactaacattatat

SEQ ID NO: 70423 - DNA, 601 bp, Human
cattctaaggctatctaagggtctaccatgagtcaccccaattgcatcacaaagtcactcctatcactcaggaaattccaagggtttttgaagctctatgccaagaaccagtgcaaagaccagatacattcctaattatactacacatctataactcacattaaggcacacagtttccaatatatattcttttatttttgactaacattatattaaaaataaataaagttatattaataccaatggccctggctatttatgttgatcagaagctctgattgttagatgtatttttcatatrtgggaaaaataggaaaatgaattaatgtttggtaataaatatagattagcaaggcagaatcattcaaaacatgggatccatatagaagataccgaaaaagggatccgcggtggtagaaatgttgggaaaggctgccaggatggacccttgcagataggaaaagctaatctatgatcaagtgttcatggtgagagaaggcacagccccccttccctcccgaacccttcctctctggtgggaacaagattggtgcagtttgacatatgaggacacagtcatctcatttccactgttaaccca

SEQ ID NO: 70424 - DNA, 601 bp, Human
taaagttatattaataccaatggccctggctatttatgttgatcagaagctctgattgttagatgtatttttcatatatgggaaaaataggaaaatgaattaatgtttggtaataaatatagattagcaaggcagaatcattcaaaacatgggatccatatagaagataccgaaaaagggatccgcggtggtagaaatgttgggaaaggctgccaggatggacccttgcagataggaaaagctaatctatgatcaagtgttcatggtgagagaaggcacagccccccttccctcccgaacmcttcctctctggtgggaacaagattggtgcagtttgacatatgaggacacagtcatctcatttccactgttaacccagaggaatggcagtagtggtagaggctcttaggaaaggtgcaatgtgctaacatgagagagaaatttgggaagataatgcctttcaaattctgtcccatagaagacaccagccctgggcatttggatgctgttgttcctgggttcaaagagtttgtgagtgtcctgtccagtttcatactccttgctttgacacagacatcccattagacctttctttcctgat

SEQ ID NO: 70425 - DNA, 601 bp, Human
tagacatcatttaccttggccatttatgtaagaagtattctgcccagaatattacaaacaggagacatccctgatcccagtccctcacaggtttctcatcctcataggagtgaggtggatagagtaagtgtccccaaatcctgcaaagccagtgctgtggtctaaatgtctgtgtcgttccccctcccccaccaacctgccccttattcataggttgaaatcctgaccttcaggatgattgggcgatgggatctctggggggtgattaggttaggtggggattattgcccttttaaaagaggtctgagggagcttggtcacatcttctgccatgtgagaacacagccagaaggtgccgtatatgaaccataaagtggaccttcactagacactgaatctgctggcaccttgatcttggaattttagcctccagaattgtgagaaataaatttttattatttataagacacccagtttgtggtattttgttatatcagcctggaatgctaagacagacagccaccgttctctagccaagggccatttaagaagatgtggattctgcacttcagtgagccaaattccctatatttctccatat

SEQ ID NO: 70426 - DNA, 601 bp, Human
atttatgtaagaagtattctgcccagaatattacaaacaggagacatccctgatcccagtccctcacaggtttctcatcctcataggagtgaggtggatagagtaagtgtccccaaatcctgcaaagccagtgctgtggtctaaatgtctgtgtcgttccccctcccccaccaacctgccccttattcataggttgaaatcctgaccttcaggatgattgggcgatgggatctctggggggtgattaggttaggtggggattattgcccttttaaaagaggtctgagggagcttggtcacrtcttctgccatgtgagaacacagccagaaggtgccgtatatgaaccataaagtggaccttcactagacactgaatctgctggcaccttgatcttggaattttagcctccagaattgtgagaaataaatttttattatttataagacacccagtttgtggtattttgttatatcagcctggaatgctaagacagacagccaccgttctctagccaagggccatttaagaagatgtggattctgcacttcagtgagccaaattccctatatttctccatatatccaggaagatataaattct

SEQ ID NO: 70427 - DNA, 601 bp, Human
cactgtgagatgtcattgtcttgctttcatattcttacttagcaaactaattcacagttatgtattaagcccctatctggggactgagcactgggctcccagctggataaataggaatgagtgaaacaaatgtctctgccttctggaattttattttagagggggtggagagacagatataaacagcgagaggtattactcaatgctgagtgccctaacaatggagaggtggctgagatgcagaataacagtagaagacctactcagatcaagtgccaaagaagatctgttagagaagatrgtctttaaggagaggactgaaggtaaaaatcattccagttagagagaacaacacaaaccaaggcattaaggtgggaaagagttcattgtataccagcttgactttcaaagaactgaagtgtgggaactctacctctcatctggagagagtggctccagataagagtcatgaaggtggttgggccaaaccatgcagggccctatggaccagtgtaaggagtttggactctattcagtgtgaaataggggagtgacaagatctgacttagattttttttttttttttttttgagatggagtc

SEQ ID NO: 70428 - DNA, 601 bp, Human
aagtgccaaagaagatctgttagagaagatggtctttaaggagaggactgaaggtaaaaatcattccagttagagagaacaacacaaaccaaggcattaaggtgggaaagagttcattgtataccagcttgactttcaaagaactgaagtgtgggaactctacctctcatctggagagagtggctccagataagagtcatgaaggtggttgggccaaaccatgcagggccctatggaccagtgtaaggagtttggactctattcagtgtgaaataggggagtgacaagatctgacttagattttttttttttttttttttgagatggagtctcgctctgttgcacagaccagagtgcagtagcacgatctcagctcactacaacctctgcctcctgggttcaagtgattctcctgccccagcctcctgagtagctgggattacaggcacctgccaccacgcctggttaaattttgtatttttagtagaggcagagtttcatcatattggccaggctggtctcgaactcctgacctcaggtgatccatcccaaagcacagagattacaggtgtgagtcaccccacctggcccgacttagatc

SEQ ID NO: 70429 - DNA, 601 bp, Human
tgagcacagaaactggagccagattgcctaggttcaaatcctggctgtgccacaaactacctatgtgaccttggcgagtgtcttaaccgctctggaccctcttttttctcctctataaaatcacggtattaattgtacctacctcatagggtggttttgaggattaaatgatcaggtatatgtaaaatacaagtaagtactatgtaagtgtcagaagggggaagaaatagcttgggaggaaacaatgagttgatataggagataatcaaaacaaatacatggaggagacattgaatatacmagaccagtgctcagaactgaagtctgggctagagctataatgtgggatttttctgtatacagaagagggagtggaagaaataacccacagcaggattagagggaaagaaaagagagagccactttccactttagaattgcgtattttatagaggtcagacaaaggtgagtgcatcctggagaggcgggaagaaacctaggaggtgaggcacaggagccaatggaaggcaggctagctgtgagtgacacatgctccaaggggtcaaggcttcttattataactcatgtgtcatggaaaata

SEQ ID NO: 70430 - DNA, 601 bp, Human
catgtgtcatggaaaatacaacatcaatggcttgtttgtccctgtcttccctgatttctgaatctcattcatctttctactccatcccacaccctcctctgttctcacattccagtcctcttgctctgacactgccctgatgatgaaatcactctatttaaaaaagaaaagctgaactattcacagtagcaaaaatatggaataaaactaaggtttatcaacagaggattgaattaagaaaatgaatgtagaatactatactatactatactatagaatactactcagccactcagccacaaaaaaaaaaaaaaatgaaatcatgtcttttgcaggaacatgaatggaactggaggccattatcctgagtgaaataactcagaagcagaaagtcaaataccacttataagtgggagctaaacaatgggtacacattgatatagagaacggaataatagagattgaacacttcaaaaggtgggagggtgggaggggctaagggctgaaaattacctattgagcacagggctcactagtcgggtgacgggtacactaataaaagccaagacttcaccaccatgcaccatctgcatgtaagaaa

SEQ ID NO: 70431 - DNA, 601 bp, Human
gagctaaacaatgggtacacattgatatagagaacggaataatagagattgaacacttcaaaaggtgggagggtgggaggggctaagggctgaaaattacctattgagcacagggctcactagtcgggtgacgggtacactaataaaagccaagacttcaccaccatgcaccatctgcatgtaagaaatctgcacttgtaccccctaaatatttttaagaaatttaaaaaagaaaagctgaaaagtatgaatattttttctttgagtgagcccaagaacaaatataaactttttcttcagwactttggacacattatgaacaaagccatgttgtcagcctggcatatctcagggatcccagcgtctgccagtcttgcctgctgtggacgttcagcaccgcctactccttactgccctgtgggctgcagagcatgcctgcggtggtggtgggaggcttctgtttgtgcatcatcttccataggcacagtgatcattgccagccagtggcacttctaggtgaggaggctcttaggcgaggcccccaggatttgccctgtaggaaccgcttggttaccagtatttttctctggcctttacctgc

SEQ ID NO: 70432 - DNA, 601 bp, Human
gatgcctcaatttttggatgtggcctttatagggctttctgaagtgatgagtgatctggcttcaccgcatcttcaaaatgtccctgcagcaactgctattcttgctctgtagcatttggctttaaatatgtttcatatcaacagggttggcaccttctgtttttctcttccactcatccttctgaatgtaaatgtttaacttcttgcaaacacagtacactttgcataaagaaataggtacaactggcttttgtgagtcaaaaacagactggcctctcccaggggcaatagcaaacagctccctaggcccagcttggccaagcagtggcttcaaggtgtcatgtgctaaggctgacctccgaaggatgattttagaagatcaagggagattatattgtcttgaaaaagatggtttaaatgagatgaaggctagtctagtttaggagcaaagactgttggaacagaccacttactggctgtgggaacttagacaagttacttaatcatcagtttcatcatctgtgaaaaggatttattatatctaccttataagtttattgcaaggattgaataagcaaatgcaggaaacgcgcttagcaca

SEQ ID NO: 70433 - DNA, 601 bp, Human; identical to SEQ ID NO: 31975

SEQ ID NO: 70434 - DNA, 601 bp, Human; identical to SEQ ID NO: 31976

SEQ ID NO: 70435 - DNA, 601 bp, Human; identical to SEQ ID NO: 31977

SEQ ID NO: 70436 - DNA, 601 bp, Human; identical to SEQ ID NO: 31978

SEQ ID NO: 70437 - DNA, 601 bp, Human; identical to SEQ ID NO: 31979

SEQ ID NO: 70438 - DNA, 601 bp, Human; identical to SEQ ID NO: 31980

SEQ ID NO: 70439 - DNA, 601 bp, Human; identical to SEQ ID NO: 31981

SEQ ID NO: 70440 - DNA, 601 bp, Human; identical to SEQ ID NO: 31982

SEQ ID NO: 70441 - DNA, 601 bp, Human; identical to SEQ ID NO: 31983

SEQ ID NO: 70442 - DNA, 601 bp, Human; identical to SEQ ID NO: 31984

SEQ ID NO: 70443 - DNA, 601 bp, Human; identical to SEQ ID NO: 31985

SEQ ID NO: 70444 - DNA, 601 bp, Human; identical to SEQ ID NO: 31986

SEQ ID NO: 70445 - DNA, 601 bp, Human; identical to SEQ ID NO: 31987

SEQ ID NO: 70446 - DNA, 601 bp, Human; identical to SEQ ID NO: 31988

SEQ ID NO: 70447 - DNA, 601 bp, Human; identical to SEQ ID NO: 31989

SEQ ID NO: 70448 - DNA, 601 bp, Human; identical to SEQ ID NO: 31990

SEQ ID NO: 70449 - DNA, 601 bp, Human; identical to SEQ ID NO: 31991

SEQ ID NO: 70450 - DNA, 601 bp, Human; identical to SEQ ID NO: 31992

SEQ ID NO: 70451 - DNA, 601 bp, Human; identical to SEQ ID NO: 31993

SEQ ID NO: 70452 - DNA, 601 bp, Human; identical to SEQ ID NO: 31994

SEQ ID NO: 70453 - DNA, 601 bp, Human; identical to SEQ ID NO: 31995

SEQ ID NO: 70454 - DNA, 601 bp, Human; identical to SEQ ID NO: 31996

SEQ ID NO: 70455 - DNA, 601 bp, Human; identical to SEQ ID NO: 31997

SEQ ID NO: 70456 - DNA, 601 bp, Human; identical to SEQ ID NO: 31998

SEQ ID NO: 70457 - DNA, 601 bp, Human; identical to SEQ ID NO: 31999

SEQ ID NO: 70458 - DNA, 601 bp, Human; identical to SEQ ID NO: 32000

SEQ ID NO: 70459 - DNA, 601 bp, Human; identical to SEQ ID NO: 32001

SEQ ID NO: 70460 - DNA, 601 bp, Human; identical to SEQ ID NO: 32002

SEQ ID NO: 70461 - DNA, 601 bp, Human; identical to SEQ ID NO: 32003

SEQ ID NO: 70462 - DNA, 601 bp, Human; identical to SEQ ID NO: 32004

SEQ ID NO: 70463 - DNA, 601 bp, Human; identical to SEQ ID NO: 32005

SEQ ID NO: 70464 - DNA, 601 bp, Human; identical to SEQ ID NO: 32006

SEQ ID NO: 70465 - DNA, 601 bp, Human; identical to SEQ ID NO: 32007

SEQ ID NO: 70466 - DNA, 601 bp, Human; identical to SEQ ID NO: 32008

SEQ ID NO: 70467 - DNA, 601 bp, Human; identical to SEQ ID NO: 32009

SEQ ID NO: 70468 - DNA, 601 bp, Human; identical to SEQ ID NO: 32010

SEQ ID NO: 70469 - DNA, 601 bp, Human; identical to SEQ ID NO: 32011

SEQ ID NO: 70470 - DNA, 601 bp, Human; identical to SEQ ID NO: 32012

SEQ ID NO: 70471 - DNA, 601 bp, Human; identical to SEQ ID NO: 32013

SEQ ID NO: 70472 - DNA, 601 bp, Human; identical to SEQ ID NO: 32014

SEQ ID NO: 70473 - DNA, 601 bp, Human; identical to SEQ ID NO: 32015

SEQ ID NO: 70474 - DNA, 601 bp, Human; identical to SEQ ID NO: 32016

SEQ ID NO: 70475 - DNA, 601 bp, Human; identical to SEQ ID NO: 32017

SEQ ID NO: 70476 - DNA, 601 bp, Human; identical to SEQ ID NO: 32018

SEQ ID NO: 70477 - DNA, 601 bp, Human; identical to SEQ ID NO: 32019

SEQ ID NO: 70478 - DNA, 601 bp, Human; identical to SEQ ID NO: 32020

SEQ ID NO: 70479 - DNA, 601 bp, Human; identical to SEQ ID NO: 32021

SEQ ID NO: 70480 - DNA, 601 bp, Human; identical to SEQ ID NO: 32022

SEQ ID NO: 70481 - DNA, 601 bp, Human; identical to SEQ ID NO: 32023

SEQ ID NO: 70482 - DNA, 601 bp, Human; identical to SEQ ID NO: 32024

SEQ ID NO: 70483 - DNA, 601 bp, Human; identical to SEQ ID NO: 32025

SEQ ID NO: 70484 - DNA, 601 bp, Human; identical to SEQ ID NO: 32026

SEQ ID NO: 70485 - DNA, 601 bp, Human; identical to SEQ ID NO: 32027

SEQ ID NO: 70486 - DNA, 601 bp, Human; identical to SEQ ID NO: 32028

SEQ ID NO: 70487 - DNA, 601 bp, Human; identical to SEQ ID NO: 32029

SEQ ID NO: 70488 - DNA, 601 bp, Human; identical to SEQ ID NO: 32030

SEQ ID NO: 70489 - DNA, 601 bp, Human; identical to SEQ ID NO: 32031

SEQ ID NO: 70490 - DNA, 601 bp, Human; identical to SEQ ID NO: 32032

SEQ ID NO: 70491 - DNA, 601 bp, Human; identical to SEQ ID NO: 32033

SEQ ID NO: 70492 - DNA, 601 bp, Human; identical to SEQ ID NO: 32034

SEQ ID NO: 70493 - DNA, 601 bp, Human; identical to SEQ ID NO: 32035

SEQ ID NO: 70494 - DNA, 601 bp, Human; identical to SEQ ID NO: 38223

SEQ ID NO: 70495 - DNA, 601 bp, Human
taatccaatgtatacaatacgttttccacacttgacatataatagtttgagattttataatatatatatttttaatgtagctatatgtggagaaccagaagattgatcttgaggggtgggaaatgaaaacaataccaatgaacatcgacttaaattattattttactaccagttttcatagtagattctactacaaactttttacagagcagtgtcccagacactaactttccatgcatttgacattttaccttctattccacttccattaactattttttaataaactgtttgtatttgaaaaaaaaaatctccatataattctatcccttcttaatttttttctcttccattaagagagtatgttttattaagcactaggctttaggtttatcataccaatgacaaaaatagcttgaatctataacctggattattttaaaacattttgtaattgatgtcctcaatatttgaaagcacaaagtgaaccaaaaaaaatgactttaagcatgtctgaggtgttctgaagcatatcccaagctaacattaatgcaagttgactgcttcaagtttattctcccaaccaattgcatatctggac

SEQ ID NO: 70496 - DNA, 601 bp, Human
gaaaccccgtctctactaaaaatacagaaaaattagccggacttggtggcaggcgcctgtagtcccagctactcgggaggctgaggcaggagaatggcgtgaacccgggaggcggagcttgcagtgagccaagatcacaccactgcactccagcctgggcaacagagtgagactccatctcaaaaaaaaaaaaaaaagcacaattccagcctgggcaacatactgagactctgtctctacaaaagacatttttaaattagctgggtgtggtggtgtatgcctgtggtcccagctacttggsaggctgaggcaggagaattgcttgagcccaggaggttgaggctgcagtgagctgtgatggcactgcacaccagcctgagcaacggagcaagaatctgtctcaaaaacaaaacaaaacaaataaacaaaatgcacaggccaggtgcagtggctcacacctgtaatcccagcactttagaaggcggaggcgggcagatcacctgaggtcaggagtttgagaccagcctggccaacatggtgaaaccctgtctctactaaaatacaaaaattagccaggcatggtggtgcacccctatagtcc

SEQ ID NO: 70497 - DNA, 601 bp, Human
cactttaaaaagcacaattccagaccgggcgcagtggctcacgcctgtaatcccaacactttgggaggccaaggtgggcggatcacaaggtcgggagattgagaccatcctggctaacacggtgaaaccccgtctctactaaaaatacagaaaaattagccggacttggtggcaggcgcctgtagtcccagctactcgggaggctgaggcaggagaatggcgtgaacccgggaggcggagcttgcagtgagccaagatcacaccactgcactccagcctgggcaacagagtgagactccatctcaaaaaaaaaaaaaaaagcacaattccagcctgggcaacatactgagactctgtctctacaaaagacatttttaaattagctgggtgtggtggtgtatgcctgtggtcccagctacttgggaggctgaggcaggagaattgcttgagcccaggaggttgaggctgcagtgagctgtgatggcactgcacaccagcctgagcaacggagcaagaatctgtctcaaaaacaaaacaaaacaaataaacaaaatgcacaggccaggtgcagtggctcacacctgtaatcccagcactttag

SEQ ID NO: 70498 - DNA, 601 bp, Human
acataacaattacaactcactttaaaaagcacaattccagaccgggcgcagtggctcacgcctgtaatcccaacactttgggaggccaaggtgggcggatcacaaggtcgggagattgagaccatcctggctaacacggtgaaaccccgtctctactaaaaatacagaaaaattagccggacttggtggcaggcgcctgtagtcccagctactcgggaggctgaggcaggagaatggcgtgaacccgggaggcggagcttgcagtgagccaagatcacaccactgcactccagcctgggcaacagagtgagactccatctcaaaaaaaaaaaaaaaagcacaattccagcctgggcaacatactgagactctgtctctacaaaagacatttttaaattagctgggtgtggtggtgtatgcctgtggtcccagctacttgggaggctgaggcaggagaattgcttgagcccaggaggttgaggctgcagtgagctgtgatggcactgcacaccagcctgagcaacggagcaagaatctgtctcaaaaacaaaacaaaacaaataaacaaaatgcacaggccaggtgcagtggctcacacctg

SEQ ID NO: 70499 - DNA, 601 bp, Human
ataaagcaatacttgagctatcacacataacaattacaactcactttaaaaagcacaattccagaccgggcgcagtggctcacgcctgtaatcccaacactttgggaggccaaggtgggcggatcacaaggtcgggagattgagaccatcctggctaacacggtgaaaccccgtctctactaaaaatacagaaaaattagccggacttggtggcaggcgcctgtagtcccagctactcgggaggctgaggcaggagaatggcgtgaacccgggaggcggagcttgcagtgagccaagatcacaccactgcactccagcctgggcaacagagtgagactccatctcaaaaaaaaaaaaaaaagcacaattccagcctgggcaacatactgagactctgtctctacaaaagacatttttaaattagctgggtgtggtggtgtatgcctgtggtcccagctacttgggaggctgaggcaggagaattgcttgagcccaggaggttgaggctgcagtgagctgtgatggcactgcacaccagcctgagcaacggagcaagaatctgtctcaaaaacaaaacaaaacaaataaacaaaatgcacag

SEQ ID NO: 70500 - DNA, 601 bp, Human
caataaagcaatacttgagctatcacacataacaattacaactcactttaaaaagcacaattccagaccgggcgcagtggctcacgcctgtaatcccaacactttgggaggccaaggtgggcggatcacaaggtcgggagattgagaccatcctggctaacacggtgaaaccccgtctctactaaaaatacagaaaaattagccggacttggtggcaggcgcctgtagtcccagctactcgggaggctgaggcaggagaatggcgtgaacccgggaggcggagcttgcagtgagccaagatcacaccactgcactccagcctgggcaacagagtgagactccatctcaaaaaaaaaaaaaaaagcacaattccagcctgggcaacatactgagactctgtctctacaaaagacatttttaaattagctgggtgtggtggtgtatgcctgtggtcccagctacttgggaggctgaggcaggagaattgcttgagcccaggaggttgaggctgcagtgagctgtgatggcactgcacaccagcctgagcaacggagcaagaatctgtctcaaaaacaaaacaaaacaaataaacaaaatgcac

SEQ ID NO: 70501 - DNA, 601 bp, Human
tccaataaagcaatacttgagctatcacacataacaattacaactcactttaaaaagcacaattccagaccgggcgcagtggctcacgcctgtaatcccaacactttgggaggccaaggtgggcggatcacaaggtcgggagattgagaccatcctggctaacacggtgaaaccccgtctctactaaaaatacagaaaaattagccggacttggtggcaggcgcctgtagtcccagctactcgggaggctgaggcaggagaatggcgtgaacccgggaggcggagcttgcagtgagccaagatcacaccactgcactccagcctgggcaacagagtgagactccatctcaaaaaaaaaaaaaaaagcacaattccagcctgggcaacatactgagactctgtctctacaaaagacatttttaaattagctgggtgtggtggtgtatgcctgtggtcccagctacttgggaggctgaggcaggagaattgcttgagcccaggaggttgaggctgcagtgagctgtgatggcactgcacaccagcctgagcaacggagcaagaatctgtctcaaaaacaaaacaaaacaaataaacaaaatgc

SEQ ID NO: 70502 - DNA, 601 bp, Human
aatgtcatgttaatgaaattccatatatttttaattccaataaagcaatacttgagctatcacacataacaattacaactcactttaaaaagcacaattccagaccgggcgcagtggctcacgcctgtaatcccaacactttgggaggccaaggtgggcggatcacaaggtcgggagattgagaccatcctggctaacacggtgaaaccccgtctctactaaaaatacagaaaaattagccggacttggtggcaggcgcctgtagtcccagctactcgggaggctgaggcaggagaatggygtgaacccgggaggcggagcttgcagtgagccaagatcacaccactgcactccagcctgggcaacagagtgagactccatctcaaaaaaaaaaaaaaaagcacaattccagcctgggcaacatactgagactctgtctctacaaaagacatttttaaattagctgggtgtggtggtgtatgcctgtggtcccagctacttgggaggctgaggcaggagaattgcttgagcccaggaggttgaggctgcagtgagctgtgatggcactgcacaccagcctgagcaacggagcaagaatctg

SEQ ID NO: 70503 - DNA, 601 bp, Human
atgtaagctatgtttcaaaatggtcacacacattaagctatgttttcaaaatggtcacacacatttcataatagacaacgcaaatggaattgaagccattaactttaaattactaaatgtcatgttaatgaaattccatatatttttaattccaataaagcaatacttgagctatcacacataacaattacaactcactttaaaaagcacaattccagaccgggcgcagtggctcacgcctgtaatcccaacactttgggaggccaaggtgggcggatcacaaggtcgggagattgagacyatcctggctaacacggtgaaaccccgtctctactaaaaatacagaaaaattagccggacttggtggcaggcgcctgtagtcccagctactcgggaggctgaggcaggagaatggcgtgaacccgggaggcggagcttgcagtgagccaagatcacaccactgcactccagcctgggcaacagagtgagactccatctcaaaaaaaaaaaaaaaagcacaattccagcctgggcaacatactgagactctgtctctacaaaagacatttttaaattagctgggtgtggtggtgtatgcctg

SEQ ID NO: 70504 - DNA, 601 bp, Human
actaaaagacagaaacacaatgtaaaatttccaagttattagaaaaaaaggaatgataaatgtaatcaatccaagtaacaaaagacaaagaaatagagaactggtaatacaaatagcacatattaaggtggtagatatatatattcaaaatacatcagatattatattacaagtaaatggaataaatgctccaattaaaagggaaatattatcaaacaggaaaaaagcaaaatataactatacggttttcacaagagatacatctaaacaagaattcagaaaaattagggggccaggcgcrgtggcttacacctgtaatctcagcactttggaaggctgaggcaggcggataacctgaggtcaggagtttgagaccagcctggccaacatggtgaaaccccatccctactaaaaatacaaaaattagccaggcgtggtggcgggcgcctatagtaccagctactcaggaggctgaggcagaattgcttgaacccaggaggcagaggttgcagtgagccaagattacgccactgcactccagcctagatgacaagtgtgaaactccatctcaaaaaaaaaaaaaaaagaattcagaaaaatt

SEQ ID NO: 70505 - DNA, 601 bp, Human
aaaaaaacccacacctaggcatattattgtaaactcctgaaaaccaaagagaaaaccttaaaagtatctagaagaaaatggttattaaggaacacagtaagactgatgtctgattttttcaatacaagcaacggagcccagaacagtaggattctatcttgaacatactgaatgtaattaactgacaaccctgaatgctatatcctgagaaaacggcctttttttctttttttttgaagcgatgagatctcactacagtgcccaggctggagtgcagtggctattcacaggcatgatcatrgcacaccacagtctcaaactcctgggctcaagtgatcctcccacctcagcctcctgaatagcaaagactataggcccacgctatcgcaccgagcttgaaatagtattttaaacacaaagtagaatacatacttttttttacactaacaaaaatgaatagaatttcttatcatcagatttgctttaaggaaaataaaggaagtgctttaagcataaggaaattgaccccagatggaaactcagaaatgtagggaaaattaaagagtaatagaaagggtaatattaggtatatcctaataac

SEQ ID NO: 70506 - DNA, 601 bp, Human
ttctcctgcctcagcctcctgagtagctgggactataggcgcgcaccaacatgcccagctaatttttgtatttttagtaaggacagggtttcaccacgttggccaggctggtctcgaacccctgacctcaagtgatccgcccaccttggcctcccaaagtgctgagattaacagacatgagccaccatgcccagcatttttttaaaatgacaaatgacattatttgatagaagcaagagccataaaattaacagacaaaaaaaaaaaaaaacccacacctaggcatattattgtaaactcmtgaaaaccaaagagaaaaccttaaaagtatctagaagaaaatggttattaaggaacacagtaagactgatgtctgattttttcaatacaagcaacggagcccagaacagtaggattctatcttgaacatactgaatgtaattaactgacaaccctgaatgctatatcctgagaaaacggcctttttttctttttttttgaagcgatgagatctcactacagtgcccaggctggagtgcagtggctattcacaggcatgatcatagcacaccacagtctcaaactcctgggctcaagtgat

SEQ ID NO: 70507 - DNA, 601 bp, Human
agcgttgccaagaaaaaaataaaagttataaaagagtatgatattatacataataataactaatacttacacaatgcttactatgttccaggtactattctaagcacaaaagccttatgaaataggtacaattattatcctgctttatagctgaagcaactaactcacacagaggtcaaggaacttgtccaaggtcacacagcaataactggtagaggcatgattaaaacaccttctcaaaaaaaccaaaaaaactaaacaaaccaacaaaaatgccccaaaacccacaaatttcatatcytaatggaactataaattctgacaagttctattttatcaaattaagaaatctaaataatactagaatgtcacttgttccattgggctgttttggcacatttctaatagaagaaaacattacactaaaactttttactctttaaaaattcacactatagcaccagataatttatctttctctactctatgtcaagtccttcttgcaaagatttccacagtagctccaaacctgcaatcataattaaaacagactatcggccgggcatggtggctcatgcctgtaatcccagcaccttttggg

SEQ ID NO: 70508 - DNA, 601 bp, Human
aagaatgagatcatgtcctttgcagggacatggatggagctagaagccattatcctcagcaaactaataggaacagaaaaccaaataccacatgttgtcacttataagtgggagctaaatgatgagtgcacatagaggggaacaacacacactggggcctaccggagggcaaagggtgggagaagggagaggaccaggaaaaatgactgacaaataattgtttaaacccaagacttacatcgtgactgcgacaaaatccaattccattattaataatctgaaacaagtacttttgaactasttggtagtctagtccatttggaaagagctccaagtcatcaaaccccatgacacatgtttacctatgtaacaaacctgtacatcctgcacatgtacccctgaacttaaaagttaaaaaaaaacacaaacttctaccctgccttcccttaaaacagacattttacaatgtaaaagaagcgttgccaagaaaaaaataaaagttataaaagagtatgatattatacataataataactaatacttacacaatgcttactatgttccaggtactattctaagcacaaaagccttatgaaatagg

SEQ ID NO: 70509 - DNA, 601 bp, Human
gatatatatcatatatgatatattatatatataatatatatatatttaaaaatctacagctaggcaaaagacattattaggcctaattctctaatataagcaaattgtattttgaaaactaaaaaagatagatttgttttaactctttcagaagaccagcatcctaaacggcaatctgccattgctgagcacgttgtataggctaccaactttattaccctagatatcagtgatgaggacacaggtccagtctcagaccacctgtgctgtagtagaaagagctaaactggggccgggtgcrgtggctcacacctgtaatcccagcactttgggagaccgaggcgggtggatcacgaggtcaggagatcgagacatcctggctaatatagtgaaaccccgtctctaccaaaaatacaaaaaattagccaggcgtggtggcaggcgcctgtagtcccagctactcgggaggctgaggcagggagaatggcgtgaacctgggaggcggagcttgcagtgagccgaaatcgagccactgcactccatcctgggcgacagagcgagcctccatctcaaaaaaaaaaagaaaaagaaaaaaagaaag

SEQ ID NO: 70510 - DNA, 601 bp, Human
aaaaaaaatatatataaaaaatattatatagatatatatcatatatgatatattatatatataatatatatatatttaaaaatctacagctaggcaaaagacattattaggcctaattctctaatataagcaaattgtattttgaaaactaaaaaagatagatttgttttaactctttcagaagaccagcatcctaaacggcaatctgccattgctgagcacgttgtataggctaccaactttattaccctagatatcagtgatgaggacacaggtccagtctcagaccacctgtgctgtrgtagaaagagctaaactggggccgggtgcggtggctcacacctgtaatcccagcactttgggagaccgaggcgggtggatcacgaggtcaggagatcgagacatcctggctaatatagtgaaaccccgtctctaccaaaaatacaaaaaattagccaggcgtggtggcaggcgcctgtagtcccagctactcgggaggctgaggcagggagaatggcgtgaacctgggaggcggagcttgcagtgagccgaaatcgagccactgcactccatcctgggcgacagagcgagcctccatctc

SEQ ID NO: 70511 - DNA, 601 bp, Human
ataatatttaaaaatctggccaggtgcggtggctcacgcctgtaatcccagcactttgggaggttgaggtgggtggatcatgaggtcaggagtttgagaccagcctggccaacatggtgaaaccccgtccctagtcaaaatacaaaaattagccaggcactatggcaggcacctgtaatcccagctacttgggaggctcaggcaggagaatctcttgaacctaggagggggaaggttgcagtgagccgagattgcgccattgcactccagcctgggcgacagagactccatctcaaaaaawatatatataaaaaatattatatagatatatatcatatatgatatattatatatataatatatatatatttaaaaatctacagctaggcaaaagacattattaggcctaattctctaatataagcaaattgtattttgaaaactaaaaaagatagatttgttttaactctttcagaagaccagcatcctaaacggcaatctgccattgctgagcacgttgtataggctaccaactttattaccctagatatcagtgatgaggacacaggtccagtctcagaccacctgtgctgtagtagaa

SEQ ID NO: 70512 - DNA, 601 bp, Human
aaaaaaaaaaaaaaagaaaagaaagaaatagaatttagaagagtcgtagatattttgtagatattttgtttgaacctgagaatttaaaagaatggtggtttcattttcaaaattagaaaagcctagagaaagttagttttaatggaataattagtttagttttaatcattggacttttgggtggaatgctgagcacccaagtatagacattcatcaggcaattagaaatgtaaagagtaaacaaaaacattagtgattaaaatttctaaaggagagactttgtaagaataaaacaggatgytgatattcagataatatttaaaaatctggccaggtgcggtggctcacgcctgtaatcccagcactttgggaggttgaggtgggtggatcatgaggtcaggagtttgagaccagcctggccaacatggtgaaaccccgtccctagtcaaaatacaaaaattagccaggcactatggcaggcacctgtaatcccagctacttgggaggctcaggcaggagaatctcttgaacctaggagggggaaggttgcagtgagccgagattgcgccattgcactccagcctgggcgacagagactcca

SEQ ID NO: 70513 - DNA, 601 bp, Human
ccagcactttgggaggccgaggcaggcagatcacttgaggtcaggagttcaagaccagcctggccaacttggtgaaaccttgtctttactaaaatacaaaaaagtagctgggcgtgctggcacgcgcttgtaatcccagctacttgagtggttgaggcaggagaattgcttgtacccaggaggtggaggttgcagtgagccaagatcgcaccactgtattccagcctgggcaacagagcgagactccatctcaagaaaaaaaaaaaaaaagaaaagaaagaaatagaatttagaagagtcrtagatattttgtagatattttgtttgaacctgagaatttaaaagaatggtggtttcattttcaaaattagaaaagcctagagaaagttagttttaatggaataattagtttagttttaatcattggacttttgggtggaatgctgagcacccaagtatagacattcatcaggcaattagaaatgtaaagagtaaacaaaaacattagtgattaaaatttctaaaggagagactttgtaagaataaaacaggatgctgatattcagataatatttaaaaatctggccaggtgcggtggctc

SEQ ID NO: 70514 - DNA, 601 bp, Human
tatttaaacaatcaaaaacattggataaaatatattttttcaaattactaaatcaactgttcagttaatgtactgctctcaagactaagagagtaaagctatcattgaagctgaggcagtcaggggaaatttttatgaaaggggtgggctctaacataggtctttaatactaagtatgacctagataaataaagagaaagaagggcagcccaagtgaatgtaacaaggagagcaagaatggaaatggggatagataagagattgtggggaaaaaaaaatttttttttgagacggagtctckctctgtcacccaggatggagtgcagtggcgcgatctcggctcactgcaagctccacctcccgggttcacgccattctcctgcctcagcctcccgagtaggtgggactactggcgcctgccaccacgcccggctaattttttgtatttttagtacagacggcgtttcaccgtgttagccaggatggtctcgatctcctgacctcctcgtgatctgcccgcctcggcctcccgaagtgctgagattacaggcgtgagccaccgcgcccgggccaaaaaccttttttttttttttttttttag

SEQ ID NO: 70515 - DNA, 601 bp, Human
taagaaactattgtactgcttatttaatttctaatctgaaaacttcaaatcaaatagttaaattacccccaagtattttcccattatttccatttctaagctccatcttcaaacatgaagttgatatttcaacaaacgtaagattttgatagtccagctttgaaattctgtcaaaagcactaatagcagaagtccaaatctgtgccaagattaaatcaaccttggaaatctctgtgtctctcctcttgaatgtgaaagtaaggacagtagtcacattacaccaaatgcttactgactcaasaataataaatgatcattgcatcctctctacatgtaattaacggtatgtaaaagtacagagaaatgcacaacctctgctcttttcctctctcttgaggggaaaggggatgtgagcgtgattaagaacatgcaccagggcgggccacagtggctcacgcctgcaatcccagcattttgggaggccgaggcaggagaatcgcttgaacctgggagtcggaggttgcagtgagccaagattgccactgcaccccagcctggtgacagaacgagactccgtctcaaaaaataaaaaagaacatgc

SEQ ID NO: 70516 - DNA, 601 bp, Human
ggggtttcaccttgttagccaggatggtctcgatctcctgacctcatgatccacccgcctcggcctcccaaagtgctgggattacaggcgtgagccaccgcgcccggccaataaatggtttcttaatgagtgttaaaacaggtaaaattttcagtcctttttctctgaagttacccccatcaaattatttaaattgtttctaaatgtacaaaaattaaaattattagaggaaattgttgacctaaaagatcaactagaggccagggctggtggctcacacctataatcccagcactttggraggccgaggcgggcggatcacgaggtcaggagattgagaccatcctggctaacacagtgaaaccccgtttctactaaaaatacaaaaaattagccaggcatggtggcgagcgcctgtagtcccagctactagagaggttgaggcggaagaatggtgaagcttgcagtgagccgagatcatgccacagcactccagcctgtgtgacagagcaagactccatcaaaaaaaaaaaaaaaagatcaactagacaagtaaaaaaaaaaaaaaaaggtcttgatagtgcataaattcccctgtcat

SEQ ID NO: 70517 - DNA, 601 bp, Human
catgttggccaggctggtctccaactcctgacttcaagtgatccaccggccttagcctcccaaagtgctgggattacaggtgtgagccaccatgcccagaccctttttattttcttatcctacttttattttcttttccatttaaacaaggcgtgtattttaaatgttaaacgtaaaaatcatacagtgtttttatgtttttaatgtgtttttcagtgaggatgttttcacatttacaaaatgctagataacaataaatggtttcttttttttttttttttttttttgagacggagtctcsctctgtcgcccaggccggactgcggactgcagtggcacaatctcggctcactgcaagctccgcttcccgggttcacgccattctcctgcctcagcctccccagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccaataaatggtttcttaatgagtgtt

SEQ ID NO: 70518 - DNA, 601 bp, Human
tatttatttatttatttaaagagagagtttcactctgtcacccaggatggagtgcagtggtgcgatctcagctcactgtaacctctgtctcctgggttcaagtgattctcctgtctcagcatcccgagtagctgggattacagacatgcaccaccatgcccagctaatttttttgtatttctaatagagatggggttttgccatgttggccaggctggtctccaactcctgacttcaagtgatccaccggccttagcctcccaaagtgctgggattacaggtgtgagccaccatgcccagmccctttttattttcttatcctacttttattttcttttccatttaaacaaggcgtgtattttaaatgttaaacgtaaaaatcatacagtgtttttatgtttttaatgtgtttttcagtgaggatgttttcacatttacaaaatgctagataacaataaatggtttcttttttttttttttttttttttgagacggagtctcgctctgtcgcccaggccggactgcggactgcagtggcacaatctcggctcactgcaagctccgcttcccgggttcacgccattctcctgcctcagcctcc

SEQ ID NO: 70519 - DNA, 601 bp, Human
agcgggggttacaggcacgtgccaccacgcccagctaatttttgtatttttagtagagatggggtttcaccatcttggccaggatggtcttgaactcctgacctcatgatccacgtgcctcggccgcccaaactgctgggattacaggcatgagccaccatgcccggccatcctatgtcctacattttaatattttcctacttctctatcctttatttatttatttatttaaagagagagtttcactctgtcacccaggatggagtgcagtggtgcgatctcagctcactgtaacctctgyctcctgggttcaagtgattctcctgtctcagcatcccgagtagctgggattacagacatgcaccaccatgcccagctaatttttttgtatttctaatagagatggggttttgccatgttggccaggctggtctccaactcctgacttcaagtgatccaccggccttagcctcccaaagtgctgggattacaggtgtgagccaccatgcccagaccctttttattttcttatcctacttttattttcttttccatttaaacaaggcgtgtattttaaatgttaaacgtaaaaatcatacag

SEQ ID NO: 70520 - DNA, 601 bp, Human
gtttgttttttttgacatggagtctcgctctgttgcccaggctggagtgcagtggcgtaatctcagctcactgaaacctccacctcccaggttcaagcaattctctgcctcaccttcccgagtagcgggggttacaggcacgtgccaccacgcccagctaatttttgtatttttagtagagatggggtttcaccatcttggccaggatggtcttgaactcctgacctcatgatccacgtgcctcggccgcccaaactgctgggattacaggcatgagccaccatgcccggccatcctatgycctacattttaatattttcctacttctctatcctttatttatttatttatttaaagagagagtttcactctgtcacccaggatggagtgcagtggtgcgatctcagctcactgtaacctctgtctcctgggttcaagtgattctcctgtctcagcatcccgagtagctgggattacagacatgcaccaccatgcccagctaatttttttgtatttctaatagagatggggttttgccatgttggccaggctggtctccaactcctgacttcaagtgatccaccggccttagcctcccaaa

SEQ ID NO: 70521 - DNA, 601 bp, Human
ttaaagaattaaaaaacaaaaaaattgggtaaatcttatagcctagtgttttagaggtacctatcttatcaatatttaaacaatcttaactgatgagaactttttgagctaaaaattccccaaaaaggtcaaattttagagttgattctcacttgatagaatgaaaacctaacatcttccttaatcaaatacaacaaaaaagtattggccatttgtaaactggctgcagccaatacagtggctaagcaaaaacccctttgacaatatcatacagatcatgatcctatgccctacattttgttttttttgttgttgttgttgtttgtttgttttttttgacatggagtctcgctctgttgcccaggctggagtgcagtggcgtaatctcagctcactgaaacctccacctcccaggttcaagcaattctctgcctcaccttcccgagtagcgggggttacaggcacgtgccaccacgcccagctaatttttgtatttttagtagagatggggtttcaccatcttggccaggatggtcttgaactcctgacctcatgatccacgtgcctcggccgcccaaactgctgggattacaggcatgag

SEQ ID NO: 70522 - DNA, 601 bp, Human
catttagatcctaattcaaactatgaaatgaaataaattttgtgaaaattaatgaaactttaaacatcaattagatattttatgatagtaagaaattatttggaatttttaaaacttaaggctattacagaatggaaaggaaaggatttatcctgtgcttatcactatgctagatgctttacaaagattattttattttattttattttattgcaaagtcttgttctgattcattaaaacccctaacatgccagtaaaaatagaagggactcaataagtagctttaaatgaacaagaaaakttctctgcataactgtgctacttataagtaaaataatacgtctgggatttgcttcaaaatactccaaaaaaagttaaagagtgtagataaattaaacaagattatcaaaaggttgataattgtggaaactagatgataagtacatgaaggtttgttaaacaactattctttctattttcttttccgtttgaaattttccataataaaatgttttaaaagttttatatgattccttaaggtatgattaaggtacacaagttggacaatagttttacctttattccctttatatctccttac

SEQ ID NO: 70523 - DNA, 601 bp, Human
caacacatacacgatcaccaggcaatgaaatctttgaaccaaagtgtttgtgtagaccgtccccattacaatcagatgtgaggtgggctggtataaacaaaggagccgggaaggagaggaaatatcaaggaagccctgagtgacgcatcagagtagagaagagacgagcctgcggaagtactccaacagacaatcctgctttcaatttcactttctctgtgcgacctgagtaagtcgcaaagagatgcctgagaaactgaggacatggataaatgacgtgtggactctgacagaactctgkaagggcactggaggaagatccttccgggcagccaagggctgggagctcccctcccacttcccaagtcctccagcccctggcctctccagtctccaaagcccaagaattcttcaggatcgacttatcgaggttttctagctttcctccttctgcctgccttacctgctcaactcagacgtctcaattattcctttggcagccgcaaagcctggaagactgcttgcagcccgagcagtttcctcctgctgcgtcactgagtcagcagggcggagccaagaaaggagtgaggagtgtgggagg

SEQ ID NO: 70524 - DNA, 601 bp, Human
gtgtaaattgggattctctggcaacagagcagcagtatgaagaaggaacaatgttctcagtcttctgacattccacctggcaacgaagagaggtgctttgtaattttacaatagggagaaaacacttgaatcagagaaattaattatattagcattttttctaaatacatatatttatttcttataaaacttttaaattacagaatattataaatatatgtaaattcaaaataagaaaattatttctctagtcccaatgcccagaaacagccaatgttaatattttagtgtatttctatayattttttaagacatttggaattatactctgtaagtaactgtatcctacttcctttcatttaataccatactataagtcatttcctgtgttattgcaaagtcttgtaaaacatttttcatgactatgtaatatgaaatcatacagttgtttcatttctctattactgagtggttttcaaaaataagttttaaagggttttttaaaattaaaaatttaaaaaatctaaatgatgttgcagcaaattcagcttattttagtttattttctttcgatagatcttatgatagatttcatatgata

SEQ ID NO: 70525 - DNA, 601 bp, Human; identical to SEQ ID NO: 40162

SEQ ID NO: 70526 - DNA, 601 bp, Human; identical to SEQ ID NO: 40163

SEQ ID NO: 70527 - DNA, 601 bp, Human; identical to SEQ ID NO: 40164

SEQ ID NO: 70528 - DNA, 601 bp, Human; identical to SEQ ID NO: 40165

SEQ ID NO: 70529 - DNA, 601 bp, Human; identical to SEQ ID NO: 40166

SEQ ID NO: 70530 - DNA, 601 bp, Human
ctagcaaggaaaatggaccgtaagccagtaattatgagtgtgatgtgcagtctagagaccagtgagggaaggaaagcaaaacaagaattaggagaagcagagtcccaggtcaggtctaggataggaagctgttggtttccaagacctgaagattatgggttctcccatagtgctttgcacatgtccctgggatgcccagcacacatcccacagcatcatttccatgggcttctcagccccacagggacacattgtattctgctttgtatgctcaaggccttgcatgggcctagcacataaytggtattgtatagatgtttgttaattaataatgaaagttctgacagtactgactagattgagatgatgactaattttgtagagttccactataattaatgcaagttaggtggaacttttcttaaagagagcaatttgaaagatcatctttccttcatagtctatttcctcaggcagaatgtaggtctgtgtgtggatcctgagagctgggctgtttacaggcagtggaggcagccaggctgtacctggactgaaacacctcatggtgaagcacttcccttggattaagctctatttagtc

SEQ ID NO: 70531 - DNA, 601 bp, Human
acctatgctgacaaaattaattgtgtgaccatgaaaatgggcaagtcaacagaaaaacaaagtgtaaaatgggaattaaaaggtaaaacttgaagttaaaacctgaagactatcaaaattcaatataagcccatggaatttagggaaaagaaccaataaattgggaaataaaagaacaagttcctctttccaggtctgccaatctctgactgtccagcatgagtaatttgagtgtggtctctgagcctcaatttcctcagtgagtaaatgagttggtagacttgatgccatcacagcttcrtgtagtggtgtggcttaagcacatggcctctgcagccatccttcccagcttcaaatcctggtgcaccccttactggttctgtgtagttggaaaaattatttgtctgtgcctcagcttgctcatctgcaaaatatagatgattgtctcagaagttgtgctaaagattaaatgtggtaactcatgtaaagtctcaagaactatggctgccacataatcataatgatactacgtaatcattagctatcactatcatagctgctttcaaatttctttgtttctacaagttaaaattttagccaa

SEQ ID NO: 70532 - DNA, 601 bp, Human
tggaataatataattggagacttggaaaggtgggagggttggagggagagggatgagaaattacttaatgggtacaatgtgcgttattcaggtaatggttacactaaaagcccaactttaccactacacaatatatccatgtaacaaaactatactagtaccctctaaaatttatattttaaacaaggttacttgtttctccttgcctgcaggtgtcccagggcaactcctttcatatcacagtaatgtcatcctctttgtctgtgcttgtcaccctcatagatacagagccatagatggctctcatatttagaaagagtttgggctacgagatcaagatgcaacagtcaagaatccagtgggtcacttaggaagagtaactgatgaaagagcaatgctagtgaggatgctgctgagactggccaggtgcactctgtgcagaacacccgtgagaaacgccaagcacgtatgtgtggcaggatggggcaagtcaagaaccaatacagtcatacaagctggaaaacttgggctccagacctatgctgacaaaattaattgtgtgaccatgaaaatgggcaagtcaacagaaaaacaaagtgta

SEQ ID NO: 70533 - DNA, 601 bp, Human
aaaactagacctctctctctcagtgtatacaaaaatcaactcaagatggattaaagacttaaatgtaagacctgaaactataaaaatactaaaagaaaacctaggaaaaactcttctggacattggtctaggcaaagaattcatgactaagaccccaaaagcacaagcaatgaaaataaagaaacagatggggtttaattaaactaaaaacttctgcgcagcaaaagaaataaacagagtgaacaaacaacctgcagcatgggaaaaaaaatatttgcaaactatgcatccaacagaggaytgatatccagaatttacaaggaactcaaacaacttaacaataaaaaataataacaccattaaaaagtgggcaaatgacaagaatagacatttctcaaaagaagacgtacaaattgccaaaaagcatatgaaaaaatgcttaacatcactaatcatcagagaaatgcaaattaaaaccaatgagatatcatcttatactaggggctactattaaaaagtcaaaaagtaacagatgttgatgaggatgcagagaaaagaatgtactgagtatctgccaaaataaagctgtaacctctgcttc

SEQ ID NO: 70534 - DNA, 528 bp, Human
cagtaacagagcaaaactccatctcaaaaaaataattttttttttttcaagacggagtctcactctgtcaccagggctggagtacagtggtgcgatcttggctcactgcaacctccgcctcccgggttcaagcgattctcctgcctcagcctcccgagtagctgggattacaggcacccgccactatgcccagctaatttttttttttttgtatttttagtagagacrgggtttcaccatgttggccaggctggtctcaaactcctgacctcgtgattcacccaccttggcccccaaagtgctgggattacaggtgtgagccgccacacctggcaaaaaaattaaaaaaattttaaaattaaaactatatatataattgtgtctggatgtgagattataagtatgttcaaatgtgtgtctgtattttccaagtaaattgttttcataagaaattaaatatattaaaatatggttaaaaaatctttgactactatactaggaaagtcgttcattatactatacaatatt

SEQ ID NO: 70535 - DNA, 476 bp, Human
cagtaacagagcaaaactccatctcaaaaaaataattttttttttttcaagacggagtctcactctgtcaccagggctggagtacagtggtgcgatcttggctcactgcaacctccgcctcccgggttcaagcgattctcctgcctcagcctcccgagtagctgggattacaggcrcccgccactatgcccagctaatttttttttttttgtatttttagtagagacagggtttcaccatgttggccaggctggtctcaaactcctgacctcgtgattcacccaccttggcccccaaagtgctgggattacaggtgtgagccgccacacctggcaaaaaaattaaaaaaattttaaaattaaaactatatatataattgtgtctggatgtgagattataagtatgttcaaatgtgtgtctgtattttccaagtaaattgttttcataagaaattaaatatattaaaatatggttaa

SEQ ID NO: 70536 - DNA, 601 bp, Human; identical to SEQ ID NO: 40167

SEQ ID NO: 70537 - DNA, 601 bp, Human
aagaagatcaaaacaactcaccccgcccttcccagagcctggccaagggcgcgccccaccagcgccagccccgacgggtccaagccaccggcggcggaagcacgcgggaggagcactcatgccggatctcaggcatgggccggagaggccgcagcgtagggctgggactggaggggcaggcagccgaaaaaagaggctgggcggcgcgcctcgcggggtagcaggggcggcgcgcctcgcttgcgtgacaccgggccgtccgggggcttacctggtcgccgagcaggcgggcgggtaaagstaggccgcgagagcgaggttaggagaggagaggaggccgcagtactgctcacacgctccgctcttctcccactctcgactctgcagggccgccagcagccccgcaccctttatccgcggcccggggccgcccccggtgccctgattggctcccagcggccaggagcccgggccgatcagctgatgcggtcccgggccccgcggccattgggcgaggagcccggcgggcgccgctggggtgggggcaagcgaactgggaaagaaagaaagaaagagaaaggggcgtgggggaggggcaggg

SEQ ID NO: 70538 - DNA, 601 bp, Human
aaccccagaggcagaggttgcagtgagccgggagattgcaccactgcactccaacctgggtaacagatagagactctgtcggaaaacaaaaaaaaaaaacctacaacccaatttctcggctgtcctctccaacatgttacaccaccaatatcatgcacactttgtcctaagcctcagtttcggatctcttgctcttttccgtgagccgagttgcatgccagcagcctagtgccactctatcaactgctgctgctgcggtgccaagtttacgtgggggaaatggattctgaagttttcagcmgtttctgcagctcccaccaactccggggtcgtcctccctgccccctcactcaccccagccacagaaagtcaagcgtatcgttagggttgccctctttaacccttctctttttggagtggcgttcgcgcctctcctctttctcagactctagctggtccaagcaccggagctttctgggagagggcgatggagaaggggacagacagcggccggcccggggggtgtccgaacaggcaggttggtgggttaaggtcttaatcttgactcgagatctctccccggagttcacagagtaggcga

SEQ ID NO: 70539 - DNA, 601 bp, Human
cccactgttttgaaggctgcttggtctctctagctgactgagttctctgaaggcagagacgagactctcactttgtatcttcagtgtctgtgcactatcatctgccacatagcaagtacacaatataggctttgtattatgatcattcacttactcaaaaaggaaaagtaaactaccctaaactaggtaggatatgatactttcctctggcccctttccagaagagggaagactatggcttgttctagactgaaaaatgaaggtcacaactataatctaactgtagctcctagagggataygcaattagtttaagaatttccaaaagtggcatcaactaaaaattagtcctatttaaaaaccattgtagagcatttgcttcacatctagaagccagtgatatgagtattaaacacagttttctaagagtttgtaaactagatggcattctcaggttagagcagtggttttctgagggtgccttagagccagctaagtggggatgtccaggtcggcaacctctaagccccatgccaactctccataaaccagacttagtttttcttcaatacactggcctacgtgcacaattccattgaaat

SEQ ID NO: 70540 - DNA, 601 bp, Human
attatctcttcctcaaagcagaagttcagggaaaagaatcactcagattcttaaaatagtgctgaaattgcctagtcttcccaatgctgatttcagaatgtcttctccctccccttcacagcattcacagattgaggaggggtatccatagctgtgctataacacacctgcaggccttcgattgtacttgaaaacttcacataacaccagcttgttagggtccttacggaaggggtcccgaaacatggcagcaggcacgagatacatgtcactgttggaaccctcagactgtaaagtactrgagccatcgaaattccactcaggcaactctggggcaaaaagagggaaaattacatttaaaacatacaggagctttccaagcaatgcaaatacagccagcccttcactcaccttcccatctctaaatatctcttttccaggaattcattaaggtataaatgccatcattaatatgtataccctggcacctgtacctgatcttatagcccttcctatttgagttccaagtaagaccattgtaccaattccttaaaagaaatatatcagatactcccttcccaaatgtcttccaggagacaag

SEQ ID NO: 70541 - DNA, 601 bp, Human
tcacatgggagtggatttagaacagggcaactttcaccttatctgcattctggccacctcccaagcaccaaatgccaggcacttaaccctctattcacaagacagctgcttctggttgtcagatttattcttcatttctcaggcacttggagccattctataatttttgagaaacatttgtccattggtttacatttgtcctggcctacattccaggcaggaaggctgttactggggactccaagaccggcaaacagatctggacaaatccaatgctattttatgcaaccaacagagaagmccatagaaagatgggccatattatctcttcctcaaagcagaagttcagggaaaagaatcactcagattcttaaaatagtgctgaaattgcctagtcttcccaatgctgatttcagaatgtcttctccctccccttcacagcattcacagattgaggaggggtatccatagctgtgctataacacacctgcaggccttcgattgtacttgaaaacttcacataacaccagcttgttagggtccttacggaaggggtcccgaaacatggcagcaggcacgagatacatgtcactgttggaac

SEQ ID NO: 70542 - DNA, 601 bp, Human
gaatctcctaaacctgttctcttctcacctgtactccaacccgttcttaggttttgggttagtgagtggtgtatcagcagcccttactagcaaaagtcctatgtacacctacctacccttcttcattgatggattggagctatacttacctgggcaggcatgacctcggcattagtccccgcaatcttgactccagcatacaagcaggcccggtaatgggcctccacgatgtccctgccataggctctgtctgctcccacaccacagtaatatggacctacagaagcatcaggacaaaacrctaagagtcaagaaatccagagaatcccaaagtcagagatcagaaggcccttaagccttgccctcttgaatcactatccttgccttcatctgcaggtgcggggcaggggaggggcaataggggagttcctcttcaccacagcttcagtggggccaaacgttccccctaaaaccttactttatatattcatatccatttttggactttggtgatgtgagggctgtttcgcctttactgtattattttgcttcttgattctgaaagtcattcccatccctgggaaggggcattcctgcacag

SEQ ID NO: 70543 - DNA, 601 bp, Human
cattccagttcccaggaatgggcttaggatcaaaggttgctatcactccaaagtcttcacacacacgatgcaagatgaaacgggccacccagagatgatctcccatgctgattccttcacaaggtccaatctgaaattcccactagaaacgagaagcttggccattaaaacaaagctaactgctcactccaactcagaatctcctaaacctgttctcttctcacctgtactccaacccgttcttaggttttgggttagtgagtggtgtatcagcagcccttactagcaaaagtcctatgtrcacctacctacccttcttcattgatggattggagctatacttacctgggcaggcatgacctcggcattagtccccgcaatcttgactccagcatacaagcaggcccggtaatgggcctccacgatgtccctgccataggctctgtctgctcccacaccacagtaatatggacctacagaagcatcaggacaaaacactaagagtcaagaaatccagagaatcccaaagtcagagatcagaaggcccttaagccttgccctcttgaatcactatccttgccttcatctgcaggtgcggggc

SEQ ID NO: 70544 - DNA, 601 bp, Human
ccatctcctccaagagcagaggtaggagacagttgaagcaaacaagcaattctgtaaaaattacctagaaaccctacaaatttgattaaaatctaaacttctataattttgctttttaaaaaatttaatatcaaaaggcctgctttagtgacatgctattcctaccagaaaataaccccaataccccctctgtcagtaacatgctcaagttgaccagccaactcttatctctaaacctatgtggacaagtgtgtcttttaaaccaaagccacggagatcaagtgactgctagtaacgtgtygtctgttaactaatccagtgcccaccttctccagagggtgggcagggcagaaacccaaaagggtcttgagggcctaatcccagatcaccatctaagaaccacttcccttgctctctactcaaaatgagatgctttatttctaatccgactatttgtctcaaatttggtgccccgtgacctggatggttttttcctttagcaaaacacacataatccacaaaaccatacatatagttttttgtctttacatttaaatataaaaatactattctgctttgtgtgataaatcaaggaccaagc

SEQ ID NO: 70545 - DNA, 601 bp, Human
tattattcatatctgaacagctgccctacttccacagaattttaaatagagaaaattaagacataccatccttaaaaccacaaataaccattaagatgcattaaatactcattgactcaataagtctatttctggtaatctaatctcagggaatgcagaaaatgaaaatgttcattgaagtattatgaaaatagtaatgagaaatttaaaacaaatgaaatatcctacatcagagaattattttatatatatcttatcatatatatcccccaaattaggtaatttatatccagtggatatratacatactggatattataatatctggcggatattatatatcaattcacatgatgactagaaaggccatgacgctctaggaaagtcacttgtgcaataatgtgaagtgaaccagaaggatccaaaactgtttctatgccatagtgatcaccaaccacgttcttaaaaacaggaagctaagaagcacatgaaaacagactggaaacatccaggtggctgggaatcatggctgctttttttccccctttattttacacatttcatgtaatgttataaaatttatttttataactaaaaggta

SEQ ID NO: 70546 - DNA, 601 bp, Human
aactcggagatgataaataactcacctaatgtcactcaactgtaaataatggagcaggaattcaaattcagattgtatgcatcagggaccaaggctctaactaacatactatttaattattttaggtgcttggtaatgtgttctagcagtagcaacagcacagaaacaataagaacaactacattaatgtcaataacaacaacagcaacaactaccatttattgagttcttactatgtttcagtcagtgaaggaggtactttatatgagttttctgattgaatccacatgctattcatatsgggtaactaccacttattctaatttataggtgtgggaactgaggttccgaaaatttaactagctgcttaaggtcatacctgttgtgaatggtctggctggaaaataaatcaagatctgtcaggttccaaatatctgcttctaaccataatgttccactgccttgttttaattagaaacttagttcacactgggtaaagatattacaatggattccaaagagtgacccgcaaacagacaacctatatgaccttagcaaagttgttaaacccctgctgtgaaaccagtgtcaaccatgctaa

SEQ ID NO: 70547 - DNA, 601 bp, Human
tactgctttctcttatttttaatttggtgggggtaatgtcttcccttttatcactccagaactcaagtgatttttctagaaaatactaaacatttttcagacaatgacataacttcaaatcaaaggtttacttttaaaataagccatttcccccatgctacttttcatcctttcctaccggcactctctaccccacaatgatatctcattcctgggaggatggatggaaagctgaacaatatggggcgagctcagaactctctcttcctatctaagggtttaaggatggggttggaccaaygtggaccaacatgaagctaaaaccttggtgctagggtctaggagtgggaccagctcagcacaagggagcacacacagggtatgggtcatgtgattagccttggaaccatacagcctcagggaggtgatgtcatgaagtcgaaggaatctctttttttcatgttctttcccactagatcctgaatgttcttcaagaccctcaaagctttcctgattcctaaaaaaaatattgatcatttccctttgaacatcacatataacgcttgaacttttacttttcctcaatgtaaccctgagatat

SEQ ID NO: 70548 - DNA, 601 bp, Human
gtttaaagaggtcctaggccaggtgcggtggctcacgcctataatcccagcactttgggaggccgaggcgggcagatcacctgaggtcaggagttcgagatcagcctgaccaacatgaagaaaccccgtctctactaaaaatacaaaacattagctggatgtggtgatgcatacctgtaatcccagctacttgggaggctgaggcaggagaatcgcttgaacctgggaggcggaggttgtggtgaactgagatcatgccattgcactccagcctgggcaacaagaacgatactctgtcccraataaataaataaataaagaggtcctaataccaaaatatttgagaatggcttctatggagcatagtataatatgctgcctctcaatattttacttttatgtgtactgctttctcttatttttaatttggtgggggtaatgtcttcccttttatcactccagaactcaagtgatttttctagaaaatactaaacatttttcagacaatgacataacttcaaatcaaaggtttacttttaaaataagccatttcccccatgctacttttcatcctttcctaccggcactctctaccccacaa

SEQ ID NO: 70549 - DNA, 601 bp, Human
taatagcagttcacacttaattgagtgtaaccgcgagtcagcttcagtactaagccccatatgccttttatttaattttcatgacaatagaaaggatatagagaatttgaaaccaggagaacagaatgaatgaggctacagtggacctgggggaatgagagagggcatgtgaggaactgtagaaaatagggttagagagggtcttggaacactgcaagaggagtcagaaagtgacgtggagggtagcacacagtcacatgaagatggccacacttgcagctcctctctcttgacctcctgyctctatgagggctttgttctgtcctaccaccatgagggacagtgaaaatgacacttaaaaatccagtgctcctggcagcccatgactgatacagctaaactcaagtagaaaccctggcacagtgcctgggaaaaagggaaccaacatctgttgagtgtgacctcagacaagtgacttccctactgggccccagttcctcatccacttgttaatagaatagagccagttgatctctttcactatatgcctagctttgggctgtgattttttacaggtattatttcacttaatcctctctga

SEQ ID NO: 70550 - DNA, 601 bp, Human
aatgtaattagaccagtcagagatatctaatggaagagaagtggggagtgatgggtttaatagcagttcacacttaattgagtgtaaccgcgagtcagcttcagtactaagccccatatgccttttatttaattttcatgacaatagaaaggatatagagaatttgaaaccaggagaacagaatgaatgaggctacagtggacctgggggaatgagagagggcatgtgaggaactgtagaaaatagggttagagagggtcttggaacactgcaagaggagtcagaaagtgacgtggagggyagcacacagtcacatgaagatggccacacttgcagctcctctctcttgacctcctgcctctatgagggctttgttctgtcctaccaccatgagggacagtgaaaatgacacttaaaaatccagtgctcctggcagcccatgactgatacagctaaactcaagtagaaaccctggcacagtgcctgggaaaaagggaaccaacatctgttgagtgtgacctcagacaagtgacttccctactgggccccagttcctcatccacttgttaatagaatagagccagttgatctctttcactat

SEQ ID NO: 70551 - DNA, 601 bp, Human
agaagttgttcttctgaacaaataagaatgtttttaaaggtagagacttgttctttcaaagaatggaggagtctttgcacttctacagccacttgagagatgtctaccaactttgcttttttaagttcgaaaacactgatactttattcagtaagatagctgattgagagatgtcagtactttggtaggactagccaaataggagacttcaatgtaattagaccagtcagagatatctaatggaagagaagtggggagtgatgggtttaatagcagttcacacttaattgagtgtaaccgygagtcagcttcagtactaagccccatatgccttttatttaattttcatgacaatagaaaggatatagagaatttgaaaccaggagaacagaatgaatgaggctacagtggacctgggggaatgagagagggcatgtgaggaactgtagaaaatagggttagagagggtcttggaacactgcaagaggagtcagaaagtgacgtggagggtagcacacagtcacatgaagatggccacacttgcagctcctctctcttgacctcctgcctctatgagggctttgttctgtcctaccaccat

SEQ ID NO: 70552 - DNA, 601 bp, Human
tctcgatctcctgacctcatgatccgcccgcctcggcctcccaaagtgctgggattacaggcgtgagccactgtgcccagctgcagggatgttcttaagtttgccaagtctagagggagtctggaaacctcagtccacagtccggcattatgagtgatttcttatgtgttcttgtacaagccattttaatttctctcacttagtttctcgcatgtaaaatgaggttaaaaccaagtttgtaaaatgggataatttttaatagcacctttaaaagagcaaagcatgtctataatagaagttsttcttctgaacaaataagaatgtttttaaaggtagagacttgttctttcaaagaatggaggagtctttgcacttctacagccacttgagagatgtctaccaactttgcttttttaagttcgaaaacactgatactttattcagtaagatagctgattgagagatgtcagtactttggtaggactagccaaataggagacttcaatgtaattagaccagtcagagatatctaatggaagagaagtggggagtgatgggtttaatagcagttcacacttaattgagtgtaaccgcgagtcag

SEQ ID NO: 70553 - DNA, 601 bp, Human
gcgcgatctctgcttactgcaagctccacctcccatgttcatgccattctcctgcctcagcctcctgagtagctgggactacaggtgcccaccaccacacccggctaattttttgtagttttagtagagacagggtttcatcgtgttagccaggatggtctcgatctcctgacctcatgatccgcccgcctcggcctcccaaagtgctgggattacaggcgtgagccactgtgcccagctgcagggatgttcttaagtttgccaagtctagagggagtctggaaacctcagtccacagtcyggcattatgagtgatttcttatgtgttcttgtacaagccattttaatttctctcacttagtttctcgcatgtaaaatgaggttaaaaccaagtttgtaaaatgggataatttttaatagcacctttaaaagagcaaagcatgtctataatagaagttgttcttctgaacaaataagaatgtttttaaaggtagagacttgttctttcaaagaatggaggagtctttgcacttctacagccacttgagagatgtctaccaactttgcttttttaagttcgaaaacactgatactttattca

SEQ ID NO: 70554 - DNA, 601 bp, Human
aacaagtttctcttcaaaatatctgtttggtcacaaggatggctggccttactgaccagaacaccactcctggtgttaggcatttcctctatgggctactcccaaagccaaagtgaattatgttcatcctggcttgaggtctttgtataatggagaactcccatatttagatgaaagcaagggtcttgctggcgatatccctggggactgctaggcaccacgttttagaagggaatagcagaaccatttgaccacaatctattaaattttggttccttccagtaaaaaataatcaggacamatgtctgattcctaagcagggatgttctttttttttctttttctttttcttctttgagacagagtctgcactgttgctctggctggagtgcagtggcgcgatctctgcttactgcaagctccacctcccatgttcatgccattctcctgcctcagcctcctgagtagctgggactacaggtgcccaccaccacacccggctaattttttgtagttttagtagagacagggtttcatcgtgttagccaggatggtctcgatctcctgacctcatgatccgcccgcctcggcctcccaaagt

SEQ ID NO: 70555 - DNA, 601 bp, Human
ctttaaaatacatcctcttactttaaaatgtttctaatcaaggataaagaaaacaaaaatgtgttcattagtgtcctaaattagatgagagttttgtttggatttcactctgactcacacatttctcctcttagaaagcaatacaagaattgaaaacaagtttctcttcaaaatatctgtttggtcacaaggatggctggccttactgaccagaacaccactcctggtgttaggcatttcctctatgggctactcccaaagccaaagtgaattatgttcatcctggcttgaggtctttgtrtaatggagaactcccatatttagatgaaagcaagggtcttgctggcgatatccctggggactgctaggcaccacgttttagaagggaatagcagaaccatttgaccacaatctattaaattttggttccttccagtaaaaaataatcaggacaaatgtctgattcctaagcagggatgttctttttttttctttttctttttcttctttgagacagagtctgcactgttgctctggctggagtgcagtggcgcgatctctgcttactgcaagctccacctcccatgttcatgccattctc

SEQ ID NO: 70556 - DNA, 601 bp, Human
cacttctcacatgaaatgaaaatggttaacagttaattatcatctatttttcctaaagaaggtgctgcagaattctgttttctttcttagtagacagggaaggagattgtgtaacattacaaaattgccagaaaacccctttgtctttaaaatacatcctcttactttaaaatgtttctaatcaaggataaagaaaacaaaaatgtgttcattagtgtcctaaattagatgagagttttgtttggatttcactctgactcacacatttctcctcttagaaagcaatacaagaattgaaaayaagtttctcttcaaaatatctgtttggtcacaaggatggctggccttactgaccagaacaccactcctggtgttaggcatttcctctatgggctactcccaaagccaaagtgaattatgttcatcctggcttgaggtctttgtataatggagaactcccatatttagatgaaagcaagggtcttgctggcgatatccctggggactgctaggcaccacgttttagaagggaatagcagaaccatttgaccacaatctattaaattttggttccttccagtaaaaaataatcaggacaaat

SEQ ID NO: 70557 - DNA, 601 bp, Human
tgagtaggtcgaggccttcacaggtgctactccggcagtcgcctgagttatgaatcagaccatccgaatacatgaaagtagcgttcacagtcacatttaggcctgtcgcccagagatgagggaaaatagaacactagtgttatttttcagtaatttatatcagccatgagattgattctgggaaaaaatggatatccattttcaggcctaggaatatttacatcctgagcccttgttttactcctggtcacttttttcctctgtgtgtctctgtctctctgtatcttttcatctctgtttttctctctctctctcaacagttttattgaggtataatttatctatcataaaaatcatccatgttgagtttacgattcaatgacttttagtaaatatatatatagttgtgcaaccatccacatggtccagttttagaacattttcattgtgttcactgacctcttcatcttttcacaaccctagatgcagcaggtctcctgtatggactggagagtgttgggaagcaaagacataaacattatgataacctgttctttcatggtccccaggtgctatttgttgccaacttgcaggaggctgc

SEQ ID NO: 70558 - DNA, 601 bp, Human
agtgagtaaaatgctatgcaattgattgggtgattattgatcttattttctcctatttcttaaggggaatctggttgggaccatctcatccctggttttggagaaccaggttatacctctctctgtagaggcagagaaaagcagcatatatttctgaaattgtgatgtggagtttattgaactatgcttgtgcacaccttaccttcccaagattgagaatcactgctgtggtagccattgttcctgatgggagtgtggcctgcctggttggtgtgatgttattgattaaagtttagagccrtggctctactcccagtgctctgctgctaagacagccttttctttagtttctgtattaagggggtgcattgcacatctgcttgtctctagagagcttttaaccctctttatttccttaaagctctggttgggattggggtttggggattaggaggaggaactaggcaagaatctccctcttcccattttcatcctttgacattgaagttactactttaagttaggtggcagattcaacgcttaagcaattaactatgacctgatatatggtgatgacttgaaacagagatttctggtgtgg

SEQ ID NO: 70559 - DNA, 601 bp, Human
gaacaaatacaaggaagagtaagattctggatctgtccgcattttggtatggaagagaagctgaaaaagtgctcagtgaacctgagcatctgaggctgtttgtaatggtgggtgtgaggtgacaaaagcaaactttgcaacagaattttcagaggtctaatgtttactctccaaaatccattgcaagtgatattctgcacagttttctctgtgtcgatgaagcgtgattcttgattcagggtcagattgaacaggtacaaaaaaggaacttgagcaggattttgattagggaaggtgtaaktagcagaacaaagtattttttggtgataattacattgtgtaaaatgaatggaagagatgagggtgattttcccagagccagaaaaatatattcattctagaatatactgagagctttgttctaagatagtaagggcactgtacaaaggactttaacatgtcatttatataattctcaaataacatgaactaaatatattgttattttccccacttttaccagacctacaggatagaacagaaccctactagtaccctggggtgttgcactttcttttgtgtttcccaaccctctacccat

SEQ ID NO: 70560 - DNA, 601 bp, Human
aaaatgctttgcacgtagaaggtcttcataaatggtgaatcaatttttccaatcctcctttccttttgagcatactctgtagcaatattagtaagtgatcaggttagatgacagttgggaacaaatacaaggaagagtaagattctggatctgtccgcattttggtatggaagagaagctgaaaaagtgctcagtgaacctgagcatctgaggctgtttgtaatggtgggtgtgaggtgacaaaagcaaactttgcaacagaattttcagaggtctaatgtttactctccaaaatccattkcaagtgatattctgcacagttttctctgtgtcgatgaagcgtgattcttgattcagggtcagattgaacaggtacaaaaaaggaacttgagcaggattttgattagggaaggtgtaattagcagaacaaagtattttttggtgataattacattgtgtaaaatgaatggaagagatgagggtgattttcccagagccagaaaaatatattcattctagaatatactgagagctttgttctaagatagtaagggcactgtacaaaggactttaacatgtcatttatataattctcaaataa

SEQ ID NO: 70561 - DNA, 601 bp, Human
cttctctgctgactttcctgtcatcagtctgcctgtgtctttcctatacactgtggtcaatcattcttctgaaagttggctgcttctcatggcattcccaagcttaaaaccttagtgatttctgatgtgagtctcattaaatgcaacttccttcacctggactttcctcccatgaacttccaaatatggtcctacttaattttcctagtcttatctctattattcccctatacatttcctgaactctggttaatacagagttcttcatttccctgcttgtttgcttttacatgtacttctytccctctgcctggctagaaagctcatctcctcatctctctactcattaaaattttacccattcttcaacatgcaaacaatcgcatctccttcataagatttttttcctccattgaagcttagtcccctcaagcagaggtgacccttcccttctgtgcactctatagcttctcttttcttttctcttctctctcccttcctctttctttttctcctctctctctttctttctttcccttccttccttccttccttccttcctttcctttcctttcctttcctttcctttcctttcctttcc

SEQ ID NO: 70562 - DNA, 601 bp, Human
cttgtaaacatacgaagtgctccaggaataagttttgaagggcagatcgttggttttccaaaagttaaccaagaagtacatcaactttctagctggagacatcagcctggttaaggtttctttatagtcacatgacaatccaaaacttccagctgagatcatggggtagctcaattctgtgtcaaggctatgtcaagaggttgaggaaaaaagccattatcagtattaacttaagtagcacaaataagatccctctttaacctgtttcagcatgtatgtataaatggtaagaatgaaatcrgatcattaaagcaggtttctcatgtatataggtgtctttctcatacagctaagtttaaaaacatttattgagcacatgctatgttctaagcacactctaagcaattttgtgaatatgtggcttggttacttcgatttattctaaagtgagtcatcatgatatctgggctgggatacaggggaagtcgggctaagaaaaaggatggaccaccacagccaccatagttgttgtaaagccaaaaagattccatctacactttgccatgcattgccttctccccagcttgttcacctcggtatc

SEQ ID NO: 70563 - DNA, 601 bp, Human
ctgggattacaggtgtgagtgaccatagacagccaggattctatgttgactgagcaggcctcagtcataaatggacatgtgggttcaatggggctataataaaccttttatatttacaaatggtgaaggtgtcaaaggaatgcatctctgctaaagccacaattagctaaataagaatgacagtgtgacagagttcaaatattatcatcatacttaaccccataaggggttgtacaaagcaagagaaaagagaatgtgccttctggaaatccttggaatacttcctttttgaaaggaggagggtttttccaaatgttatacctacttgaaaagatccactagaataatgacaatgtcttcagccactgctcggtcacccttcagcttgtagaggaactctggaccaccacacataataatcactggaggagaaggtaagacaaggagagaaatatatgacagtctacagacaaacaggcagggaaccagttgcctgaatttgaatccagtatgttaatgttaaattttttaaagataaactccaattccttaaattcctccttccttttttttttcatttacaattatagagtcagaatag

SEQ ID NO: 70564 - DNA, 601 bp, Human
cttttatttttattttgttttattttatttttagacagagtttcactctcatttcccaggctggagtacaatggcatgatctcggctcactgcaacctccgcctcccaggttcaagcaattctcctgcctcagcctcctgagtagctgggattacaggcgcccaccaccacgcccagctatttttttttttttttttgtatttttagtagagacgggttttcagcatgttggccaggcaggtcttgaactcctgacctcaggtgatccgcctgtcttggcctcccaaagtgctgggattayaggtgtgagccaccacacccagcctcaaatgctgtggtttctaagcttcctattatttggagatttgaaaagaatctggtatgtttgaactgctgcaattaggctgaccattatttaatgtttttatttaaaaactttttttaggagacaaggtcttgctacattacctaggctggtcttgaactcctagattcaagctatcctcccgcctcagcttcccgagcagctgggacaacaggcatgcactgctgtgcccagcatatttaatatttgaacacatctactatgtgctgagaactg

SEQ ID NO: 70565 - DNA, 601 bp, Human
gcggagcacctgagttcaggagtttgagaccagcctgtccaacatgcagaaaccccatctctataaaaatacaaaaaaattagcctgctgtggtggcacatgcctgtaattccagctactcaggaggctgaggcaggagaatcacttgaacccaggaggtggaggttgcagtgagccaagattccactgcactccagcctgggtgacagagtgaaactccatctcaaaaaaaaaaaaaaaaaaaaaagaaaaaaagaaagaaagaaaaaaaaaaaactcttccttgggtcagtgttctttwtgatcccatgtcacaattctgtcttctcttggaatcaataaaatgagggaagcaactataagcagttatacttcattcccatgatgaaaaacatacaaatgcaaccaggaaaggcaacatgaagcattttcataattcttataagattttatatagaaataatgttagtttctagttgattgtttttattaaagtgcaaaagagaaacccaaaaatcaaaaaccaaaaacaatccctgcgtttaagtattctgagtggaacatgagcagttttgattggatgatgccactgaaattgctt

SEQ ID NO: 70566 - DNA, 601 bp, Human
gctcttagtagaccagtaccttcaaaagtgagattcctgaaagcatgagcaaatttgggggtggtaatattttctccattttcaagaaatatcttcagcatatgtccaaagagcaggattccattcaaataggcaagagcaaagtctcgttttgtctaaataaaaaaggaaaatattaaaacgggtccttcaaaaaagaatcttgtcttgagcctagaacaaaaggttgttgggatcagcagggttactggaaagttaaagggatatcaggggaattgaagggatgttattaaaggagacktttagaaaactcttccttggaggccgggtgaggtggatcatgtctgtaaacccagcattttgggaggctgaggagggcggagcacctgagttcaggagtttgagaccagcctgtccaacatgcagaaaccccatctctataaaaatacaaaaaaattagcctgctgtggtggcacatgcctgtaattccagctactcaggaggctgaggcaggagaatcacttgaacccaggaggtggaggttgcagtgagccaagattccactgcactccagcctgggtgacagagtgaaactccatct

SEQ ID NO: 70567 - DNA, 601 bp, Human
ggcgtaattgtgaagttgaaatgaactgtcttcagatcctaaacataatttctctaattcttttgctagtgctcctcttccaagttacccctcctcacccagtcacagcaccctgaattttctgataagcagtgagacatactttcttggtgtccacagaggtatacagaagcaccatggtactgtcaacatccccccagtcatccaaggtcactggaccgtcataccctagggcaagatcagagtatgttagaggccattcttgatttttgcctgacagataagttggatcatgacagasagtgtaaaatgggttcaaatagctctgtttcaaatttactgaaaacattgttgacattaatagtctaatcagatggcacctggattggcttcttagcccagagatctctggagggcatttttatgggagatgtatttatttagaaaaagcaaaaaaccttttcattgcatttagggtggcactaaatgtaatgagtcaataagtccctcgattattagtgatacatttttgctaagaatatttcctgaactcctagcatagtgtatagggtcactgcacaatcttaacatagattgtagg

SEQ ID NO: 70568 - DNA, 601 bp, Human
gtactacattattgaaaaattcacccgaatttgcttatagagagaataaatgcacaaagcaacattttccattttgaagtatagttatgagactgacattagatctcacacgtttctgcctctctctgtgaagatcatgggcatcatcccagatgcaaataactcagagaggaatgcatgtacctttgtaatcgctattagtaactgaagtattgatgggatcttatgttaaggtattcttacggaatgtatgcgaaacataacattatattgaaggttcaatatagtatctagaaactaygaattacatttatggaatgctgctagcaaatttctggtttagctttctcaacgtggacatcttttctctagcttttcacattttccattgcagatatcttttacaaagctgggttgatgtacacatttagtatatgacttagactgtcataacactcacattggaaaatgaaaaaaaaaatgaataaattttatgttatgtcaggacctgacctcctatataaacctttttactgaccacttggttggctggaacagtggcttttatagtttggatggatacaacattggatgacatgaa

SEQ ID NO: 70569 - DNA, 601 bp, Human
aataagaaactaatacagagtcattgtggaaattttggaaaattcagaaaaatagaataaagcaaaaaaaatcttgcaggatcccatcagtcagaggacaccactcttaacagtttaacatatttctttccagtcttatttctatgcattgttttacaaagttagaatctcattaaataagaagctgtacttttctattactttacatcataagttttcccatgtcatttaacattcttcataaataattatttttaattggttgcctgatgctccatttgtgaatatataataattttctttttttttttttttttttttgaggcagggtcttgctctgtcatccaggctggagtgcagtggcacaatcatggctcactgcagccccaacttactgggctcaagtgatcctcccacctcagcctcctgagtagctgggaccacaggtatgcacctctatgtccactaatttatatatatatatttttgagacggagtcttgctctgttccccaggctggagtgcagtggcgtgatcttggcttacaacaacctctgcctcctgggttcaagcgattctcctgcctcagcctcctgagtag

SEQ ID NO: 70570 - DNA, 601 bp, Human
gcttattaaataaaactcgactttaaaaagcaatcatagcaataaatctgaagtcagctcaggattgcttattgtctagaagaatgccatcttcattcccccctccctcatttcgttaatcagctgctaatacctgttggataaaagtacaggaatcattttggacttaatttgactcatggagtgaaagaaaactagaaacgcaggtatagctctgacacaagcaagcccttcaaaccagaaatgttccctttatatcagatcaaattttcagagtttctggctgtagagcggggctggyataaaaatatttgtagcttataatttttaatactttttgaaaataagaaactaatacagagtcattgtggaaattttggaaaattcagaaaaatagaataaagcaaaaaaaatcttgcaggatcccatcagtcagaggacaccactcttaacagtttaacatatttctttccagtcttatttctatgcattgttttacaaagttagaatctcattaaataagaagctgtacttttctattactttacatcataagttttcccatgtcatttaacattcttcataaataattatttttaat

SEQ ID NO: 70571 - DNA, 601 bp, Human
tttacactgttggtgggactgtaaactagttcaaccattgaggaagtcagttctctttaagtaaagagaactctctcaaaaagtactttttgagaagttcagcactttagaaatcacagacctattgaataaccaaaataccaaaaaacttgaaggaaatacattaaaaacacaaacctaactttgtcactgacagttataattaagaagaaagaaaaaataatttgaactcaaaaagttacaaaagaagttgagagttgcagaagcccatgagaaaagagatatatttcagaagtcaagyttggtttaaaactagaaagcttgaagatggttccagaaagttttaaaagcttattaaataaaactcgactttaaaaagcaatcatagcaataaatctgaagtcagctcaggattgcttattgtctagaagaatgccatcttcattcccccctccctcatttcgttaatcagctgctaatacctgttggataaaagtacaggaatcattttggacttaatttgactcatggagtgaaagaaaactagaaacgcaggtatagctctgacacaagcaagcccttcaaaccagaaatgttccct

SEQ ID NO: 70572 - DNA, 601 bp, Human
tatgaatatttaatgttcactttaggaacacttttacactgttggtgggactgtaaactagttcaaccattgaggaagtcagttctctttaagtaaagagaactctctcaaaaagtactttttgagaagttcagcactttagaaatcacagacctattgaataaccaaaataccaaaaaacttgaaggaaatacattaaaaacacaaacctaactttgtcactgacagttataattaagaagaaagaaaaaataatttgaactcaaaaagttacaaaagaagttgagagttgcagaagccyatgagaaaagagatatatttcagaagtcaagcttggtttaaaactagaaagcttgaagatggttccagaaagttttaaaagcttattaaataaaactcgactttaaaaagcaatcatagcaataaatctgaagtcagctcaggattgcttattgtctagaagaatgccatcttcattcccccctccctcatttcgttaatcagctgctaatacctgttggataaaagtacaggaatcattttggacttaatttgactcatggagtgaaagaaaactagaaacgcaggtatagctctgaca

SEQ ID NO: 70573 - DNA, 601 bp, Human
ctggcatgcaatggcacgatctcggctcaccgcaacctccaccctccaggttcaaagattctcctgcctcagcctcccaagtatctgggattacaggcgcacgccaccatgtccagctaattttttgtatttttagtagaggtggggtttcatcacgttggccaggctggtctcgaactcctgacctcaggtgatcagcccaccttggtctcccaaagtgctgggattacaggcgtgagccactgtgcccagccatgtgtgaatttttctgtgctaaaatataattgatgtaggtgccccraaaatgaggttttaggacttctttatgaaagcagaatcctaaaccttcacactgtattctctatcatgacaccataatctaaactcctgggggcacagtccatgtcctacttattcattcctgttcatccttacacctttggcacccagcacaagacctggtaaagtatcaataaaaatggctaataaaaaataatagaagaaaaacctggccctgatcatcttattgcctgagaagaggcaaggagaaggtgcttggacattaaaatacataaataaattcatatagaaagactcctgt

SEQ ID NO: 70574 - DNA, 601 bp, Human
agtaaaagcagaagtgactgagagagcagagatgcacagaggtgggatcaggtgcattcactttccattatgaacacatctgctactggattttaaaatcatgtgtgtgaatttttctttttatttttctgagacagagttttgctctttttgcccaggctggcatgcaatggcacgatctcggctcaccgcaacctccaccctccaggttcaaagattctcctgcctcagcctcccaagtatctgggattacaggcgcacgccaccatgtccagctaattttttgtatttttagtagagktggggtttcatcacgttggccaggctggtctcgaactcctgacctcaggtgatcagcccaccttggtctcccaaagtgctgggattacaggcgtgagccactgtgcccagccatgtgtgaatttttctgtgctaaaatataattgatgtaggtgccccaaaaatgaggttttaggacttctttatgaaagcagaatcctaaaccttcacactgtattctctatcatgacaccataatctaaactcctgggggcacagtccatgtcctacttattcattcctgttcatccttacacctttg

SEQ ID NO: 70575 - DNA, 601 bp, Human
ggctcatacctgtaatcccagcactttgggggggctgaggggccgatcacctgaggtcaggagatcaagaccagcctagccaacatggcaaaaccccatctctactaaaaatacaaaaaattatctggccgtggtggtgggtgcctgtaatcccagctattcgggaggctgaagcaggagaatcgcttgaacccgggaggtggaggttgtagtgagccaagattgcaccactgctctccagcctgggcgacacaatgagactccgtctcaaaaaaaaaaaaaaaaaaagaaagatgttatcacggtatacaatttagctttatataaataatattcacataatgaaaatgtttccttgttttcaacttatagaatcaagttataggtaaagaacagaggtctttattttggttaccaaataaatattatcaaccctggcaaagaaaaatataggagaattttggagatgggaaggaggtagaagaaagaattgtggcactaacatcttcatcttacaaagtgggaggcaagatattttatatacaattgataggacaacactagaagctcatgcatattaattaaaatgaaaaaggtgttc

SEQ ID NO: 70576 - DNA, 601 bp, Human
gctatatagaaagatgttggccgggtgcggtggctcatacctgtaatcccagcactttgggggggctgaggggccgatcacctgaggtcaggagatcaagaccagcctagccaacatggcaaaaccccatctctactaaaaatacaaaaaattatctggccgtggtggtgggtgcctgtaatcccagctattcgggaggctgaagcaggagaatcgcttgaacccgggaggtggaggttgtagtgagccaagattgcaccactgctctccagcctgggcgacacaatgagactccgtctcaaaaaaaaaaaaaaaaaaagaaagatgttatcacggtatacaatttagctttatataaataatattcacataatgaaaatgtttccttgttttcaacttatagaatcaagttataggtaaagaacagaggtctttattttggttaccaaataaatattatcaaccctggcaaagaaaaatataggagaattttggagatgggaaggaggtagaagaaagaattgtggcactaacatcttcatcttacaaagtgggaggcaagatattttatatacaattgataggacaacactagaagctc

SEQ ID NO: 70577 - DNA, 601 bp, Human
ctgtttgcctttgctttttggttatttgacaaactcattctcaccttctcaaggccatgccttccttaatgtcccctaagcagaaatgattattctctttgtatgcttccatctaagtctgagtattcttcaagtaaatgcatgtaaaatagcatattactgaccctaagacctggaggcaagtaggatgaatatcaagaccttaaaggctcttgggttctcagctctgtaccccaggagactcttgggacccagcagagccaactgtcattcatactgaattaggggatttcttaaatgrtttgctagttttcttgcataggctgttgtaatggcaaactgcatgtgtaccacctgtctgccaggccccctcatgggcatagcattgcactggtcattaggaagccccatctctgcctgccatgtttagagacaatgagaaacacctgttattatctttgatcttgtgatttaccctatcttaaagtgattcccatttagatttgcttttgggggaaaattttggtttcttctcactcttcactaaatggtcaccacacattgtagaccatcacctgtatttctgagcaacacagttaca

SEQ ID NO: 70578 - DNA, 601 bp, Human
aatatgccaataaaatgtgttttgtttcagatctttgagaagatgtgttgtcttaacaaattgaatgtcagtacccattgcttatcacacattatatcaatctcattcaacaaactttcctttgtcagtaagaggccttgaatataaactttactttcaaataatatcaggtccactttccaggaaagactagtagatttccagaattttttacaccgtcaacctcactttccaatatctcttggtagaattttcaacaagaaatatagtcaccatttcttggcctgagggcttttctgtyagcctcttactccaccagcaacctcagtgattagaggaaatgaagtgaagttatttctcaagggtttgaagtaagggctacataccttgttcaattctatcttctgtttttcagtgaaattaccatcattgtgcttgagatctttgagaatcactcgctgcaaaaatcaatgaaatttaggagacactgttgtggtgtaactctttacatgcatattataacagtttgtttgtgtgtctcactagactataaacttttgagagcagtgacagtatttgattgattttttatatttattta

SEQ ID NO: 70579 - DNA, 601 bp, Human
ttctcattatctatataaaaactattttaaacttaaacaaaaacatgaacatactccaaattcatttaacattgaacaaagtcagcataggattgaaactaaaatctatagttgtgaatatagatgaagaaacgtactaaaatactagaaatgctaagccagttgtatacacaaaaagcataacacaaataattggatatggttaattctatgaatggaacaatattattataatgtaccaaatcaaaaggtcataggagaaaaaccacatgagcattttaatggatgattaaagtgatcrttttaattgatactgataaaataaatacaaatttctaggaataataataactatttcaggtctttcaaaattagaaacgtttttcacatgaggtctagacctcatttaatttcaatgagacagaaattttagaataccaattaatagagcctagtcaaagggtttcacatggcttattattccctgaaactgattcagaattggcctaattaaatatttatttttttgaaacagatttcatgattatattgcttctgaaactttccctttttaaagattacaatttaatagtcatgaagt

SEQ ID NO: 70580 - DNA, 601 bp, Human
catcccaaatttcagttcttccatcagacaggtgtagaggaataagcagcaggtggggagactgcttaacaagtgactgccctgcatgttctgtctcatctaaattggacccatgttttaaaacaggcaattgctataagaaaattccttcattaggcttgtgtttttactcacataatcagttatataaattagcttaattgctcttttttttttgagtttactaagtcctctgtcaataagagagatcttggatttttttgtgaattgtatgacctggaattttctttgtttttttttkttttgttttgtttttgagacagaatcttgctctgttgcccaggctggcatgcagtggcacaatctcagctcattgcaacctgtgcctccggggttccagccattctcctgcctcagcctgctgagtagctgggattacaggcgcatgccactatgcccagctaacttttgtatttttactagagacggggtttcgctacgttggccaggctgatctcgaactcctggcctcaagcaatctgcccgcctcagcctcccaaagtgctgggattacaggcacaagccaccgcgccccgcctat

SEQ ID NO: 70581 - DNA, 601 bp, Human
attggaattccattgtctgggatttcatgaacctgtgttttttccttttctgcataagaagcattgggtggtttttgccacctggatatgagcaggaggtacccatagcatcccaaatttcagttcttccatcagacaggtgtagaggaataagcagcaggtggggagactgcttaacaagtgactgccctgcatgttctgtctcatctaaattggacccatgttttaaaacaggcaattgctataagaaaattccttcattaggcttgtgtttttactcacataatcagttatataaatyagcttaattgctcttttttttttgagtttactaagtcctctgtcaataagagagatcttggatttttttgtgaattgtatgacctggaattttctttgttttttttttttttgttttgtttttgagacagaatcttgctctgttgcccaggctggcatgcagtggcacaatctcagctcattgcaacctgtgcctccggggttccagccattctcctgcctcagcctgctgagtagctgggattacaggcgcatgccactatgcccagctaacttttgtatttttactagagacggggtt

SEQ ID NO: 70582 - DNA, 601 bp, Human
caatattactgaagccctaatatttgcctacactttatatctagtttcaaagtctgtttaaatgacagagtaaaagggaattgtctaaaatatctgcttaagtagttgtgtataatatgaggcaaagggttgattttttttaagtgtttctgcttaccacttatttggtctgtgaccctgggtaggtctctggtcctgttttacatgaatttaaaataaaaatatgaataatagtgccttgcttttccaaaggggcagggtgccaggctagattatttcctaaagtggaagtggtttcatsctattttgaagcaatgtttcattcattctgtttcaaaaggggaagcctccccgtgatggctcatgcctgtaatcccagcactttgggaggccgagctactcaggaagctgaggcaggataatcgcttgaatttggaaggccgaggttgcagtgagctgagatcgcgccactgtactccagcctgggtgacacagtgagactccgtctcaaaaaataaaaaaataaaaaaagaggaagcctgtttttggctgatgtgcttctctcttgtggttagagggtgtctcagctgaagctgatttt

SEQ ID NO: 70583 - DNA, 601 bp, Human
attagaaatataatttggtgtttggctctaggtagtattttaaggcaacatgagttctagatatctgagtctgtttaactgtgagtcatagtcaagaaagggtaaatgttcaacacgaaaagccctttatactttacaaatccgttttctttatgttatcttttttgactctcaccacaatcctgaaagaggtaagaatatattttactggttagagttttttccttaacatttcttattaccacacataaatgaatgatgtcttgaatgggaaatgggtcttctggtttgtactctaccwtcttggacaaatctgagtctcagtgctgtcctctataaaggaaaaagcttaaattagacgatgtctaaggtctcttcctgctctaaccttctatatttttttcagctagttctgctcccacaagccattaagttattcatgatttctcagtgtagcaagggacgcatggatgaaggaaatccacagaggacatttgtttaactcaggaaatactcgttgactgacaagtgtgaagttctggagaatgagccagctgttgtctcttgtggctttaagtgcttatcttctgatcagtattac

SEQ ID NO: 70584 - DNA, 601 bp, Human
ggcacaggtcttcaataagaaattattagattgagttcaatatcatattatgcttgaaatggctgtggatgtagggacagaattgcaattttccttttattaaggaaaaacgaaaggattgcaaagttgaattagaaatataatttggtgtttggctctaggtagtattttaaggcaacatgagttctagatatctgagtctgtttaactgtgagtcatagtcaagaaagggtaaatgttcaacacgaaaagccctttatactttacaaatccgttttctttatgttatcttttttgactytcaccacaatcctgaaagaggtaagaatatattttactggttagagttttttccttaacatttcttattaccacacataaatgaatgatgtcttgaatgggaaatgggtcttctggtttgtactctaccttcttggacaaatctgagtctcagtgctgtcctctataaaggaaaaagcttaaattagacgatgtctaaggtctcttcctgctctaaccttctatatttttttcagctagttctgctcccacaagccattaagttattcatgatttctcagtgtagcaagggacgcatgga

SEQ ID NO: 70585 - DNA, 601 bp, Human
tagggtccacagtggtgtttttgctggttcccacagtattcttaaaaaagtatcgcatgtaatttactcacagtttactcctgtccctgccactccctagtgcttacatctagttcactcacttcacatgagtgcaatgctgtatttagctcctatagatactcgagttttgaatccttattacacaccttatttagtaataacgggcatgcaattaatttttcttcaacatgcttcgtaagtttttcaggatcacctagctccttataaactttttaagacttaccttcaccagtttcartgaaacatgtatagattcatgttgttaggtgcaataatatgtttatgatgatgcacactttccttatttggttctctgtccaaatgtacatcacctttttgaatttgtgtcttgtgaatttttgtgaattgtgattcatgcatagttgatcataaaggttaggggttgtagaaaaggtaagtaaatctacttatgctaaaattttaggtaactgatgccataggtaggtaggtataagcgagtgctgtttaagatgataggatttgacctgtaatttatctgatttgtgtcatgctaggt

SEQ ID NO: 70586 - DNA, 601 bp, Human
aggcctccaacctgcttttgctctctaattccctacaccatccactctaaatatgggtgatagcttataagtggccttgaattgatatgattccaaatttttgaaaaatttttgctaatcctggtgatcaaaggtagaacacacaccttttagactaactatgaaatgttaggatttgggtgaggtcatatggcaatatgttatttaaaactgctaggatcatagtcttgaaaactctcaaagtttacctggaatggggtctgattgtggtaaatgctcagtaaatatatgttgaatgaayacagtagaatatgagaggctgaggaatttagtagtttatgggacatatggaatgaacctatgaaagccttcaaaatacaaattttggccaggcgtagtggcttacgctggtaatcccagtactttgggaggccaaggcaggtggatcacaaggtcaggagattgagaccagcctggccaatatggtgaaaccctgtctctactaaaaatacaaaaattagccaggcgtggtggtgggcgcctgtagtcccagcttctcaggaggctgaggcaggagaattgcttgaacctgggaggtgga

SEQ ID NO: 70587 - DNA, 601 bp, Human
tagagaatgaggccaggcgcggtggcttacacctattatgtaatcccagcgctttgggaggccaaggcaggtgggatcgcttgaggtcaggagatcgagaccagcctggccaacatggtgaaaccccatctctactaaaaatacaaaaattagctgggtgtggtggcaggcgcctgtagtcccagctactcaggaggccgaggcaggagaattgcttgaagacgggaggccggagttgcagtgagccaagatcctgccactgcactctagtgacagagtgacagagcaagactccgtctcaaaaaaaaaaaaaaaaaaaaatagagaatgagatgtgtgctttagaagccagctcattcctgagttggggagtggtggaaaggcacggagaatgcggtaggctgaggctggctcccaaagacatgctgcgtcctaatacctggaacctatgaatgctaccttatttggaaaaagagcctttgcagatataattaagttacaattcttgagatgaggtgattattctgtattttctgggtggacccaaatgcaatcacatatgtcctaatagaaaggtgacagagggagaatagacagaaga

SEQ ID NO: 70588 - DNA, 601 bp, Human
acaaagctggaggcataacattacctgatttcaaaatgttctataaagttgcagtaaccaaaacaacctgttactggcacaggaacagacacataaacaaatggaacagaatagagaacccagaaataaatccacacacttacagacaactgattttcaacaacggctccaagaacatacaatggggaaaggacaccccatctcttcccatatacaaaaatcaactcaagatagatttaagacttaaacagaggacctgaaactatgaaactattagaagaaaacatagagaaaagacttyaggacattggtttaggcaaagattttatggctaagacctcaaaagcacaggcaaccaaaccaaaaatagacaaatgggactatattagactaaaaggcttctgcacagcaagggaaacaacagagtgaagagacaacctgttgaatgggagaaagtatttgcaaactattaatctgacaaggatgatattccagaatatacaaggagctcaaacaactcagcaattaaaaaaattccattaaaaagtgggcaaaactcatgaataaacatttctcaaaagaagatttataaatggctaac

SEQ ID NO: 70589 - DNA, 601 bp, Human
gtggattttggtatccacaggggttcctgggaccaattccctatggatggagagacgactctactgggtgtttctggggcattgctgagtgatctagtttcgactctgtattctgttggaatcagttacttgacatgaaattttattcctcatttctaattccagaactgtccaactacacaaatgaattaaagatgctgctgttttagtgaataaggttttactatttggatatactcagattagaaaaaaagggcttgagaaaggatatgctgattgtgtggaggaatcctggaattcrgaaaagcaggacgaaagaaaggaatgaggagaaggcagggctaggagcagctgtacttcggaaagctgtatttcaacatactattactattgaaaaagaaagggaaggggagaggtaaaaatgacccactcatgccctgcagagtctggccataaaactcatctggcagtgtctttgtaaatggaaggaaaatgtttctatttttatcccacaaggaacaaaagatgtttttgtttaaagattataaatgtcttttttaaaattttttttatttttattatactttaagttttagggtac

SEQ ID NO: 70590 - DNA, 601 bp, Human
aatttaaagtacataggataatgtatgcaggttatatgcacatgatatgccattttatatcagatccttgagccgctgtggattttggtatccacaggggttcctgggaccaattccctatggatggagagacgactctactgggtgtttctggggcattgctgagtgatctagtttcgactctgtattctgttggaatcagttacttgacatgaaattttattcctcatttctaattccagaactgtccaactacacaaatgaattaaagatgctgctgttttagtgaataaggttttamtatttggatatactcagattagaaaaaaagggcttgagaaaggatatgctgattgtgtggaggaatcctggaattcagaaaagcaggacgaaagaaaggaatgaggagaaggcagggctaggagcagctgtacttcggaaagctgtatttcaacatactattactattgaaaaagaaagggaaggggagaggtaaaaatgacccactcatgccctgcagagtctggccataaaactcatctggcagtgtctttgtaaatggaaggaaaatgtttctatttttatcccacaaggaacaaaa

SEQ ID NO: 70591 - DNA, 601 bp, Human
ttagggattataagcaatctagagataatttaaagtacataggataatgtatgcaggttatatgcacatgatatgccattttatatcagatccttgagccgctgtggattttggtatccacaggggttcctgggaccaattccctatggatggagagacgactctactgggtgtttctggggcattgctgagtgatctagtttcgactctgtattctgttggaatcagttacttgacatgaaattttattcctcatttctaattccagaactgtccaactacacaaatgaattaaagatgmtgctgttttagtgaataaggttttactatttggatatactcagattagaaaaaaagggcttgagaaaggatatgctgattgtgtggaggaatcctggaattcagaaaagcaggacgaaagaaaggaatgaggagaaggcagggctaggagcagctgtacttcggaaagctgtatttcaacatactattactattgaaaaagaaagggaaggggagaggtaaaaatgacccactcatgccctgcagagtctggccataaaactcatctggcagtgtctttgtaaatggaaggaaaatgttt

SEQ ID NO: 70592 - DNA, 601 bp, Human
catacatatacatacttgtccactttttgcttctctattgataatcaacctcttacagatgtggctctacatgcagaagctgaggagagtgtggtattacttaaatcaccacaggtatcagatctgaatttctcaacaaagttgatagttttactttcctggcatatgtaatatggcattgcttaatattactatgaaataatgatgcatttaaatataaattttgatatattctgaaccagagttcatttgatattttgaaccagatttgggtcctttgtaaagcagaatcaatcttgtmaataaattaaatcatgctaaaactgtagaagtcaaattaaagcaacttttagaatatctttgctgaatgaggagcagcatatcagattcaagattgaaggaagagaaccagaagaagggactccatacttggtgtgccaagttacctcttcattgagaaaaggaagtgagggctgacatgaagtgggatggtccctgtctgtccttggcatcactttgtagtggccctcagtatggaaccactagaatcagaaactggaagctgggaggttccacggaagtcattgaaaagaaatcttta

SEQ ID NO: 70593 - DNA, 601 bp, Human
taagcatgtccaccacttccatgggggtgctgtatttgcagatagtagtgaaacctacaatgtcactgaagtagattgtaacttcctcatatagttccggctccacaaagcctttctccttcagagactttaccactagcctagatgaacgaagggaaaaaaaatgccttcaacttcagcaaatttcttcttgtttcacataaatctttcaggtagtagtgactgtctaccaagaattctagaatttgagacttccagtgaattgagtgaatcggaaacagaggttgtgtatatcatatayatgaacatattacacaaatacacatataatgcatgttgtgaacacagatgaatacaagcaggttcaacattaacttagtgtttgattattaatcctaatacacataaatagataactttaatatcctcaaaactctcatacatatacatacttgtccactttttgcttctctattgataatcaacctcttacagatgtggctctacatgcagaagctgaggagagtgtggtattacttaaatcaccacaggtatcagatctgaatttctcaacaaagttgatagttttactttcctggca

SEQ ID NO: 70594 - DNA, 601 bp, Human
tcagcctgttaggtgatgtggttaccttgtagacatcatgatgatcaacaatgtggtcaaaactcttatagatgtcattaagcatgtccaccacttccatgggggtgctgtatttgcagatagtagtgaaacctacaatgtcactgaagtagattgtaacttcctcatatagttccggctccacaaagcctttctccttcagagactttaccactagcctagatgaacgaagggaaaaaaaatgccttcaacttcagcaaatttcttcttgtttcacataaatctttcaggtagtagtgaytgtctaccaagaattctagaatttgagacttccagtgaattgagtgaatcggaaacagaggttgtgtatatcatatacatgaacatattacacaaatacacatataatgcatgttgtgaacacagatgaatacaagcaggttcaacattaacttagtgtttgattattaatcctaatacacataaatagataactttaatatcctcaaaactctcatacatatacatacttgtccactttttgcttctctattgataatcaacctcttacagatgtggctctacatgcagaagctgagga

SEQ ID NO: 70595 - DNA, 601 bp, Human
gacctggaacactccaagtaaggagccaggtttctcatgccccagggaagatttgggttgttttggcttttctagaaggttgccatctctctgggtctgacatctaggcctctgcaagacagagtttctcaaccatagcaaaagccaaggaaatggccatatggctgcagtaacatgtattgacaggcaactgggtgacagcttgagtcacctttaggagaagtgaaacctgtcagttaaccctgaaactttgtcttcctcatctcagggagaacacagacttcatgttaagacccagaamcgcagtcttggggttggggcaggtcctgttttcatcaggcaactcaacagaaagatgaagacaggagtggaatgcagagagcctctttgcccccagtatgctccactcttgtcagaacaagacatgcatgaagtgaactctaaagtgtcttctgttctcccgagcaagcctggaacacaacgctagctttgccatgctttattgcagggcaatatagtcagtttttcagcaagaacaagatgatgactggtacagtctaagaaagtggacagaataggtagaagctcatacccagactca

SEQ ID NO: 70596 - DNA, 601 bp, Human; identical to SEQ ID NO: 31385

SEQ ID NO: 70597 - DNA, 601 bp, Human; identical to SEQ ID NO: 31386

SEQ ID NO: 70598 - DNA, 601 bp, Human; identical to SEQ ID NO: 31387

SEQ ID NO: 70599 - DNA, 601 bp, Human; identical to SEQ ID NO: 31388

SEQ ID NO: 70600 - DNA, 601 bp, Human; identical to SEQ ID NO: 31389

SEQ ID NO: 70601 - DNA, 601 bp, Human; identical to SEQ ID NO: 31390

SEQ ID NO: 70602 - DNA, 601 bp, Human
ttccgataatcggccatatggatgagtcacttagagatacccatttttaaggattaggaccccgaagcccagaaaatgcctgctgtagtcaacattatagtcacactccacaggcactgggtccacccctttgaccgacattcctttgcggttttcccacccttcttccctgcctggagaactcctattcatcctccagagcccggctcaaagtggcttcatctgtggggatcctccctgccccatagtgagtgctccttgagtcctcgcccttcctagggcatcccaagctcccaggggmtgcccctgctgcctcgccatccgctccaaagctggctgtacctcgatggttaagggcagccaggcgtgctgcttctcgtccaaatacacgaacttctcccaggcccacaggcggtccgggtggtcggtgactgcctccccgagtgtcgggcactcggccatggcgtcctcgggccgcctaagaagcaagagccagagcctctcaaggccgctcgctggtccctgggatgtggggccgaccctttatatccgggcagcatgcggccgccaccaagcggcggggcgggaggacggccttggg

SEQ ID NO: 70603 - DNA, 601 bp, Human; identical to SEQ ID NO: 34725

SEQ ID NO: 70604 - DNA, 601 bp, Human; identical to SEQ ID NO: 34726

SEQ ID NO: 70605 - DNA, 601 bp, Human; identical to SEQ ID NO: 34727

SEQ ID NO: 70606 - DNA, 601 bp, Human; identical to SEQ ID NO: 34728

SEQ ID NO: 70607 - DNA, 601 bp, Human; identical to SEQ ID NO: 34729

SEQ ID NO: 70608 - DNA, 601 bp, Human; identical to SEQ ID NO: 34730

SEQ ID NO: 70609 - DNA, 601 bp, Human; identical to SEQ ID NO: 34731

SEQ ID NO: 70610 - DNA, 601 bp, Human; identical to SEQ ID NO: 34732

SEQ ID NO: 70611 - DNA, 601 bp, Human; identical to SEQ ID NO: 34733

SEQ ID NO: 70612 - DNA, 601 bp, Human; identical to SEQ ID NO: 34734

SEQ ID NO: 70613 - DNA, 601 bp, Human; identical to SEQ ID NO: 34735

SEQ ID NO: 70614 - DNA, 601 bp, Human; identical to SEQ ID NO: 34736

SEQ ID NO: 70615 - DNA, 601 bp, Human; identical to SEQ ID NO: 34737

SEQ ID NO: 70616 - DNA, 601 bp, Human; identical to SEQ ID NO: 34738

SEQ ID NO: 70617 - DNA, 601 bp, Human; identical to SEQ ID NO: 34739

SEQ ID NO: 70618 - DNA, 601 bp, Human; identical to SEQ ID NO: 34740

SEQ ID NO: 70619 - DNA, 601 bp, Human; identical to SEQ ID NO: 34741

SEQ ID NO: 70620 - DNA, 601 bp, Human
cagtggtttcagagttctatgatgaaatggtaagaagattttataatgatagttttaaaagcatttgaagttggagaactttgaagttattgggtttttgttcattttatcccattagatatttcaagacccaacagcaatgatgcaacaattattgacaacatctcgtcagctaacattaggagcctataagcatgaaacagaatgtaagtgccatgcattcataattctgaaaaataacgtattctgtaatagtgaaagggttgtatgattcgtgccttttacactttaaaaaaatgawataggtaagttttttaggtgttaaaaaacacagtttgtattacagtggaacatgtaaaaaggatgttttaaattgttcccaagtaggcctgctttcaagaagggtgaaagacagcctcttacattcgctgaagtactgtttgtctgttttattccctaattacatttaagtatagttttttattagtcttgcttagcctatcattttctgtttactagtctttgctaacaaaatctgtgtgaagaaccttgcaaaccataattatacttttatatactgtgaactagtttatcttatatt

SEQ ID NO: 70621 - DNA, 601 bp, Human
ttagtcttgcttagcctatcattttctgtttactagtctttgctaacaaaatctgtgtgaagaaccttgcaaaccataattatacttttatatactgtgaactagtttatcttatatttttgctgatgtcattttacatagtttcagattaatgctcaagtgttgactacctgaatgccacattgataatcggtcatgttgtattttctctctaagctgacatggtctcagaattctgtacgcattaatctgtgcatctattctcagtcatttgcaattggcatttaatatgaaatctatytgacatccctgtgttaacactgatgttactgttcagtcatttctttgattattcattcattacaatatatagtgagtaccagttaatgccaaccattgttctaggtgctagctgctgaggttagagcagtgcctgaatcagacaaaaagccctatcgtcatgggtcctacattctagtgggaggaaaacaggtattaaataaacagaacaaggaagtataaggtagtgattaagtgctatagagacaaacaaagtggggcagggagcatctttggtgggacgagatggttggagttttag

SEQ ID NO: 70622 - DNA, 601 bp, Human
tatatactgtgaactagtttatcttatatttttgctgatgtcattttacatagtttcagattaatgctcaagtgttgactacctgaatgccacattgataatcggtcatgttgtattttctctctaagctgacatggtctcagaattctgtacgcattaatctgtgcatctattctcagtcatttgcaattggcatttaatatgaaatctatttgacatccctgtgttaacactgatgttactgttcagtcatttctttgattattcattcattacaatatatagtgagtaccagttaatrccaaccattgttctaggtgctagctgctgaggttagagcagtgcctgaatcagacaaaaagccctatcgtcatgggtcctacattctagtgggaggaaaacaggtattaaataaacagaacaaggaagtataaggtagtgattaagtgctatagagacaaacaaagtggggcagggagcatctttggtgggacgagatggttggagttttagatactgatatcaaaatgtcagtcaggaaatgctttctgagcatttggagacctaaaggggtaaaggagtgatctaagggaaggatatt

SEQ ID NO: 70623 - DNA, 601 bp, Human
ttttttcctcaagtatatattcttggcacctttgtcaaaaatgagttccctgtaagtgtgtggatttgtttctgggttctctagtctgttccgttggtttatgtgtctctttttctgcaagtaccatgctgttgtggttactatagctctgtagtataatttgaagtcaggtgattcctccagttttgttctttttgcggaggataacttaggctattctggatcttttgtggttccacataaaattttaggttttgttttttttttttctatttctgtgaagaatgtcatttgtattttsatagggattgcagtgaatctgtagattgctttgggaagtatgggcattttaacaatattgattttccagttcatgaacatggaatatctttccttttctgtgtgttctcttccgtttctttcattactgttttatatttctcattgtacatatctttcacttctttggttaattcctagttatttaatttgtagctgtggtaaatgagattactttctttttttttatttaattttttagtatttattgatcattcttgggtgtttctcggagagggggatttggcaggatcataggaca

SEQ ID NO: 70624 - DNA, 601 bp, Human
cggtcagagacgctcctcacctcccagacggggtggcggcggggcagagacactcctcagtttccagatggggtcgcggccgggcagaggcgctcttcacatctcagatggggcggcggggcagaggcgctccccacatcccagaggatgggcggccgggcagagacgctcctcacttcctagacgggatgacggccgggaagaggcgctcctcacttcccagactgggcggctgggcagaggggctcctcacatcccagacgatgggcggccaggcagagacgctcctcacttcctagayggggtggcggccgggcagaggctgtaatctcggcactttgggaggccaaggcaggcggctgggagatggaggttgtagcgagcagagatcacgccactgcactccagcctgggcaacattgagcactgagtgagcgagactccgtctgcaatcccggcacctcgggaggccaaggctggcagatcactcgcggtcaggagctggagaccagcccagccaacacggcgaaaccccgtctccaccaaaaaatacaaaaactggtgaggcgtggtggtgcgcgcctgcaatcccaggcactcg

SEQ ID NO: 70625 - DNA, 601 bp, Human
atgggcggccaggcagagacgctcctcacttcctagacggggtggcggccgggcagaggctgtaatctcggcactttgggaggccaaggcaggcggctgggagatggaggttgtagcgagcagagatcacgccactgcactccagcctgggcaacattgagcactgagtgagcgagactccgtctgcaatcccggcacctcgggaggccaaggctggcagatcactcgcggtcaggagctggagaccagcccagccaacacggcgaaaccccgtctccaccaaaaaatacaaaaactggtsaggcgtggtggtgcgcgcctgcaatcccaggcactcggcaggctgaggcaggagaatcaggcagggaggttgcagtgagccgagatggcggcagtacagtccagcctgggctcggcatcagagggagaccgcgcagagagggagggggagggggagacttctttcttgatttcattttcagattgttcactgttggcatacagagatgctactgatttttttgtatgttgattttgtatcctgcagttttactgaatttgtttatcaactcttaatagcttttttggtggagtctttagg

SEQ ID NO: 70626 - DNA, 601 bp, Human
aatataatatcatctacaggctgggtgtggtggctcacgcctgtaatcccagcactttgggaggccaaggcagatggatcacctgaggtcaggagttcaagaccagcctggccaacatggcgaaacccttctctgctaaaactataaaaattaaccgagcatggtggcatgtgcctgtaatcccagctactcgtgtggcagaggcaggagaattgcttgaacctgggaggcggaggttgcaatgagccgagattgtgtcactgcactccagcctaggcaacagagtgagactctctctcaraataaataaataaataaataatgataatatcatctacaaacaaggctaatttgacttctgctgaattttatcagatcctttttcagcatcaattgaaatgatcatatggtttttgtccatcattctgtcgatatgaggtatcacattgatttgctcatgttgagcgattcttacatccctgggataaatcccgcttggtcacgatgaatgatctttttaaggtgttgttgaattctttttgctagtgttttgttatggatttttgcatcagtgttcatcagggatattggcctgtggttt

SEQ ID NO: 70627 - DNA, 601 bp, Human
ttctaacttttttggagctggggatctcgctgtgtttaccaggctggtcttgaactcttgtcctcaagcgatcctcccacctcagcctcccaaagtgctgggattataggtgtgagcctctgcacctgacccaatttttcaattcttaatctcttcattgacccactggtcattcagaagcatattgtttaaattccatgtgtttgtatagtttccagaattcctcttgttattgatttctaattttattccattgtagtcagagaagatacttcacattacttgcttttttaaaaaaaaatgttttatgacttgttttgtggcctaacatatggtctttatccttgagaatgatccatgaggtcaggagaagaatgtgtattctgtagccatttgatgaaatgttctgtaaatacctattaggtccatttggcctattttgcagattaagtccaatggtatttttttgttgattttctgtctggatgatctgttcagtgctgaaagttggatgttggcgatgccaggtattgttgtattggggtctatctctcttaaactctaataatatttgctttatgtatctgactgctccactgtt

SEQ ID NO: 70628 - DNA, 601 bp, Human
gaattcctcttgttattgatttctaattttattccattgtagtcagagaagatacttcacattacttgcttttttaaaaaaaaatgttttatgacttgttttgtggcctaacatatggtctttatccttgagaatgatccatgaggtcaggagaagaatgtgtattctgtagccatttgatgaaatgttctgtaaatacctattaggtccatttggcctattttgcagattaagtccaatggtatttttttgttgattttctgtctggatgatctgttcagtgctgaaagttggatgttgrcgatgccaggtattgttgtattggggtctatctctcttaaactctaataatatttgctttatgtatctgactgctccactgttgggtgcatatatgtttacaattgttatatcctcttgctgaattgactcctttattattatataatgaccctgtctctttttatagtttttgttgtgcaatctgtttgtctgatgtcagtattgctactcctgctcttttttgattttgcatgcaatatctttttttttcatttgcatgcaatatctttttccatccctttattttcagtctacgtgt

SEQ ID NO: 70629 - DNA, 601 bp, Human
atgttctgtaaatacctattaggtccatttggcctattttgcagattaagtccaatggtatttttttgttgattttctgtctggatgatctgttcagtgctgaaagttggatgttggcgatgccaggtattgttgtattggggtctatctctcttaaactctaataatatttgctttatgtatctgactgctccactgttgggtgcatatatgtttacaattgttatatcctcttgctgaattgactcctttattattatataatgaccctgtctctttttatagtttttgttgtgcaatmtgtttgtctgatgtcagtattgctactcctgctcttttttgattttgcatgcaatatctttttttttcatttgcatgcaatatctttttccatccctttattttcagtctacgtgtgtctttataggtgaagtgtgtttcctggaggcagtacatcactgggtcttgttttttcatccattcagccactctgtgtcttttgattggagactttagtccatttacattcactgatattgatatttacattcattagtattgataagtaaggacttccaccattttatttttctgattgttt

SEQ ID NO: 70630 - DNA, 601 bp, Human
attattatccctttgaataaactttctactcctctctctctctatctcctctttaattaaggtcaataactcttagattctacccctaccctgcctttttattttgagacaggtcctgactttgtcacccaggctggagtgcagtggcatgatcttggctcactgcaacctccaccttccgggttcaagcaatcctctcacctcagcctcctgagtagctgggacccacaggcacatgccaccactatgcccagctaattttttttttttttttttttttttttttttttggtggagatgrggttttgccatgttgcccaggctagtctcgaactcctgggctcaagcagtcctccctccttggcctcccaaagtgctgggatcataggtgtgagctgctgcacctggcctggatttccccttttctaggttattttctagaacttgtagatgtgcttcattttctcttgtctcctctcactgtgaatttgcaaatagcctctcttcaagcccactaattctttgttctgcttgatcagttctgctattaagtgactgatgcattcttccatatgtcagtggtgttttcaactccagcatt

SEQ ID NO: 70631 - DNA, 601 bp, Human
ccatatctgcattaggggataccccaaggcccagtaatgctgtggttcttgcagatttgtagggtacgactttggtggtcttggataagatccagaagaatcctctggattagcaggcagagactcttgttctcgtcccttactttctcccaaacaaacggagtttctgtttctgtgctgaactgcctagacctgaggagggatgacacaagcacccctttagccaccaccactgggactgccttaggtcagacttgaagccagcacattactgggtcttgcccaaggcccactgtaaccrctgcctggctgccacctatgtttgtgtgaggccctaaggctctataatcagcaggtgatgaagtcagccagtatcaggggaaattcagccagatatcgggtgaaattcacccccaatatttcacgtaggttctttcctattttccctaagtgccggccagtctgagaaataaagggacagagtacgaaagagagaaattttaaagctgggtgtccaggggagacatcacatgtcggcaggttccatgatgccccacaagccacaaaaccagcaagtttttattagtgattttcaaaaggg

SEQ ID NO: 70632 - DNA, 601 bp, Human
ccttaggtcagacttgaagccagcacattactgggtcttgcccaaggcccactgtaaccgctgcctggctgccacctatgtttgtgtgaggccctaaggctctataatcagcaggtgatgaagtcagccagtatcaggggaaattcagccagatatcgggtgaaattcacccccaatatttcacgtaggttctttcctattttccctaagtgccggccagtctgagaaataaagggacagagtacgaaagagagaaattttaaagctgggtgtccaggggagacatcacatgtcggcaggktccatgatgccccacaagccacaaaaccagcaagtttttattagtgattttcaaaaggggagggagtgtatgaatagggtctgggtcacagagatcacatgcttcacaaggtaataagatatcacaaggcaaatggaggcagggtgagatcacaggaccggggcaaaactaaaattgctaatgaagttttgggcacatattgtcattgataacatcttatcaggagacagggtttgagagcaggcaaccggtctgaccaaaatttattaggcaggaatttcctagtcctaataagcctgg

SEQ ID NO: 70633 - DNA, 601 bp, Human
ccaagccaaataacagactgtcttaaatcattaatttgattagcttgtgtccatcccttaagggcactgagtttccctgggctgcgggtaggtccagagattctgtccaggagccagggcctggagttggaaaccttaggaataatcctggtgctctgttttactgtggctgagctggcacccaggctacaagacagcatccttcccattcttccctcccctttttccaggcagatgattctttccccgtgtccaccactaccacaggcccacaaggagttctgtcagggtaccacaaatrtttacttaaggcccaagggctcttcagtcagcttgtgttgaatactgccaggcctgggactttcccttcagggcagtgggctcctcttggcctaggtaggtccagagatgccatccaagggccaaggcgtggaattggggagttggtaccaaagcttaagacaaagtcccctttactctttcctgtgtgtggaggctgtcccagtaattcagatttggtagaatggtggcttggaccagagtgatagcaatgggagaagacattagattttggacctgatttgaaaataggtacaggagg

SEQ ID NO: 70634 - DNA, 601 bp, Human
actgtggctgagctggcacccaggctacaagacagcatccttcccattcttccctcccctttttccaggcagatgattctttccccgtgtccaccactaccacaggcccacaaggagttctgtcagggtaccacaaatgtttacttaaggcccaagggctcttcagtcagcttgtgttgaatactgccaggcctgggactttcccttcagggcagtgggctcctcttggcctaggtaggtccagagatgccatccaagggccaaggcgtggaattggggagttggtaccaaagcttaagasaaagtcccctttactctttcctgtgtgtggaggctgtcccagtaattcagatttggtagaatggtggcttggaccagagtgatagcaatgggagaagacattagattttggacctgatttgaaaataggtacaggaggatttgctgatgttttgaataatgaggtattggagaaagaaaagcaaaggatgacttacatggttttgggcctgaggaactccaaaaaagtcattgctttttacacaggtgggaggtcttggaggaacaggtttttgcaattcagagtacagctttggcggcc

SEQ ID NO: 70635 - DNA, 601 bp, Human
ccagtaattcagatttggtagaatggtggcttggaccagagtgatagcaatgggagaagacattagattttggacctgatttgaaaataggtacaggaggatttgctgatgttttgaataatgaggtattggagaaagaaaagcaaaggatgacttacatggttttgggcctgaggaactccaaaaaagtcattgctttttacacaggtgggaggtcttggaggaacaggtttttgcaattcagagtacagctttggcggccaggtgtgatggctcatgcctataatcgcagcacattagrggggctagcatgggaggattgcctgagcccaggacttcaagactagcctgagcaatgtagtgagaccccatctctacaaaaaaaatttttttaattttctgggtgtggtggcacattcctgtagtaccagctactcaggaggctgaggttgggggattacttgagcccaggagggcaaggctttaatgagctgttgtcatgtgactgcacgccagactgaacaatacaacaagattctgtctcaaaaaaaaaaagtgcaagtttggacatgatgggtgtgggatgtctgtaagacatgta

SEQ ID NO: 70636 - DNA, 601 bp, Human
ataggtacaggaggatttgctgatgttttgaataatgaggtattggagaaagaaaagcaaaggatgacttacatggttttgggcctgaggaactccaaaaaagtcattgctttttacacaggtgggaggtcttggaggaacaggtttttgcaattcagagtacagctttggcggccaggtgtgatggctcatgcctataatcgcagcacattaggggggctagcatgggaggattgcctgagcccaggacttcaagactagcctgagcaatgtagtgagaccccatctctacaaaaaaaawttttttaattttctgggtgtggtggcacattcctgtagtaccagctactcaggaggctgaggttgggggattacttgagcccaggagggcaaggctttaatgagctgttgtcatgtgactgcacgccagactgaacaatacaacaagattctgtctcaaaaaaaaaaagtgcaagtttggacatgatgggtgtgggatgtctgtaagacatgtaagttgagatgttgagaaggatgttgcaccatggcattcaaagagaggagaagtgtaggctggagacataaatttgaaagttaatac

SEQ ID NO: 70637 - DNA, 601 bp, Human
tttttaattttctgggtgtggtggcacattcctgtagtaccagctactcaggaggctgaggttgggggattacttgagcccaggagggcaaggctttaatgagctgttgtcatgtgactgcacgccagactgaacaatacaacaagattctgtctcaaaaaaaaaaagtgcaagtttggacatgatgggtgtgggatgtctgtaagacatgtaagttgagatgttgagaaggatgttgcaccatggcattcaaagagaggagaagtgtaggctggagacataaatttgaaagttaatacarttataaattatgagaccaaatggtatcatcaaaggagtaagtgaagatagaaaagaggtccaaagactgagagacctgggcactccaaaatttaaagattgaggagataaccagcaaagggaatgaagaacaaacagcaaatatggagggagaaaaactaggtgcatgtaatgtcctcacaggcaagtgaaaaaagtgtatcaggaactagagagtgtctcatactgctgataggtcaagtaagatgagggcccagtaattggatagagtaagatggagctccttgatgactttaacagg

SEQ ID NO: 70638 - DNA, 601 bp, Human
gataaatagaaaaacctgttaaacctcagtagataaatgggcagaaggtatggacagacagatagaataagagatcaccagtaaataaaatgataaaatatctggccctgctaataattttaaaaatgcaaaccaaacagtagtgaatgactatatttgtcctattaaattagcaaaagcatttttttttcccctagagacaggttctcgctctgtcactcaggctgggttgcagtgtcatgatcgtagctcactgtagcctcaaacttgggggctcacatgatcctcctgccttggcccyctaacagtagctaggactacaggtatgtgccaccatgtctggctaattttttttttttttgtaggggcaggtttctccacctcagactcctaaagtactggtattacaggcatgaatcaccatgccagccaggaattttaaatagttgtaccgattaagagtaaactttgcactctcatgaattgttttgtgagtataaatttagctctttaggaaagctatctgggaatattaatcaaaggtctaaaaaatatgtatagttttaataatctgagggcatatgatagtcaatatttagta

SEQ ID NO: 70639 - DNA, 601 bp, Human
gatagaataagagatcaccagtaaataaaatgataaaatatctggccctgctaataattttaaaaatgcaaaccaaacagtagtgaatgactatatttgtcctattaaattagcaaaagcatttttttttcccctagagacaggttctcgctctgtcactcaggctgggttgcagtgtcatgatcgtagctcactgtagcctcaaacttgggggctcacatgatcctcctgccttggccccctaacagtagctaggactacaggtatgtgccaccatgtctggctaattttttttttttttgtaggggcaggtttctccacctcagactcctaaagtactggtattacaggcatgaatcaccatgccagccaggaattttaaatagttgtaccgattaagagtaaactttgcactctcatgaattgttttgtgagtataaatttagctctttaggaaagctatctgggaatattaatcaaaggtctaaaaaatatgtatagttttaataatctgagggcatatgatagtcaatatttagtaataataaaatgccagacttattcagtgcttactatttgtattcttctgagtctgtacatg

SEQ ID NO: 70640 - DNA, 601 bp, Human
gccccctaacagtagctaggactacaggtatgtgccaccatgtctggctaattttttttttttttgtaggggcaggtttctccacctcagactcctaaagtactggtattacaggcatgaatcaccatgccagccaggaattttaaatagttgtaccgattaagagtaaactttgcactctcatgaattgttttgtgagtataaatttagctctttaggaaagctatctgggaatattaatcaaaggtctaaaaaatatgtatagttttaataatctgagggcatatgatagtcaatattkagtaataataaaatgccagacttattcagtgcttactatttgtattcttctgagtctgtacatgtataaactcacttaattctataacagctttattaggtaatatttagaaaaggaaaccgaggtataaggaggttaagaaacttgcccagggtcacacagctagttagtagtagaatcagaacttgatccctggcagtcctcagaacttaggctccaaaaatttaatagtatttttatagagagaatatttattatggagtatattggaagtttaagcactaatgatctagcttttta

SEQ ID NO: 70641 - DNA, 601 bp, Human
gcactaatgatctagctttttagttgcttcttcaagaaatagtaaaaatgatagtgaacacttagtgagagcttactatgtacctgacaagcactttccatttcttaacttatttaatactctaaaataaccctaggaggaagatactatgattagcaccattttgtaggtaaaagctctagaaagatttgataacttgcccaaaattacccagtagagcctgcattttaaacccaaaatctgtccacttaactaataagttgtaaaaagcctgatagtctgtctcctaaccagtatgctsaactgactttataaaagtagtaattctttggatttgttttctcgaaattgagcttcattgggaaattaaaaacagaaacttttctttttttgtataagcatttaacacataggaagcagaacactggaacaagctaaaagaagttttaaaatgttttcccccaggatctcattgctaattaactcatgtcttcttccaaacatctagtgcccttcgcagtcttacaagttgtcaaaaataaaagtatcatgaatcaaacaacaaatctatgttatatctacagtgaatgctgtccttctg

SEQ ID NO: 70642 - DNA, 601 bp, Human
actacagatagtaccaagccctatatactgttttttcctatacatatatacctatgataaagtttaatttataaattaggcacaataaaagattaacaacactaattaataaaatagaacattataacaatgaactctaataaaagttatgtaaatgtgtgctctttccccaccccaccccccaaaaaaatcttattctactttttactcacctattttcagaccgctattgacagtggctaactgtaagcatggaaaatgaaaccatggatgaggggggactactgtataaagctgtatrtagctcttacaaatcaataagaaaggccaataacccaataggaaaatgagcaaaaggaaaacagatcatttgtagaaagggagaaatgtctcaaacattataaaaaagatgagtcagccccaatagtaataagatgaatgcgaattacagaaatactgtttttaacctttcaggttaggtaagaccaaaaagttgatgcagtagggaaacagacacaatgctaatgggattataaattggtagatccttttgagttgcttgatgttcttccagaattacaagtacatatatattctgtaa

SEQ ID NO: 70643 - DNA, 601 bp, Human
ctatttctgggaagatatcagagaacacaacagtgattatctctgggaagaagcactgattggtcatggcaggctggggaacaagtgtagtagaagggcatattttttcactgtctactctttaatcttttaatttgtaatcttgtgtgtactacctatgtataaaaataatttgtaaaagaatgaaaagaattacaaagtaaaatatgaattgttttgacaatcacaaaaagcaagtcaccagcaatgagcaaaataaggaaagaactcattaatattcattgaatttttttattttttatatttttattttttttttttgaggcagagtctcgcgctgtcgcccaggctggatggagtgcagggcgcgatctcggctcactgcaagctccgcctcctgcgttcacgccattctcccgcctcagcctcacgcgtagctgggactacaagtgctcgccaccatgcccagctaattttttgtatttttagtagagacagggttttaccgtgtattgcatgttttttatgtgctagatgctttacatataattacttcatgtaatcttcgtaaatcctctgagaaatacctagttttagctgt

SEQ ID NO: 70644 - DNA, 601 bp, Human
atttctgggaagatatcagagaacacaacagtgattatctctgggaagaagcactgattggtcatggcaggctggggaacaagtgtagtagaagggcatattttttcactgtctactctttaatcttttaatttgtaatcttgtgtgtactacctatgtataaaaataatttgtaaaagaatgaaaagaattacaaagtaaaatatgaattgttttgacaatcacaaaaagcaagtcaccagcaatgagcaaaataaggaaagaactcattaatattcattgaatttttttattttttttwtttttattttttttttttgaggcagagtctcgcgctgtcgcccaggctggatggagtgcagggcgcgatctcggctcactgcaagctccgcctcctgcgttcacgccattctcccgcctcagcctcacgcgtagctgggactacaagtgctcgccaccatgcccagctaattttttgtatttttagtagagacagggttttaccgtgtattgcatgttttttatgtgctagatgctttacatataattacttcatgtaatcttcgtaaatcctctgagaaatacctagttttagctgtat

SEQ ID NO: 70645 - DNA, 601 bp, Human
ggaagatatcagagaacacaacagtgattatctctgggaagaagcactgattggtcatggcaggctggggaacaagtgtagtagaagggcatattttttcactgtctactctttaatcttttaatttgtaatcttgtgtgtactacctatgtataaaaataatttgtaaaagaatgaaaagaattacaaagtaaaatatgaattgttttgacaatcacaaaaagcaagtcaccagcaatgagcaaaataaggaaagaactcattaatattcattgaatttttttattttttttatttttattttttttttttgaggcagagtctcgcgctgtcgcccaggctggatggagtgcagggcgcgatctcggctcactgcaagctccgcctcctgcgttcacgccattctcccgcctcagcctcacgcgtagctgggactacaagtgctcgccaccatgcccagctaattttttgtatttttagtagagacagggttttaccgtgtattgcatgttttttatgtgctagatgctttacatataattacttcatgtaatcttcgtaaatcctctgagaaatacctagttttagctgtatcgtacaa

SEQ ID NO: 70646 - DNA, 601 bp, Human
aattgttttgacaatcacaaaaagcaagtcaccagcaatgagcaaaataaggaaagaactcattaatattcattgaatttttttattttttttatttttattttttttttttgaggcagagtctcgcgctgtcgcccaggctggatggagtgcagggcgcgatctcggctcactgcaagctccgcctcctgcgttcacgccattctcccgcctcagcctcacgcgtagctgggactacaagtgctcgccaccatgcccagctaattttttgtatttttagtagagacagggttttaccgtstattgcatgttttttatgtgctagatgctttacatataattacttcatgtaatcttcgtaaatcctctgagaaatacctagttttagctgtatcgtacaaagagattgatggagccttagaaatgttagcattcggctaataaggaagcaagggtttatttgaaatcagatcttttctgtttccatagttgggtttttttcccaccaaaccatctggcttccaattagtgaccatcttttattagtgaaagtaagtataagtgtactttaatagtgagcagcagttaccaaaaatgtcca

SEQ ID NO: 70647 - DNA, 601 bp, Human
gtactttacataaattaattcattaagtcttctcaacaggctgggtgtggtggctcacacctgtaatcccagctgcttgggaagctgaggtgggataatcacttgaacccgggagtgagagtttgcagtgagccaagatcacaccactgcactccagcctgggtgacagagtaagatcctgtctcaaaagttttctcaacaaataatattatgaagtatttgccattatcatttctgtttcataagtgaggaacataggtgaaatagcttacagtgtcacagctagtaagtggcagagctrggattcaaattttagcagttattgccacctatttgaaaaaaagatattggcttgtattgatagtgtgattttgtttataagtttcacctgggccgggcctggtggcttatgcctgtaatccccgcactttgggaggctaaggagggcggattgcctgagctcaggagttcgcagtcagcctgggcaacacggtgaaaccccgtctctactaaaatacaaaaaattagccgggcatggcagcatgcacctgtagtcccaactactcaggaggttgaggcaggagaattgcttgaacctggg

SEQ ID NO: 70648 - DNA, 601 bp, Human
taagagacgaggtttcacatgttggccaggctggtctcgaactcgtgacctcaagtgatcctcttgccttggcttcccaaagcgctgggattacaggcatgagtcaccacaccgggcctaaacttttttctattaaatttttttttttaacttttaaaattaattttattttagaagagacaaggtcttactgtgttgcacaggtctcaaactcctggcctcatgtgatcctcttgcctcagcctcccaaaggaggctggaattacaggcatgaacgactgaacctggtctttttttttttaagctttttttaaaaactaagatatacacacattaacctaggcctgcacagggtcaggattatcaatatcactgtcttccatctctgcatcttgtcccactggaaaggtcttcaggggcagtacgatgcatgggctgtcatctcctaggataactgccttcttctgtaatacgtggtgaaggactgacttgcctgaggctgttttacagttaactttttgaagtaggaagagtacactctaacataatgattaaaagtatggtatagttggccttggtgtggtggttcacacctgtaatc

SEQ ID NO: 70649 - DNA, 601 bp, Human
tcctaggataactgccttcttctgtaatacgtggtgaaggactgacttgcctgaggctgttttacagttaactttttgaagtaggaagagtacactctaacataatgattaaaagtatggtatagttggccttggtgtggtggttcacacctgtaatcccagtgctttgagagcctgaggcggcagattgcttgaggccaggagttcgagaccagcttggccaacatgtcgaaactccgtctctatttaaaaaaaaaaaaaaaaaagtgtaaaaacaaaaaagtatagtataataaatacrtaaaccagtaacacagtcgcttattgtcaagtattgtgtactgtacataattgtatgtgctattcttttatatgactgagagcacagtaggtttgttcacaccagcattacgagcccaaacgtgaggaatgcattgggctaagatcgctaaacaatagtaatttttcagctccattataatctgaccacctggaccaaaacattgtcatgcatgactaaattgttctcttttattagttattttttacagtgcctactttataaattaaactttatcataggtatgtataaagaaaaaca

SEQ ID NO: 70650 - DNA, 601 bp, Human
aactcttctctattttgttatttatgggtgcagttaatttagttgcctgtgaattgtccactatggtttatgtggcatatttttagtaccaaattccttaccattatataaggaagggatttttacagggattactagccagttttaataactactgagaacataattagataaaaccagaaaatgatatattttctttaaaaatgtatgcattaggttatctgctattggattttgcatactagtatttcttttccgaggtataggatatattttgtaaatgcaaaatgtaacttccccscttcatatatttctctaaatggaaataatttaaaataggctttgaaacaagtggcctttgctgtgcatttactgatagtatcatataatgcacgaattttgtatgtatttatgtatttttatggtagagatgggatcttcctaagttgcccaggctggtcttagactcctgggctcaagggatcctcttgccttggcctcccaaagtggtgggattaacaggcatgaaccaccatgcctagcctcgaatgatattactgtaattttagaaccatcaaaaaaatatcaggcctgtcaggga

SEQ ID NO: 70651 - DNA, 601 bp, Human
ccaaggaaagtttcatgttacttattttgtttccatgtctttttccaaaagaacttattttttatattataataaatatcagtggaaaagtaggtttcgttatatagaaattaactttaggctgggtgcagtggctcaagcctatatttgggaggccgaggcaggaggattgcttgaactcaggagttcgaaactagcgtgggcaatgtagcgagacctggtctctacaaaaaaaaaaaaaaaaagaaaaaaaagaaaagaaataaaggaaaccccctttttttgtttttttgttttttttgagatgaagtcttgctctgtcgcccaggctggagtgcaatggcacgatcttggctcactacaacctccgcctcccaggttcaagcgattctcctgcctcagcctcctgagtaactgggattacaggcgtgtgccaccatgcctggctaatttttgtatgtttagtagagacagggcttcatcatgttggctaggctggtctcgaactcctgacctcaagtgatccacctgcctcggcctcccaagtgctgggattacaggtgtgagccaccactcccggcaagaaattcactttttagac

SEQ ID NO: 70652 - DNA, 601 bp, Human
gatagatttgtatgacgatgtcatatctccatctgcaaataatggagatgccccagaagaccgagattacatggatactctcccaccaactgttggtgatgatgtgggtaaaggagcagcaccaaatgttgtctatacatatactggaaagagaattgcattatatattggaaatctaacatgggtaagtgaagttaatataagaattaaattattggtaattgattttgaactgctctagtaattaatgtttttctccagatttttataagtttgaagttactgtgtttttctatatgtktttgcttgtccaatgaggagggaaatacaaatatctttgcaacatcgttaattcgaattcttctagttttgagttttgtggtcattcaacttttcttggtggagatactagttaaatatagttaaattagttttgtcttcagttaccttttttatgctaccactttaccttgcttccgatagcccagtttcactaaaaataatgctcacatggggtctcaaaccaggattcaagtgtaaaaggaaagagacatagtatcactcctggtttaaaaatagtgtccattatttaatttgtgtt

SEQ ID NO: 70653 - DNA, 601 bp, Human
ctagttttgagttttgtggtcattcaacttttcttggtggagatactagttaaatatagttaaattagttttgtcttcagttaccttttttatgctaccactttaccttgcttccgatagcccagtttcactaaaaataatgctcacatggggtctcaaaccaggattcaagtgtaaaaggaaagagacatagtatcactcctggtttaaaaatagtgtccattatttaatttgtgttacaaatttgagttttatttctgcccttaaatttgaaatctgatttatagaagcacttctgtgygtattatattttaatttgggttgtcatgagactaagattattgatttagagcttcattaaatgcacatatgtatatttattttttattaatattacatcttaagtatcattaaaatagtcctatagaatgtttgtatttctacttagttatatgtatacttgaaagttaaaaacttgtatatgcaaaaatcaataaaacttggcacccttgcatttccttaataacactgtatttttaaacgttttatttacatttctttttttcggggggagacagaatttgcaaaactctgtcaccca

SEQ ID NO: 70654 - DNA, 601 bp, Human
aatttgaaatctgatttatagaagcacttctgtgcgtattatattttaatttgggttgtcatgagactaagattattgatttagagcttcattaaatgcacatatgtatatttattttttattaatattacatcttaagtatcattaaaatagtcctatagaatgtttgtatttctacttagttatatgtatacttgaaagttaaaaacttgtatatgcaaaaatcaataaaacttggcacccttgcatttccttaataacactgtatttttaaacgttttatttacatttctttttttcrgggggagacagaatttgcaaaactctgtcacccaggctggagtgcagtggtgtaatcatagctcactgaagcctcaaactcctgggctgaagtgattctcctgtgtcagcctccaagtagctaggaccacaggcatgtgtcactccgcctggctaattaaaaacaaaacaaaaaaacacttttgtagagctgacttcttgctatattgcttcaggctggcctcaaattcctggcctcaagtgatcctcctaaccaagctctcaaagtgctaggattatggtgcccagcctatttacattt

SEQ ID NO: 70655 - DNA, 601 bp, Human
aaaatagtcctatagaatgtttgtatttctacttagttatatgtatacttgaaagttaaaaacttgtatatgcaaaaatcaataaaacttggcacccttgcatttccttaataacactgtatttttaaacgttttatttacatttctttttttcggggggagacagaatttgcaaaactctgtcacccaggctggagtgcagtggtgtaatcatagctcactgaagcctcaaactcctgggctgaagtgattctcctgtgtcagcctccaagtagctaggaccacaggcatgtgtcactcygcctggctaattaaaaacaaaacaaaaaaacacttttgtagagctgacttcttgctatattgcttcaggctggcctcaaattcctggcctcaagtgatcctcctaaccaagctctcaaagtgctaggattatggtgcccagcctatttacatttcttttaaaactaaatgtaacagatctcccaccacccagtctgagtattctataaaattggagacagtagcagtgtagttatgaaagtatggttgctaagtaagtatttggatcttagctccaccatctattattagttttgtgacc

SEQ ID NO: 70656 - DNA, 601 bp, Human
ctagtttctgaaatacttatcagggaatgaagttaggttcccagatggtttttgtgctgtttaaaaattggagtctgactggccataactagacttagatttgcactcagcatttattttctcttttatgtctcaaatttccccttaaaaactagactgggataataaaaatcttggttttattttaatggttaatgagggggaaaatatcttgcagtggacaacagatgaagacttaactgaagcagttcattctttgggagtaaatgatattttggagataaaattttttgaaaatcgrgcaaatggccagtcaaaggggtaagttttttttttctttctttttgatttagtagctagtgatacagtttttacaagttaactttcctttaagttaatgttaattacacatgtatacacatgtatacaaacaacacatgattgtttacattggaaggaggttcttgggcaaagattgatacttttcattttacgtaccctattacctaacacactaaaaccagtagagtggaaatgtggacagatttattttctatttttcccaagttttctctatctgtggttgaaatggttgttgaaa

SEQ ID NO: 70657 - DNA, 601 bp, Human
acagtttttacaagttaactttcctttaagttaatgttaattacacatgtatacacatgtatacaaacaacacatgattgtttacattggaaggaggttcttgggcaaagattgatacttttcattttacgtaccctattacctaacacactaaaaccagtagagtggaaatgtggacagatttattttctatttttcccaagttttctctatctgtggttgaaatggttgttgaaatgacagtttaagaaccattactctccctgtgattaagagatgggagaagatgggcaactgaatratgtgttacatggatattttgctttatttcactactaaactatacaagtgggatagcctcagcatgagaacattataaatacagatatctaaaagtaagaaaataaaataccactgtcctaccattcattgatgtttacttttaacattttagtgaagattcttttgggctttttcctaaaaataaataaataaataaataatggaattataattcatgtgttttatatgtttgatataaggaataaaaataaatacacatcctctctaatgtctaattcttttgcatcatacctggtat

SEQ ID NO: 70658 - DNA, 601 bp, Human
cttaataaatatttgttaaattaatttagttttttctaaatgttgtgacccaagataatcctggtgcaaacagcagaacttgttgactaaaataagaaggataatttaaaagatcatattgaacattagggggaaaagagcttaagcttcttaagctactaagaccctccctccctcaaataatttagaatatcctgtaactatacgaattggtaatcattctgattattttaaatttgtttttctttttgaggtataattcatatgccataaaatgcaggcttttaaatgtacaattcartgataatttattatatttatgaagtttagcaaccattaccactgtctcattccagaacatttcatcactccaagaaggaaccttgtacctggttagcagtcactcccatttcctctcttcctatctgctggcaactgctaacgtgctctggatatgcctgttctggacatttcatctaaatggaatcataaaatacgtagtcctatgtgactggcttttttccttagcataatgattttaaggttcatccatgttgaagcatgcatcagcatttctttttatggctgagtaatattccac

SEQ ID NO: 70659 - DNA, 601 bp, Human
gtgaacatgtattttcagttctgttggatgtgtacctaggaatggaattactgggttaatatagtaactctatgtttaaatgtttgaggaattaccagattatttgccagaggcattgtgccattttattaatacgtgctcatcagcaatgtgcaatggttccagtttctccacatatttatttatttatttatttattgagacagagtctcactctgtcacccaggctggagtgcagtggcgcaatcttggctcattgcaacttctgcctcccaggttcaagcgattctcctgtctcagmctcccagcgtgggactacaggcacacgccaccatgcctggctaatttttgaatttttagtagagacggggtttcaccatgttggtcaggctggtcttgaactcctgacctcatgatcctcctgccttggcctcccaaagtgctgagattataggcgtgagccactgcacccggcctctccacatctttaatacttgtctttttgattatagccaccctagtgggtatggggtggtatcttgtggttttgatttgcacttccccaatagttaatgatattgtacatctttttattgtagca

SEQ ID NO: 70660 - DNA, 601 bp, Human
acccataaaagtaagtggtgatgcatgctgtaacagtggatgaagcttgaaaacatgctagttaaagaaggctggtcacaagggacctcctattgtatgattccatttagatgaaatgtctaggataggccagtccagagacagaaattaggtttagtggttccatagggtacagggatgggaaggaatgggagcgatggctaatggatatggagtttctttttggggtgatgaaaatgttttaaaattgattatggtggtggttataacactgtgaaatactaaaaaccactgaattatrtattttgaatgactgaattctatggtatgttatacaagatgaacaaaaatgtgtactcgtatagttaagaaatatttttagtttttaaaattatttatttttagagacaggatctcactgtgttgcccaggctggagtgcagtagtgtgattataggttactgtagcctcaaactcctgggctcaagcaatcctcgtgcctcaaccttctaagcagctgggattacaggcatgagccactgtgcccagctgttgttttagataaaagcagattaagacctttttacagaagaataacagt

SEQ ID NO: 70661 - DNA, 601 bp, Human
gcatcagagtagaatataaggtgggtgatttcactgtaagaagtgtgtgtacacggaaagatggaaaatatctctaggcattgtaatatttttttattaaagttttcgtttcaataatttttcttaagcataaattgagctagttaaatttgtaaggatatacttcattgtagttggtagtgtaacatttaccatacgggtttaatttaaagacaaagacttggtgtatgctctatgcgtttaaagtataatcttggcatataaaagttaaaatatcttattagtgaagtgttttttttttctctctttctcctttgttttttagctggacagactccaccacgtccacccttaggtcctccaggcccacctggtccaccaggtcctccacctcctggtcaggttctgcctcctcctctagctgggcctcctaatcgaggagatcgccctccaccaccagttctttttcctggacaaccttttgggcagcctccattgggtccacttcctcctggccctccacctccagttccaggctacggcccccctcctggcccaccacctccacaacagggaccacctccacctccaggcccctttc

SEQ ID NO: 70662 - DNA, 601 bp, Human
ctttccctcacaggtgattatgggagtgctattgagacactggtaactgcaatttctttaattaaacaatccaaagtatctgctgatgatcgttgcaaagttcttattagttctttgcaagattgccttcatggaattgagtccaagtcttatggttctggatcaaggtaaaactttcctgtctcatttccatttaaaaaaactgttagtttacaaatggaaaaaatactgtgagactttaaaaggaggactttgcttttacttactgattatttagcagctggagtggttttttttttttaactctaaatgttagttgcttgcttaaaaccctttaaaggctcctactcagtcttaaagcaagactgtaaagattgagggactgtgtgataaagcccctgcctatctttttagcctcattttgtacctctccccttactcactgttctccagtgagtatttctccatatttctccttttctttaggtacaccaaatgtttgaccacctcactttatattccttctgctgggagcagttttccctgtctcttcacatagctggctccttattcttcacgtctcattctaacttcttagggt

SEQ ID NO: 70663 - DNA, 601 bp, Human
aggcagacctaatcttcacttggtattcttagatatgtctttagtgtactctatctggtagtaatctgtaagagaaaagagcttgcctttgacatggtccccagttttgtaattattacctttttgacccggtgtaagaatctttgtgtctaaacaaatttgtcatagatatagttatcttgtatcatctttttaagttttgaagtccaaagtaataattttttaatcccaacactttgggagaccaaggcaggaggatcacgtgagccccaggagtttgagaccagccttggccacatarggagtttttctacaaaaaaattttaaaaatatctgggcctggtggtgcatgcctatagtcccagctacttgggaggctgtggtgggagggttgcttgagcctcagaggtcgaggatgaaatgaactgtgatcatgtccctgcactccagcctgggtgacagagagagagagagagaccctatcttgaaaaaacaaagtaataacttaggccttgatcaaggattttagcacctaatgtttgctaagcttagctgtctggtgcagaaatacaagacataaatattatttcgtagacagtta

SEQ ID NO: 70664 - DNA, 601 bp, Human
ttgtcatagatatagttatcttgtatcatctttttaagttttgaagtccaaagtaataattttttaatcccaacactttgggagaccaaggcaggaggatcacgtgagccccaggagtttgagaccagccttggccacataaggagtttttctacaaaaaaattttaaaaatatctgggcctggtggtgcatgcctatagtcccagctacttgggaggctgtggtgggagggttgcttgagcctcagaggtcgaggatgaaatgaactgtgatcatgtccctgcactccagcctgggtgasagagagagagagagagaccctatcttgaaaaaacaaagtaataacttaggccttgatcaaggattttagcacctaatgtttgctaagcttagctgtctggtgcagaaatacaagacataaatattatttcgtagacagttattatttccttactgtgaatttagcagaatttatagaagtcttttgggtagtaagctttggttaaattatttgtttttaaaaaatcgcagttcatgaaacatttctacttattaaatacaatgtgaatactatatctattcttgctactggtcataattg

SEQ ID NO: 70665 - DNA, 601 bp, Human
cttctggaaacatctgaaacaaattataggtaagtaatgacaggtaaaaattttgaccctttatcttatgaatattttattgctgagttatcactttcaggtttcaaatagttaatggtcttaacaaagcaaggaaataatcaagaggactcattgtgtacttctaaaatctaaaaattggggttcttgtatcacatacataggttgcatgcaatttaaaatacaaaacacagggagttatttcacatatatgttatgtgtttggatttttaaaaataaatggaaagttactatttttgamctagttttatttgtccctaaaaatttatgagaaaatctaacacaataatagtttataatacaggagggtgttttctcaacattcaaagagaattttcctttaaaaaaaaaattttttttttagaagagacactatcctgacatctgctttttgtttttaaaagaaacagtatcctttaatttgcaaagaagatgtaaaagttaatcaattaaaatgggtttagggtgcactgatttatatctaaaaattttaaattgtgtcaagccatatacccaagtttagaataccttgaaataattt

SEQ ID NO: 70666 - DNA, 601 bp, Human
taatggtcttaacaaagcaaggaaataatcaagaggactcattgtgtacttctaaaatctaaaaattggggttcttgtatcacatacataggttgcatgcaatttaaaatacaaaacacagggagttatttcacatatatgttatgtgtttggatttttaaaaataaatggaaagttactatttttgaactagttttatttgtccctaaaaatttatgagaaaatctaacacaataatagtttataatacaggagggtgttttctcaacattcaaagagaattttcctttaaaaaaaaaawtttttttttagaagagacactatcctgacatctgctttttgtttttaaaagaaacagtatcctttaatttgcaaagaagatgtaaaagttaatcaattaaaatgggtttagggtgcactgatttatatctaaaaattttaaattgtgtcaagccatatacccaagtttagaataccttgaaataattttctttgatgtttcattcataaatcataatcattgtctttttttctgtattttaaaactttcttgtgtacatttttcataaagtgggaagagttgtctgtttatgcttcattt

SEQ ID NO: 70667 - DNA, 601 bp, Human
taacaaagcaaggaaataatcaagaggactcattgtgtacttctaaaatctaaaaattggggttcttgtatcacatacataggttgcatgcaatttaaaatacaaaacacagggagttatttcacatatatgttatgtgtttggatttttaaaaataaatggaaagttactatttttgaactagttttatttgtccctaaaaatttatgagaaaatctaacacaataatagtttataatacaggagggtgttttctcaacattcaaagagaattttcctttaaaaaaaaaattttttttttagaagagacactatcctgacatctgctttttgtttttaaaagaaacagtatcctttaatttgcaaagaagatgtaaaagttaatcaattaaaatgggtttagggtgcactgatttatatctaaaaattttaaattgtgtcaagccatatacccaagtttagaataccttgaaataattttctttgatgtttcattcataaatcataatcattgtctttttttctgtattttaaaactttcttgtgtacatttttcataaagtgggaagagttgtctgtttatgcttcattttcacatgta

SEQ ID NO: 70668 - DNA, 601 bp, Human
acattcaaagagaattttcctttaaaaaaaaaattttttttttagaagagacactatcctgacatctgctttttgtttttaaaagaaacagtatcctttaatttgcaaagaagatgtaaaagttaatcaattaaaatgggtttagggtgcactgatttatatctaaaaattttaaattgtgtcaagccatatacccaagtttagaataccttgaaataattttctttgatgtttcattcataaatcataatcattgtctttttttctgtattttaaaactttcttgtgtacatttttcatraagtgggaagagttgtctgtttatgcttcattttcacatgtaattttattttttatatttgttaatagcatttattcatgtgaagagctgggggagggcactataaggcttatgcatgtgacacaaaggttattctgtaaattaaaatattttttctttatatgttggttggcatattcaaattaaattaaggctaaacaaacccctcataggtaaatactctttatgtgattattttcagtaatcatgggaaacttactgaaaattcagtcatggtaattgttagtatttaaattgtta

SEQ ID NO: 70669 - DNA, 601 bp, Human
ctttataagttatcagcaagcttcttgttagtaaaggcatgataatgaaacttgaattcatctacaaaattggatgtgcccatcaaggggcctctaaaccaatttaagcccaaagttaactaattacaatttctactggttttagtaaaactagcatagtcaaccaagtaaacaaagtccattgttaatcttatttgagttagctaacattacattctagtaatgggtacacctaaatatatcatgacttgagtttcattacattcagacataaactacaaattcctaatgtgcaaactaytgttgacatttttcttaatcactgatgtaccataccagaatttccatgttttgtttgtacattaatcagaattgagttgtaatactgtatgtgccttcatccaagaaaaattttacataagcatttctagtgcaaaaaattctgttatcctggattattgtacgtttgctatatcaaacagtattgtggatgtagacttgaataaaggggtggggactgggattaaatatattcaagtaaatctttaaaacaaaagctatctgcaaatttgatcaccatcataataaggtctgttgacct

SEQ ID NO: 70670 - DNA, 601 bp, Human
tcagtatgtaaatacgttgtgcttcatattctgtaatttctacctctattctcagaccactctgagcaaaataaaagtagttcagtgctttacgattgtacattttttactgaaataattttagtttcatagttgagttacttaaaaggttacgttcctcttgtcacttctttggaacatccctactcagcaaatttgtgttaacaattcagcttttctttgtttactgaaaccaaattatgtttttttaaaatactctttattcaggcttttcctctctctattttatgaggttttacarttctcaaatcatccatgacaatttttaagcattgggtatggggtctggattaaataacttgcctttgctatctgattacttttttttttttttttttttgagatggagtcttgctcttgttgcccagtctagagtgcagtggcacaatctcagctcaccacaaccttcacctcctgggttcaagcaattctcctgccttagcctccggagtagctaggattacaggcatgtggcaccacgcccggctaattttgtagttttagtagagatggggtttctccatgttggtcaggctggtct

SEQ ID NO: 70671 - DNA, 601 bp, Human
ataaaagtagttcagtgctttacgattgtacattttttactgaaataattttagtttcatagttgagttacttaaaaggttacgttcctcttgtcacttctttggaacatccctactcagcaaatttgtgttaacaattcagcttttctttgtttactgaaaccaaattatgtttttttaaaatactctttattcaggcttttcctctctctattttatgaggttttacaattctcaaatcatccatgacaatttttaagcattgggtatggggtctggattaaataacttgcctttgctrtctgattacttttttttttttttttttttgagatggagtcttgctcttgttgcccagtctagagtgcagtggcacaatctcagctcaccacaaccttcacctcctgggttcaagcaattctcctgccttagcctccggagtagctaggattacaggcatgtggcaccacgcccggctaattttgtagttttagtagagatggggtttctccatgttggtcaggctggtctcaaactcccgacgtcaggtgatccacccatctctgcctcccaaagtgctgggattgattacaggcgtgag

SEQ ID NO: 70672 - DNA, 601 bp, Human
ctcttattaaggagaaattttcagatagagaaaagtgaattttatttcgttgagttagtagtgcatctctaaaattatgagaatccttttaattcagtatattaatgtgaaaatctataaaagtgccctgtcaagtatttatttaaatcttaaaagatgaatttaccatgaatttaaaatactaattctaacaaatgtgcatagataaatttctaacagaaacagttataatttgagttgttaataatggcttgatatagtatcttaaaatacaagtacttctctgtgtgttgaaattttrcttagtgctcactttagtttacagactttattaaaaaggtgtagattccatttatcatcttagttgttttaacatctgtttacataggcctttcttttataattaatagctaaagcaagtaattgtgtggctttgacattacagattttaccaaatgatacattgaaaacatggacgttgaatgtatttgtcacttttaagcttctttttgatatctttgttgatgtagttgcctacttagacatttgagagtataatatggaattggattattggaaatgggttgtattgccttcaaat

SEQ ID NO: 70673 - DNA, 601 bp, Human
accctggggaagaaaggaaggagaatgaaaccaggaacatccttaattagtaaaacaccacaaactatcattgctaaatatgaattcccaggcttgctccagagtcctgcctcaatgaaatcatttttaaaaggcaatccttttattctgcaaatagcatttttttaaccagttgtctgccttcacctttacatgtctaaattgccaccaaactcagtgtgctatacattttgtctatgagtggccttcccaaagatccttagacgggtggagagctgaggggtaaggaagaacccaattygaagtcttgatgataaaatttctcagcatggcttagaaggtttggagccatacagacctaaactaattccagttctggcccagaccttcaaatgcaaaaggctaatgggtaatatacaaaatggagaaatttgtgttttgtcaacacaagtttgtcattgtttaaactttttgaaattttaaacaatttctttctgaaatgcaacatgactctccattatgaaggtaggccacaaaccacattaatcactgctaaggcaatcattttgataattaatcatactaccaaaggtgtatgtca

SEQ ID NO: 70674 - DNA, 601 bp, Human
ggctggagtgcagtggcgcgatctcggctcactcctagttcctcctcccgggttcatgccattctcctgcctcagcctcctgagtagctgggactacagatacccgccaccacgcccagctaatttttttttgcatttttagtagagacggggtttcactgtgttagccaggatggtctcgatctcctgaccttgtgatccacccacctcagcctcccaaagtgctgggattacagaaaacttaccatttattattagtcaagaaacaaacttacaaaagccaaaataagacaggtgaaaagggttgctcagaatagttttctttcatagttattccaaaggtgtcctaagatagtcatcacagcaaccacaaatctttctactatcacaaacaaaaccgagcaactacttatttacctttttcttctgggcaacctcctcttctggtttaggaacaatctgttccttttccgtaaggatcatctcaatgtggcagggagagctcatgtatgggttaatccgaccatgagctctgtaggtccggcggcgcatcttaggtgctttgttcacttggatatgctcaatgaccagagaatctaca

SEQ ID NO: 70675 - DNA, 601 bp, Human
ggccaactgcctggccagcgggggcgtgctggaagtccgtgtggacttcgtggcttttccttgctgactttggaggttcctggtacttggccttcctgggaaattgctcaagaaagcggctttcttcttcatcctactcttcattcattcattgaacaaaccattttctcactaatgatttcctagctttccgtacttcaccaggagcccctaaactcctgacctgaggcatgaacaccatgacctagaaaccacatgctaggtgctccatctctgcagcttccagcgttgcttacaaacgagcactttatttcattaaataatcatgagtctgtttcctgggggtttctgagctcccacaactctcttgggttctaggtaagggacaagactatgtgagggaaagctgcttagctagctagagaaatagccagaaaagattaggttattattatttttttgcctttttttggttgttgtttgcccaaccttcaataaggattgggttcttaatcttttacctgcacactgcagactttaggaagctaattgatgaaatcagaataggcttggaccttatgctctttggtgatttctgtaa

SEQ ID NO: 70676 - DNA, 601 bp, Human
gttgtttgcccaaccttcaataaggattgggttcttaatcttttacctgcacactgcagactttaggaagctaattgatgaaatcagaataggcttggaccttatgctctttggtgatttctgtaacctcccttcctttctctagatttttagaaaattttattttttaaacttttatacagatggggtcttgctatattgcttaggctggtcttgaactcctggactctagcgatcctcccaaagtgctgggattacaggcatgagccactatgcccagccaactttctctagattttartaacccggggacctgttggcttgatgacttgttccatccctgtaatgatcacaaggtcgatggtggacctgtggtgtgtgttcagctgtgtttttcagacctgctcccaacagactctcttctttagtcccctctcaatcctgtggggtctattttgcataatactgacttgtataggtagttggattgcattattgcattgcaaacatttgttctttttttttttttttttttgagtcggagtttcactcttgttgcccaggctggagtgcaatggtgcgatcttggctaactgcagcc

SEQ ID NO: 70677 - DNA, 601 bp, Human
aggacaagttttgaccacagtggattctggctgagtgttatggcctcattatcctttcctatttgatttggaagtggatactgagtagaagtacctgttatcattctgttgtaatcgtgataccacaactgtattctctcaaggaggaggaatttcattaaaacagtaaaagcaggatgagaagaaactaccccagatttggtggcagaaaaatttggatggtactgggagagtctaaacagtggttaaaaggtaagggctctggagtcaggctaagtttgaagcctagctctgttgtggktttttttttttttttttttttttgacagtctcgctctgttgcccaggccagagtgcagtggtgcgatctcggctcaccacaacctccacctcccggcttcaagcgattctcctgcctcagcctcctaactagctgagactacaggcacgtgcaaccgtgcctggctaatttttgtattttaatagagacagggttttaccctgttggtcaggctggtctcaaactcctgacctcgtgatcctcccacctcagcctcctaaagtgctgggattacagcccggcctctgttgtggttttgtg

SEQ ID NO: 70678 - DNA, 601 bp, Human
ggacaagttttgaccacagtggattctggctgagtgttatggcctcattatcctttcctatttgatttggaagtggatactgagtagaagtacctgttatcattctgttgtaatcgtgataccacaactgtattctctcaaggaggaggaatttcattaaaacagtaaaagcaggatgagaagaaactaccccagatttggtggcagaaaaatttggatggtactgggagagtctaaacagtggttaaaaggtaagggctctggagtcaggctaagtttgaagcctagctctgttgtggtkttttttttttttttttttttttgacagtctcgctctgttgcccaggccagagtgcagtggtgcgatctcggctcaccacaacctccacctcccggcttcaagcgattctcctgcctcagcctcctaactagctgagactacaggcacgtgcaaccgtgcctggctaatttttgtattttaatagagacagggttttaccctgttggtcaggctggtctcaaactcctgacctcgtgatcctcccacctcagcctcctaaagtgctgggattacagcccggcctctgttgtggttttgtga

SEQ ID NO: 70679 - DNA, 601 bp, Human
ggctaatgatagaacctacttagcatagttgtgaagattaaatgaggtagtacatagtaaacttccaaagctgttggctgctggtgcctttgttactgcctaagtgttggaccaaaggaaactggaaggtgattttcattcatggtggtagattatgtgttaaggtgcctttgcttctggacaatcaactctccctagtttggttttttgtaccatctgcatctacctctatgactcattgctgtgttacaataggaggcatctttgtgtaggctgcccaagacaaacagggactgtttcyctgtgtttcatagcactaatgagagggaaagctgtacacatcttcatctttcacttctgagagtgttcctcaagcaaaatgttccctatcttgggctaccagcagaaagaattctgttgctttcatgatttctgtgattagaccagggcacaattttgaacgttatcagacaatgtgaactaaagaggaagaaaatccattttgacagtaaagaactcttggtaccaaattggcaaggttgcttttcccttggcacctgtgcttacctctaacatagcccttacccagttcagagatgga

SEQ ID NO: 70680 - DNA, 601 bp, Human
atgttccctatcttgggctaccagcagaaagaattctgttgctttcatgatttctgtgattagaccagggcacaattttgaacgttatcagacaatgtgaactaaagaggaagaaaatccattttgacagtaaagaactcttggtaccaaattggcaaggttgcttttcccttggcacctgtgcttacctctaacatagcccttacccagttcagagatggagttgggtaatacgggacctgaagttgatgcaagttgtaggggtcctcaaagaaaaatcatgcaaaaatagctttctttygtgtattttgcagaaacatgtgagcatattactagggtcttaagtgttagaatgagataatgagataatattgttcctctgtttaaaatgttcttctggttctattgcagttacacaaaatccaaactccttatattggactatgagactgagtgatctgcctgttgtccccaccaccccctcccaccaatctctttaaccacatttcctgccactcctttcttccaccacactagtcctctttcacttcctctatgggatggtctatatgcactgcaggcctctgtacatgctgttccc

SEQ ID NO: 70681 - DNA, 601 bp, Human
aagaaaaatcatgcaaaaatagctttctttcgtgtattttgcagaaacatgtgagcatattactagggtcttaagtgttagaatgagataatgagataatattgttcctctgtttaaaatgttcttctggttctattgcagttacacaaaatccaaactccttatattggactatgagactgagtgatctgcctgttgtccccaccaccccctcccaccaatctctttaaccacatttcctgccactcctttcttccaccacactagtcctctttcacttcctctatgggatggtctataygcactgcaggcctctgtacatgctgttccctttgcctggaatgaatcactcctccttccctaggtaggcaggaagcagtcttcacctatttgcctaaatgtcacttcctctgagatgtttataagcatctcagaggaatgtggtccctctttgtcatgtcacctgagctgctgcttttttttttttttttggtatgggggtcttggtatgttgcccaggctggttcttgaactcctggactccagtgattctaccacctcagcctcttgagtagctgggactataggtgggtactactgt

SEQ ID NO: 70682 - DNA, 601 bp, Human
gcctgttgtccccaccaccccctcccaccaatctctttaaccacatttcctgccactcctttcttccaccacactagtcctctttcacttcctctatgggatggtctatatgcactgcaggcctctgtacatgctgttccctttgcctggaatgaatcactcctccttccctaggtaggcaggaagcagtcttcacctatttgcctaaatgtcacttcctctgagatgtttataagcatctcagaggaatgtggtccctctttgtcatgtcacctgagctgctgcttttttttttttttttggtatgggggtcttggtatgttgcccaggctggttcttgaactcctggactccagtgattctaccacctcagcctcttgagtagctgggactataggtgggtactactgtgcctggcgctcacctgagcttttaataagacttaatcattgtaatttttcattggggtgttcttaatatttatctctcctgtacactataaactttaagcacagcactgcctttttgttttttgagacggagtctcgctctatcgcccaggctggaatgcagtggcactacctcggctcactgcaagctc

SEQ ID NO: 70683 - DNA, 601 bp, Human
ctcggctcactgcaagctccgcctcccaggttcatgccattctcctgcctcagcctcccaagtagctgggactacaggcgcccaccactgcgtccagctaattttttgtatttttagtagagatggggtttcaccatgttagccaggatggtctcgatctcctgatctcgtgatcccaaagtgctgggattacaggcgtgagccactgtgcccagcctgcactgcctttttttgactcaccactctgtaagtacacccaaaatagttctggcacataataggtccatagatgtttgttgartcagtgagtgaatgaaatttctaatatttgcacaacgggtttaataaacctttttatgtcttttccttttcttttcccctttatgctcattccttttttccccattttcttttgttttagtcacccactcaaccattctaagatatttatatggttttataattccacctgttagtctggttatgtgtatacccttgggaagtagaaggatggttttgtatgtatctgcttaggattctaaaatgttattgtgctacaaatctgcatttcatagacaggatagaataggttatgttgagg

SEQ ID NO: 70684 - DNA, 601 bp, Human
tagggatccaggctgatcgaggcatcgtctctcaagtatacctacatgaggagggaatcttgtgaagagctacattcaggctcttaaagttttgcctagaggtgagccttgtcatttttgctgccatttctttggccagagcaaatcatgtggccatgttgaccttcaaggagggcagtgacctttttggaagggggagaaccacgaatatttgtgtgttttttttggtttttttttttttttttaagaaagggtttcgctcccactgcccaggctggagtataatggtgcgtgccaccaygccctgctaagttttgattgttttgtagagatggggtttcaccatgttgctcaggctggtcttgaactcttgggctcaagcgatctgcccacctcatcctcccaaagtgctgaaattataggtatgagccactgtgctggtgcaccaggagtatttgaacagaagcaatgaccatccctaaattttatatcagtttcttctttgttttcttttcttttcttttttttttttttttgagatggagttttgctcttgttgcccaggctggagtgcaatggcatgatctcggctcaccgcaac

SEQ ID NO: 70685 - DNA, 601 bp, Human
ctgcccaggctggagtataatggtgcgtgccaccatgccctgctaagttttgattgttttgtagagatggggtttcaccatgttgctcaggctggtcttgaactcttgggctcaagcgatctgcccacctcatcctcccaaagtgctgaaattataggtatgagccactgtgctggtgcaccaggagtatttgaacagaagcaatgaccatccctaaattttatatcagtttcttctttgttttcttttcttttcttttttttttttttttgagatggagttttgctcttgttgcccaggytggagtgcaatggcatgatctcggctcaccgcaacctccgccccccaggttcaagctattctcctgcctcagcctcctgagtagctgggattacaggcatgtgccaccgtgcctggctaattttgtatttttagtagagacagggtttcaccatgttggtcaggctggtctcgaactcctgacctcagatgatccgcctgcctcagcctcccaaagtgttgggcttacaggcgtgagccaccatgcctggccttagtttctttttttaaccaattttgttttgagctctattcatgatgc

SEQ ID NO: 70686 - DNA, 601 bp, Human
ttgaactcttgggctcaagcgatctgcccacctcatcctcccaaagtgctgaaattataggtatgagccactgtgctggtgcaccaggagtatttgaacagaagcaatgaccatccctaaattttatatcagtttcttctttgttttcttttcttttcttttttttttttttttgagatggagttttgctcttgttgcccaggctggagtgcaatggcatgatctcggctcaccgcaacctccgccccccaggttcaagctattctcctgcctcagcctcctgagtagctgggattacagrcatgtgccaccgtgcctggctaattttgtatttttagtagagacagggtttcaccatgttggtcaggctggtctcgaactcctgacctcagatgatccgcctgcctcagcctcccaaagtgttgggcttacaggcgtgagccaccatgcctggccttagtttctttttttaaccaattttgttttgagctctattcatgatgctatacaatatgtgtctagttcattatttctcttggttgtagagcagtcatgtttgcctgccacattttacttatttatttctctagaattagacatc

SEQ ID NO: 70687 - DNA, 601 bp, Human
tgcccagctaatttttatatttttagtagagacagggtttcattatattgctcaggctggtctccaagtcctgaccttgtgatctgccctccttggcctcccaaagtgctgggattacaggtgtgaaccaccgcaccggctattaatctctttctttaaaacaataccgttaatccagttgcagtagtgaggcagggtacctctcaagatctcactttttctttgaccttgggcaagtcctttctactttctgactcttggtttccttaatctgtaaagtggaggtgataattgtttacaraatctttaccatggtggcctacaaggccctacctgaccaggtccttagttttcttccagtgttctcttcactcatgcactctagccacactgtcctttgtgctgttgggttgtaggttgggcacattcttatcttagaatctttgcatttgccattcctgctgcctggaaagcttgtctctcaaataccgtatgacttgcttcctcacttccttcacccctctgttgaaatgtctcttcacagaggccatctttgatcactgtaatacagaactccctgtcattttctaccctttgattt

SEQ ID NO: 70688 - DNA, 601 bp, Human
tgattttggattttgaattgtttctatgtaaccctgaaacactcagacttacttattgcattcagggtgtagttcatagcatcagcagttctgccaggtttgtaaggaacacacatctgttagagtgtgaaggccctggaggaagaaaggttgagacaggttgatgtgcttttttttgtctcttatggctctttctgaaggttgatgtgcttttttttgtctcttatggctctttctgagatgtgtaccatgatgataaccaggaactttttttttttttttttttttttgagagacaggrtcttgctcagacactcaggctggagtgcattggtgctcactataaccttgaactcctgggttcagggaatcctcctgcttcagcctcctaagtagctagtactaccggcatgtaccaccatgcctggctaattttaaaatttagagatagggtcttactgtattgcccaggctgggctcaaactccttgcctcatgcaatcctccctccttggcctcccaaaagtgctgggtttacaggcatgagccaccatgtctggcctgataagtaggagcttttgaagtggtttcacactgatttt

SEQ ID NO: 70689 - DNA, 601 bp, Human
aggttgatgtgcttttttttgtctcttatggctctttctgaaggttgatgtgcttttttttgtctcttatggctctttctgagatgtgtaccatgatgataaccaggaactttttttttttttttttttttttgagagacaggatcttgctcagacactcaggctggagtgcattggtgctcactataaccttgaactcctgggttcagggaatcctcctgcttcagcctcctaagtagctagtactaccggcatgtaccaccatgcctggctaattttaaaatttagagatagggtcttrctgtattgcccaggctgggctcaaactccttgcctcatgcaatcctccctccttggcctcccaaaagtgctgggtttacaggcatgagccaccatgtctggcctgataagtaggagcttttgaagtggtttcacactgattttgtagttttgaacttggatgcttcttttgggtagttgatgcagtaactaatactggtgctgtctttcagaacagcttcatgtgaaaaaggcctgcttaagcctgtgtctttgggaagaacatctctgctgctgttacagcagatacagtaatagcaaa

SEQ ID NO: 70690 - DNA, 601 bp, Human
ctaattttaaaatttagagatagggtcttactgtattgcccaggctgggctcaaactccttgcctcatgcaatcctccctccttggcctcccaaaagtgctgggtttacaggcatgagccaccatgtctggcctgataagtaggagcttttgaagtggtttcacactgattttgtagttttgaacttggatgcttcttttgggtagttgatgcagtaactaatactggtgctgtctttcagaacagcttcatgtgaaaaaggcctgcttaagcctgtgtctttgggaagaacatctctgcygctgttacagcagatacagtaatagcaaagaaagtcttaaagatgatttagcccatggcaaggaaatatatgggactcttgtttgaatataaacactcacagaattccagtttcacttatttatgcacctttcaaagaaaggaagaagatactgtggtagagtacagtagtcctcccttatctgagtggcatatgttccaagacccctagtggatgcctgaaaccacagatatcaatagtaccaaaccctgcatatactgtgttttttcctatgcagtatatgcctatgatgaagtttaa

SEQ ID NO: 70691 - DNA, 601 bp, Human
atagtttcttaataattctcttgcgtcctgagttaatatttcaaatacgtaacattttgatgctgttgttattgaacatttttaagtttgtattttccatctcgactatggtttgttttgtatgaactggttatatccagcagctttgttaaatccacttaatctatctagtaacgttttttgattgaatatatatgcatttgtagatttactagtgtcatctgcaaaacaactttttcttttcaatgtgatagatattttatagctgtctcatcttgcgttgctctcagtagcagttctkgtgtctcagggaacactattaagtgtaacgaggtttctcaaggacctcctgggccagggacttttctgttctttccaaggagctgtgaaaaaaggaagcagctgcccagatttatagaagcagagcttattagggctggatgggacctaacaggttctctagacctgggccttcatttgagagatgaggaaaccagacctagagaggtgtgaatttgccagagttcacactgctgcagtggaaggaggtggttgagcttttactcttatttttttatggtacatattacatacagtacat

SEQ ID NO: 70692 - DNA, 601 bp, Human
aatgagtcaatcgttgttttacaggtttgtctgaatccaggttaattatgtttccttctttattgaattataatttgtatatccaggttagttttacaaattagatcagaccctcagtccatttgagagtagactcagagtcagaattatttgccccctttgctgctttcataccaccctttagtaaacagtcctcaagaatgtccttatgtcggggagggcagacctcagaagttagcaagaattccaagctcactgtaaaccttttgtttaatggtttactcaaatccagatagaaatkctaccaaaatgccagcctgtatttcagctcctctttcttggagtctttaggatggtgggaaaacaggcagaagaaagctgtttaacattccaataattattaataatagaaaatgtatcctgctaatcaggcactcatttgcgtccactgataaaactaggtcattggagccaaggaaaggtaccgttcactaaaggaaagaccagtagatagtcaggcatggtggcgtgtgtctgtagtcccagccactcgggggctgaggcaggagaatcacttgaaccagggaggtggtggttgcag

SEQ ID NO: 70693 - DNA, 601 bp, Human
ataatagaaaatgtatcctgctaatcaggcactcatttgcgtccactgataaaactaggtcattggagccaaggaaaggtaccgttcactaaaggaaagaccagtagatagtcaggcatggtggcgtgtgtctgtagtcccagccactcgggggctgaggcaggagaatcacttgaaccagggaggtggtggttgcagtgagcggagatcgcgccactgcactccagcctgggtaacagagtgagtgagactctgtctcagaaaaaaacaaaacaaacaaaaacagtggaatattgggctmagctcttaacacattatatttagagattgcaacacttcaatatttactggaatactcctataaaacggtctcttttgccttgttttattttggtaactaagtgaatgctgggttagccataaaggtagcttgctgcatttctatttcttgtgttctaaatcactgaataattttttaaaaaagtagttctaaagcatttccagttaaaaaggaaggcgtaacatttattaggggaagtcaaggggagaggtagtgaggaaagtaccagaaaccaccaacaggtgtttcggttacgttgaa

SEQ ID NO: 70694 - DNA, 601 bp, Human
aggtcatagtattctattttacaaataaggaaaattaagctcagggaagttatttcataaggttgcacaactagtaggtggtagagctaagtttagactcaggtctgtcctactctgataggcatgctttttccacacggccctctcagtactgtgtaaaatgccagagggctttctggatcttcacttcccaaaactgctaaatttaaattaattaaaattaaagttgaaaaatcagttcctaggttgcactgcccacatttcaagggctcagtgtccatgtgtggctagtggctactayactggaccagcacggattagaatgctttcttcattgcagaaagttctattagtgctggtctagaggtcattcagttttgcccctttatttaattttttcccccttttattccacaaaggagaaaatgagggacaaagaaaggaagtaacgttcagcatcagacagctaattaatccagttttttggactggttgcctgttagattttcccatgccccacattcttcccttaaaaaaatgaacagaatggaaatgtgagaaatggagtgactccgctactctcccagctttgcctggcctt

SEQ ID NO: 70695 - DNA, 601 bp, Human
gggacaaagaaaggaagtaacgttcagcatcagacagctaattaatccagttttttggactggttgcctgttagattttcccatgccccacattcttcccttaaaaaaatgaacagaatggaaatgtgagaaatggagtgactccgctactctcccagctttgcctggcctttaaactagattctttctcccaaagaatcctgcattttaccaagttcaaagggcatgtccggattagtttccccaaaggaaatgaaatatatttgttggaaaggaattccattcttaatgtatgaaatarcacttggattccctctggttctttctctgacttcctaccaagcgctttgtaattgaacttgcagctgctaaccatttgtcttccaaaggagaccaacttcaaacagttcaaatgacagagggatgtatactttgaatgcaagcagctgcctattatttgccattgattcaaatggcatttatgttagagtcaaatagatttagattatggccaaaattacaacaatagatttctaacttgtatgttaagagtaagatgtattaacagtcattgaactgatgtttagtgtttaactcatac

SEQ ID NO: 70696 - DNA, 601 bp, Human
tcaaatgacagagggatgtatactttgaatgcaagcagctgcctattatttgccattgattcaaatggcatttatgttagagtcaaatagatttagattatggccaaaattacaacaatagatttctaacttgtatgttaagagtaagatgtattaacagtcattgaactgatgtttagtgtttaactcatacataccaggcactgggttgcaacatgaactaaaaggacttttgctgaaatggaaaaagatgtcttattatggacaagttgaatgcattttaaattcctgtctgaattayattgctggtatttgccatccatgtaccttcctgtttagccttgaaattcagtaaaagcctcagtgtggatcatacttcatagctctgaagtaaagtgaggagtcatgtgcaaatgtccttttagtagatgctattaaaaggcatttaaattatacactccagtgtctaaatgacagtctgaagtgtatgtgtgtttggaggatgggcaagtgggagcaaaaggaggcattgtgctggggcgattgatatttttaggaagcctaaatgtaatgtttgatttcggtataactaacagactca

SEQ ID NO: 70697 - DNA, 601 bp, Human
ccttgatggatatgtgacatgggtggctgaatttacatggcacctggtggcttctcacactcctccgccacgcctctggggactaggataggacagatggccacagacaggattctcagctctgcaaatcacatttgggaaaaagttaagtttgtgcaataacacaattttggtaacatggtttcatgctgctggtaaattctataacactctctggataaatcacacttcagcagaactcacttgggaacagagtttaatttcactgtaggtggctgtgattcccacccaccagtcttcmcacccccgctaatatatctaggctgataaggtgaatgctgtgctaagcaggctatttctgggcccaggatagaattacattgtggtttttaaagaatttttttctgtatatttttctattcacagaccctttgaaagaagaattacattatgttaatcatccgtttccccatcagcacctttaattccttctccccagagtataaccacttgtcattaaaatgacagaggtggaaaagatcttgatagttcagcctcctgtatgtatatatgaagaggttgaggcccagagagactgggc

SEQ ID NO: 70698 - DNA, 601 bp, Human
cacaattttggtaacatggtttcatgctgctggtaaattctataacactctctggataaatcacacttcagcagaactcacttgggaacagagtttaatttcactgtaggtggctgtgattcccacccaccagtcttcacacccccgctaatatatctaggctgataaggtgaatgctgtgctaagcaggctatttctgggcccaggatagaattacattgtggtttttaaagaatttttttctgtatatttttctattcacagaccctttgaaagaagaattacattatgttaatcatcygtttccccatcagcacctttaattccttctccccagagtataaccacttgtcattaaaatgacagaggtggaaaagatcttgatagttcagcctcctgtatgtatatatgaagaggttgaggcccagagagactgggcagcctactcagttgtcagatggctggtgaagacctgcatccggatccgttgacttctctcctgtgcagggcccttgttttttgccctgccctactgcttaaccttgtcttctgtcttacaactaggggagagtctatggcatgttcagtttgaaatgaataa

SEQ ID NO: 70699 - DNA, 601 bp, Human
ggataaatcacacttcagcagaactcacttgggaacagagtttaatttcactgtaggtggctgtgattcccacccaccagtcttcacacccccgctaatatatctaggctgataaggtgaatgctgtgctaagcaggctatttctgggcccaggatagaattacattgtggtttttaaagaatttttttctgtatatttttctattcacagaccctttgaaagaagaattacattatgttaatcatccgtttccccatcagcacctttaattccttctccccagagtataaccacttgtcmttaaaatgacagaggtggaaaagatcttgatagttcagcctcctgtatgtatatatgaagaggttgaggcccagagagactgggcagcctactcagttgtcagatggctggtgaagacctgcatccggatccgttgacttctctcctgtgcagggcccttgttttttgccctgccctactgcttaaccttgtcttctgtcttacaactaggggagagtctatggcatgttcagtttgaaatgaataaaagtgaatacttgttcattgttaaaggaccccaacacagaactaatttcctgt

SEQ ID NO: 70700 - DNA, 601 bp, Human
cctgtgcagggcccttgttttttgccctgccctactgcttaaccttgtcttctgtcttacaactaggggagagtctatggcatgttcagtttgaaatgaataaaagtgaatacttgttcattgttaaaggaccccaacacagaactaatttcctgttaacccttacattttctcttgacatatctttggtgaggaccattaaaggcttaacacatttctgtacagtgacatgcagtcctaggggttaactgtgtgggtttgagcgataggatttaacttttaggaaaaaggggaaaaaaggaggttgataagtgtatttggagagagagaaaaaatagttaatttttctcttaacagttaatctgaaatgataacacaattgtgccttttggctctaaaatcaccatatttttgatatataatccaaaggcaggtatccagactgctgaaggcttattaaaatgtaacaataggtccaagtctagaacttgaaaaaacttctcatttgtcaaagaagttccagtattctacattctcttgctaatgaatttggggagccttggaagctcagcaactgggatgccatcgacaggtttgcggt

SEQ ID NO: 70701 - DNA, 601 bp, Human
atgtggcgatctttgtacatatttgttctgctttactagctacattgtaagcttctgcagatgaagagttcagccttgatgtcccatctcccgcccaggcctgccatgtactagttgatcagtaaaagtggaatgaatgaaagccagtgttagtttacagagcttctgtgggacagaagctttgttcagttgagtttccatcaatatcaaatgcaatgttatgtgcgttgagtttcttgataactgttcttgaggtttctttttttttttggtcctttttgactgattaagcaaggctggwctggttggagaccccagatgggaccaagaaatgcgaatcctgcctggattgttgtaggtagagtgcttaatatggggcctggcatgaaggaagttgggagtattatctggtcaactggagtttagttattaggttgtaaatgactatggtaggtacagatgtcatgaatatactagggtctcagggtctgaaagagttaaagctcctctcagaatagcccaggcagttcccaggaagtagcttcttaggcaggatgtggcaaaccagtgggtaaatgagagcccttctcctttggaagaa

SEQ ID NO: 70702 - DNA, 601 bp, Human
atttatccattttaaaacacattcccacccattctctgtccaggtgctcataacagtccccttgtgatacaggacaagagtgtgcttccatttaaggcaggagagagatcttgcccatggttagatgaccagttaccagcagagttaatagagggctccagaccctctgacttcaagttcagggttgtttccacaattttggtcctttttgttaagaatatagtttatacattggagacaaattattgatggaggctgcaattttgcaaataaaaataaccctcaaaaatccagtaatgtrtatgtgaaatgaaataggtgaactgaatttggtgagctttagtgtcgctgtaaaagcaactatcctttgtaaacttactgcatagctaataatgtaaatcagtgttgtgtttaggaatcagctccaggactgtggtttgatatgtggaaacacctctgcgtttgctgtgggctggtagacagaatgggctggacctggctgtactgtgaaaggcttctttgagctggttctttgaccaggtaatgaaaacgttaagcatctaaaaacgaagtctttaggaggcttccaaggatctggaaa

SEQ ID NO: 70703 - DNA, 601 bp, Human
ttttacacttacccagataatctactctgcctgagcacataattggtaatttggcccaaagactgcatacttagattgcatcctggtcacactgatatcttacatgcattttagatatttaaatattaaaacaaatattcttatggcaatttttgtttgttttgagatggggtcttgccgtattgcccaggctggagggcagtggctattcacaggtgcagtcatagtgcactgcagcctgaaactcctggcttcaagccatccttacatctcagcctcctgagtagctgggactacaggygcatgccactgtgcctggcccttgtggaaattttatttatttatttattttattattttattattattattattttttgacacagtctctctctgtcgccctggctggagtacagtggcgtgatctcggctcactgcaacctccacctcccaggttcaagcaattctcgtgcctcagcctctaaagtagctgggactacaggtgctcgccaccacgcccagctaatttttgtatttttagtagagacagggtttcaccatgttggccaggctggcctcgaactcctgacctcaggtgatc

SEQ ID NO: 70704 - DNA, 601 bp, Human
tattttattattattattattttttgacacagtctctctctgtcgccctggctggagtacagtggcgtgatctcggctcactgcaacctccacctcccaggttcaagcaattctcgtgcctcagcctctaaagtagctgggactacaggtgctcgccaccacgcccagctaatttttgtatttttagtagagacagggtttcaccatgttggccaggctggcctcgaactcctgacctcaggtgatccacctgcctcggcctcccaaagtgctgggattacaggcatgagccaccacgctyggccccttgtgtcaatttttagaagctaggatgtcaggctgctctttactgaaccctaaatatcctgaagcattctgggctggtgtctaggaccatcttgatcctaagggaataagcttgactcttctcctcttggtgcttcagcactgcattttcctcagtgggattggaacaagcattaaagcaaaacaaaaagttgtaaatgagacttagggcaactaacctgctctagccagaatgaaaaatttgttgacgtttaaagttctctgacctccctgtgtctacctgttcataatacta

SEQ ID NO: 70705 - DNA, 601 bp, Human
tggctggagtacagtggcgtgatctcggctcactgcaacctccacctcccaggttcaagcaattctcgtgcctcagcctctaaagtagctgggactacaggtgctcgccaccacgcccagctaatttttgtatttttagtagagacagggtttcaccatgttggccaggctggcctcgaactcctgacctcaggtgatccacctgcctcggcctcccaaagtgctgggattacaggcatgagccaccacgcttggccccttgtgtcaatttttagaagctaggatgtcaggctgctctttrctgaaccctaaatatcctgaagcattctgggctggtgtctaggaccatcttgatcctaagggaataagcttgactcttctcctcttggtgcttcagcactgcattttcctcagtgggattggaacaagcattaaagcaaaacaaaaagttgtaaatgagacttagggcaactaacctgctctagccagaatgaaaaatttgttgacgtttaaagttctctgacctccctgtgtctacctgttcataatactaaaacaaattatgaacttaagtaataagaaaaaagattatggcagattt

SEQ ID NO: 70706 - DNA, 601 bp, Human
ctccacctcccaggttcaagcaattctcgtgcctcagcctctaaagtagctgggactacaggtgctcgccaccacgcccagctaatttttgtatttttagtagagacagggtttcaccatgttggccaggctggcctcgaactcctgacctcaggtgatccacctgcctcggcctcccaaagtgctgggattacaggcatgagccaccacgcttggccccttgtgtcaatttttagaagctaggatgtcaggctgctctttactgaaccctaaatatcctgaagcattctgggctggtgtstaggaccatcttgatcctaagggaataagcttgactcttctcctcttggtgcttcagcactgcattttcctcagtgggattggaacaagcattaaagcaaaacaaaaagttgtaaatgagacttagggcaactaacctgctctagccagaatgaaaaatttgttgacgtttaaagttctctgacctccctgtgtctacctgttcataatactaaaacaaattatgaacttaagtaataagaaaaaagattatggcagatttcacacagctaaaataattacaagaattcagcaaccacaa

SEQ ID NO: 70707 - DNA, 601 bp, Human
agcactgcattttcctcagtgggattggaacaagcattaaagcaaaacaaaaagttgtaaatgagacttagggcaactaacctgctctagccagaatgaaaaatttgttgacgtttaaagttctctgacctccctgtgtctacctgttcataatactaaaacaaattatgaacttaagtaataagaaaaaagattatggcagatttcacacagctaaaataattacaagaattcagcaaccacaaaaatatttctcactgcaaattctcatccatttctgtattgtaggcattttttttttcttttggttttagtgtttattgtatacctcacactgggttagactcaagtttgggggatacttccagcttaattgagggtatgagcatgtaattgcaaggcattgtgacacatgctctaactctggtgtgtgatacagcacaggctatgggaactcaaagggtgagtgactaacgctgtcttgaggagtgaaggactgtatccccaaagcagggatctgggcctgtcttggggtttttgggtcttctgttttgttcttatttttttcttcttcttctttttttttttttttttttcctgt

SEQ ID NO: 70708 - DNA, 601 bp, Human
tatcctttcctatgtttggcttacattgtgatacacacccccctacaatcccccccaaacacacacacccacccacacacccacctttcagactgccttgtgaggacagggatcttgttgtcttcatagcctagcctctagtatacatagtgcttgtcatggagtagacgcttcatagtaaatctgcattgtattttcacagctgtaggcataaatggatgtaacccagagattcactcaagttacctatcccatgcccttttctagattggagcactccccgaggtttagattctcatcrtcagttctgctgtgggactcacatttccctttctatgttttttctctttttgctctgttcttgaactagcttggaatttggctccttttccttggtttccactataacaacagtgagaacaaagtatacacaaagctatttgtgtgcacagcagattggacttggaaggtttggggtggggagggtatattatattacagcaatacaggtaacttaaaatctaatggtgttaggtgtctttggtcttaaatgacctttgctaccctgccatggtacctcctttccttctgctcttgctgc

SEQ ID NO: 70709 - DNA, 601 bp, Human
cagtcctgatcctgaaatcaggattccctgaaggttgttggaaagtgatctgggggtagggttttttcccagaggtgatacgtgctcagggatgagatttgctgaccctcctgtgtgtatttgggcagggagaagggtccagctgtaacaaacagctgttcttgtatataagggggaagcaagtctggagaattgacaatttctcctgtggactagaattggagacatattttgagtgctgtgtttcatctgactgtatcttcctgcccttgggtgtgcttctgggcactggctactgacsttttgccttggggacccgaccgtacttatggttctgttaaagttggagggtgtccaggttcttggcatcttcaacaaagaattggacaaaatgcacaaagcaaggaagggacgaagggatttattgaaaatgaaagtaccctccacaatgtgggagcggtcccaagcataggagctcaaaaggccccgttgcagagttttggggaatttaaataccccctagaggattccatttgttattttgggtacgctgtatgtaaatggagaggttgaagtaaagttacaaagtcatttgcggcct

SEQ ID NO: 70710 - DNA, 601 bp, Human
gaagagtgaattggccttatgttccctacctccagacccaattttcctgcctcagttctgagttatgaggtttaactgattgggtcacattggatcctgtaccttctccctcattgaagagcaaactgcattcctgattgatagaccagcatgggccattattatacagggattttctaaaaagctctttttctttttttaaatttatttaaactattttttcctcattatgactggaaggataaaagatatttttctatatcagcttctcaagaacagggaatgggtaatgtccagtacrtcatctttctaaggccatagccagcttgtcttttcagtaacagccagccccactgtttagtggtcaccaccagacccagggctccctttgtttttctgatgctgaccacattttttttttttttgagacggagtctcgctctgtcgcccaggctggagtgcagtggcgggatctcagctcactgcaagctccgcctcccgggttcacgccattctcctgcctcagcctcccgagcacccgccaccacgcctggctaattttttgtgtttttagtagagagagggtttcaatgtgttagcc

SEQ ID NO: 70711 - DNA, 601 bp, Human
tatctggctgggcgcggtggctcacacctgtaattctagcactttgggaggccgaggcggatggatcacctgaggtcagggattcaagaccagcctggccaacatggcaaaaccccgtctctactaaaaatacaaaaattagtcgggcgtggtggtgcatgcctgtaatcccagctactggggaggctgaggaaggagaattgcttgaacctgggaggtggaggttgcagtgagctgagattgtgccactgcactccagcctgtgtgacgggagcgagactccatctcaaaaaaaaaaaaatttcatatgcggctaatatgaaacacattttatatactgggacagaaggaaccataggctgtcacttgttttaagcaacaatatgacaccccctgtctgattcaggatgttattcaatatttgaggaaagtctttgtgagtgggtggtcctcatgactccagaggctcctctgtgtgtgtgtatgtgtgtgtttttcaacatgactgcagaaacatgttgtgggaaggtaatttatgtgatttcagaagactgtttgattcccagggggtgtttttgtttgtttgtttctttttaaagga

SEQ ID NO: 70712 - DNA, 601 bp, Human
agagatagggttttgccatgttgcccaggctggtctcaaactcctgagctcaagcgatccgctttggccttccaaagtgccaggattacaggtttgagccaccttgcctggcctggcttataatcttttttttttttccttaagtgctaactgcgagttaatggtttataatattcctaatcctaattctataccattgtcgctgggtgcagtggttcacgcctgtaatctcagcactttgggaggccgaggtgggcagatcacttgaggtcaggaattggggacgagcctagccaacatkgtgaaatcctgtctctactaaaaaaaatacaaaaattagcctggcatagtggggcctgtaatcccagctacttgggaggctgaggtgggaggaacacttgaaccaggaggtggaggttgcagtgagctgagatcgtatcactgcacttcagcttgggtgacagagtgactccatctcaaaaaaaaaaaaccaacaaaaaacagcaacaaaccaattctataccattgttcacagattagcccctactagaatgccctctttctctttttttttttttgctatctcattattttatatcat

SEQ ID NO: 70713 - DNA, 601 bp, Human
tggccttccaaagtgccaggattacaggtttgagccaccttgcctggcctggcttataatcttttttttttttccttaagtgctaactgcgagttaatggtttataatattcctaatcctaattctataccattgtcgctgggtgcagtggttcacgcctgtaatctcagcactttgggaggccgaggtgggcagatcacttgaggtcaggaattggggacgagcctagccaacatggtgaaatcctgtctctactaaaaaaaatacaaaaattagcctggcatagtggggcctgtaatcscagctacttgggaggctgaggtgggaggaacacttgaaccaggaggtggaggttgcagtgagctgagatcgtatcactgcacttcagcttgggtgacagagtgactccatctcaaaaaaaaaaaaccaacaaaaaacagcaacaaaccaattctataccattgttcacagattagcccctactagaatgccctctttctctttttttttttttgctatctcattattttatatcattctagaccagtttgagcctcatatccccacaaaacttactctagcatatcctcaactacacagc

SEQ ID NO: 70714 - DNA, 601 bp, Human
tgaggtcaggaattggggacgagcctagccaacatggtgaaatcctgtctctactaaaaaaaatacaaaaattagcctggcatagtggggcctgtaatcccagctacttgggaggctgaggtgggaggaacacttgaaccaggaggtggaggttgcagtgagctgagatcgtatcactgcacttcagcttgggtgacagagtgactccatctcaaaaaaaaaaaaccaacaaaaaacagcaacaaaccaattctataccattgttcacagattagcccctactagaatgccctctttctctttttttttttttgctatctcattattttatatcattctagaccagtttgagcctcatatccccacaaaacttactctagcatatcctcaactacacagctgcctgtgttctaggccctttgtgagaattaggcgaactgtggtacagtcattgccccagaatcacttttgaagttggtggtgaaaccataaaagcaataaaggtaattaactacattgtgcattttccccagattatttattgcatgaacaacatgaaaacgtggggattaaatcaccttctaccctgccacagcaactg

SEQ ID NO: 70715 - DNA, 601 bp, Human
agtgagctgagatcgtatcactgcacttcagcttgggtgacagagtgactccatctcaaaaaaaaaaaaccaacaaaaaacagcaacaaaccaattctataccattgttcacagattagcccctactagaatgccctctttctctttttttttttttgctatctcattattttatatcattctagaccagtttgagcctcatatccccacaaaacttactctagcatatcctcaactacacagctgcctgtgttctaggccctttgtgagaattaggcgaactgtggtacagtcattgccscagaatcacttttgaagttggtggtgaaaccataaaagcaataaaggtaattaactacattgtgcattttccccagattatttattgcatgaacaacatgaaaacgtggggattaaatcaccttctaccctgccacagcaactgatttcatttatctatgtttctttgcagtgcttgttcgtatacattcatttttcccccataggtaatacaatataattcatttgcacctgagagtgtttgtcaaaatttctgatacctataagtgtgtgtgactttggataagtcacttctcctgag

SEQ ID NO: 70716 - DNA, 601 bp, Human
cattttccccagattatttattgcatgaacaacatgaaaacgtggggattaaatcaccttctaccctgccacagcaactgatttcatttatctatgtttctttgcagtgcttgttcgtatacattcatttttcccccataggtaatacaatataattcatttgcacctgagagtgtttgtcaaaatttctgatacctataagtgtgtgtgactttggataagtcacttctcctgagacccagtttctccgtctaaaccaggggtttagactacatgtcctgtaaggcaataatcatgaaartatcttctgttgtggagtatttcacagttgcttgaacatttgtattgttattctttaccataactacatgggattgagtggaatatgatattccttttttacggattgggaaactgaaactgaggtagccaaagaaaacactcttaggtgaaaatgaattatattgtagtacctatgacgggaaaaaaatgaacgtatatgaacaagcactggaaggaaacatagataaatgactttaaggttgactttttatctctggtttttagcagtttgactatgatgtgtctaggtgtgggattt

SEQ ID NO: 70717 - DNA, 601 bp, Human
tgatttcttttattctttttttttgctttagtttggttaatttcttttttgtttttttgtttttttgagacaagctggtcccaaagtctgggcctcaagtggtcaagctggtctcaaactctgggcctcaagtggtcctcctgccttggcctcccaaaatattggtattacaagcatgagccaccgtgcccagcctccatttaaaaagttctgtcgacctatcttcagggtcactgattgttccctcagctccatgtaatcggctaatgagcctgttgacctctgatgccacgtttttaamatttctagcattttaatttgattctatttttagttttcacctttgctgaaattcctcatttgttcatacatgttgtcccctttaacatattaatcatagttattttaaggcctctgtctgatagttccaacatctgggtcatctgagtctggttctgtttatagcttatctcttgataaggttgttcccccccatcccacctcccaacccttcttgatttttgtgtttttctttccttttttttttttttgaaacagagtctcactcttttcacccaggctagagtacagtggtgcaatc

SEQ ID NO: 70718 - DNA, 601 bp, Human
ttccttttttttttttttgaaacagagtctcactcttttcacccaggctagagtacagtggtgcaatcttggttcactgcaacctccctcccggtattaagcaattcttctgccttagcctcctgagtagctgggattacaggtgcctgccaccatgccaggctaatttttttttttttttttttttgagatggagtttcactcttgttgaccaggctggagtgcaatggcgcaatctcggctcacggcaacctctgcctcccaggttcaagtgtttcttctgcctcagcctcccgagtarctgggattacaggcatgccaccaccatgcccggctaattttgtatttttagtagagatggggtttcaccatgttggtcaggctggtctcaaactcccaacctcaggtgatctgcccaccttgacctcccaaagtgctgggattacaggtgtgagccactgtgccccacccatgcctggctgattgttttatttttagcagagatggggtttcaccatgttagccaggctggtctggaactcctgacctcaggtgatccacctgccttggcctcccaaagtgctgagattatggatgtgag

SEQ ID NO: 70719 - DNA, 601 bp, Human
gggaatcctaaagtaaggtgcaacaattaagagacaacactttggctaacaatcttggatccacatttcagtcagggccttccacatagaggggaaagacttttctctcagaagttagaatctttcttcctcctttcttgttaaactgagagcagtgttttgtttgctcaatattacatgtacaaaaggagattagaagaaaatgcatcacaaaaccatcttgaacgttcagctcttcctgccaatacatcacaactcttaggttttagacggggcctgggaatacgtaagtgttttttctttttttttttttttaagtgaaagcaagtttattacgaaagcaaagggataaaagaatggctgctccataggcagagagcagcccagtaatcttaaaataggaaaatagacactatggctacaaaaaataaaaaataaatgaggtagataaaattttcacacccaggacttgcctgttccaacttcatagccttcatgaaatattcatcaagaagacaaaaaaaaaaaaaaaacctttataattacttggcataagtcgcaacaagaaaattcaacaaaaaaattagcatgtatacctgtg

SEQ ID NO: 70720 - DNA, 601 bp, Human
ctaaagtaaggtgcaacaattaagagacaacactttggctaacaatcttggatccacatttcagtcagggccttccacatagaggggaaagacttttctctcagaagttagaatctttcttcctcctttcttgttaaactgagagcagtgttttgtttgctcaatattacatgtacaaaaggagattagaagaaaatgcatcacaaaaccatcttgaacgttcagctcttcctgccaatacatcacaactcttaggttttagacggggcctgggaatacgtaagtgttttttctttttttwtttttttaagtgaaagcaagtttattacgaaagcaaagggataaaagaatggctgctccataggcagagagcagcccagtaatcttaaaataggaaaatagacactatggctacaaaaaataaaaaataaatgaggtagataaaattttcacacccaggacttgcctgttccaacttcatagccttcatgaaatattcatcaagaagacaaaaaaaaaaaaaaaacctttataattacttggcataagtcgcaacaagaaaattcaacaaaaaaattagcatgtatacctgtgataggaa

SEQ ID NO: 70721 - DNA, 601 bp, Human
atcttgaacgttcagctcttcctgccaatacatcacaactcttaggttttagacggggcctgggaatacgtaagtgttttttctttttttttttttttaagtgaaagcaagtttattacgaaagcaaagggataaaagaatggctgctccataggcagagagcagcccagtaatcttaaaataggaaaatagacactatggctacaaaaaataaaaaataaatgaggtagataaaattttcacacccaggacttgcctgttccaacttcatagccttcatgaaatattcatcaagaagacaaaaaaaaaaaaaaaacctttataattacttggcataagtcgcaacaagaaaattcaacaaaaaaattagcatgtatacctgtgataggaaacacatccttccatgagtttcttctcaagaatgaaaacctagttcttcagtagagtaggcactggcaaactaagtcacctgagatttcctgctcaggtgccctcttcttctggggttcaggaagaggaaggcatctaagaagtgtgggaaaggacattggcactctcagggcagagctggtctttcacattgtggtgaaactactagaaa

SEQ ID NO: 70722 - DNA, 601 bp, Human
aagtcgcaacaagaaaattcaacaaaaaaattagcatgtatacctgtgataggaaacacatccttccatgagtttcttctcaagaatgaaaacctagttcttcagtagagtaggcactggcaaactaagtcacctgagatttcctgctcaggtgccctcttcttctggggttcaggaagaggaaggcatctaagaagtgtgggaaaggacattggcactctcagggcagagctggtctttcacattgtggtgaaactactagaaagaagaaaaacatgcttgtggctactctgtgcctgcraaataggtgtgaagcctttaggagtcagaagacctgggttcaactctaatagtcacttactctgtgaacttgtgcaagtcacttctctgtagtttttcttacagttaaaactttaaagttttgtccagtgctaaaattctctaatcctaacatatccttctgtagtgttacaaggatagaactctccaggtaaataccaaggctgtgcttttctgcaagcatagtggttagcttctcgtgttatatggtttgaagccctagttgttacttcttgcctgcatataaaccccattgacgatg

SEQ ID NO: 70723 - DNA, 601 bp, Human
ctttcacattgtggtgaaactactagaaagaagaaaaacatgcttgtggctactctgtgcctgcgaaataggtgtgaagcctttaggagtcagaagacctgggttcaactctaatagtcacttactctgtgaacttgtgcaagtcacttctctgtagtttttcttacagttaaaactttaaagttttgtccagtgctaaaattctctaatcctaacatatccttctgtagtgttacaaggatagaactctccaggtaaataccaaggctgtgcttttctgcaagcatagtggttagcttcycgtgttatatggtttgaagccctagttgttacttcttgcctgcatataaaccccattgacgatgatctcattttgtttttcctttgagaataaattgattgttttgtcttcccaggtctttgagaatgcgtaagttccggcactagaaggccctcagtaaagtaactaaaggagtatatacagctaagggcaatttaagtcaaaatgtgataataagtaaaaagtggttgtagaaattaaatgagagtgaaatatttttttaaaagttggaatcatctaaatgctaaatgcatatttaat

SEQ ID NO: 70724 - DNA, 601 bp, Human
ctgactcccaggttcgggtcagggtacatttttatgtatcataaaagcatagttgatgaattctcagaaaccgaacacaccatataaccagccctcagatcaagaacagggcattactagcacccaggaattcccctccttccctatattagggttcaccagagaaacagaaccaacagcagttgtgcgtgtgtgtgtgtgtgtgtgtgtgtgtgtgtgtgtgtgtgtgtgtgtgtgtatgagagggttattgatgtttattttagggaattggctcatgtgattatggaggtctggtaakcctaaaatctgcagggataagccagcaagctgaagacccagggtagggttgcatgcggttcaagtccagaggcaggctaccagcagaattccttcttttgggcaggtcagtctttgttctcttaaggttttcaactgattggctgaggcccattcacattatggagagtaattcactttaagtttaccaatttaaatgttaatctcatccaaaaaacccccacaaaaaccaaaaacattttcacagaaacaccatggcccagccaagttgacacgtaaaattaaccatcacacaccccct

SEQ ID NO: 70725 - DNA, 601 bp, Human
cttccccaagatgttgactggggctgtcccttgccactgggtctgcactgcggcgccccccccccgcccccccccaacacagatgggctagcctggggtggaatctggaagttggtaagctgtgcttttggcactctctgccttcctctttcaggtccattctcctttcctgtcttactactccttatacgcctaactctcaatcctcagccatccatggtttgactgttcagagacccatggtgccagttctttttgttctcatattgccccctgtccattgaagctcctcagcccctcracttgaacacgcccccgttcttattctgtacctcctcagattactgtcacattgacggacttgaacctcagagatagacaacttttcccttccctcctctcctccttcccatatacttttcttatggatatggaactgaggaccagaaaggaaggtaacttacccaagatctcacagatgggtaaataggggtagaaggtgtggatcaagggattgtatgcagcctttatctctaggtgctggtctctcttaccttgggtctgtctcttttgcctctcctttcctctttccctgctactt

SEQ ID NO: 70726 - DNA, 601 bp, Human
ctggggtggaatctggaagttggtaagctgtgcttttggcactctctgccttcctctttcaggtccattctcctttcctgtcttactactccttatacgcctaactctcaatcctcagccatccatggtttgactgttcagagacccatggtgccagttctttttgttctcatattgccccctgtccattgaagctcctcagcccctcaacttgaacacgcccccgttcttattctgtacctcctcagattactgtcacattgacggacttgaacctcagagatagacaacttttcccttycctcctctcctccttcccatatacttttcttatggatatggaactgaggaccagaaaggaaggtaacttacccaagatctcacagatgggtaaataggggtagaaggtgtggatcaagggattgtatgcagcctttatctctaggtgctggtctctcttaccttgggtctgtctcttttgcctctcctttcctctttccctgctacttgacttgtttcctaccctggtagcattcctgcttgccagatgccacaggggaaggagaactttacaactccctgggctctctggtaagaacac

SEQ ID NO: 70727 - DNA, 601 bp, Human
ttcttattctgtacctcctcagattactgtcacattgacggacttgaacctcagagatagacaacttttcccttccctcctctcctccttcccatatacttttcttatggatatggaactgaggaccagaaaggaaggtaacttacccaagatctcacagatgggtaaataggggtagaaggtgtggatcaagggattgtatgcagcctttatctctaggtgctggtctctcttaccttgggtctgtctcttttgcctctcctttcctctttccctgctacttgacttgtttcctaccctrgtagcattcctgcttgccagatgccacaggggaaggagaactttacaactccctgggctctctggtaagaacacccacctgcacggggacccttcctctccttcctacagtgattggttgtcatcctcttcccttcctgcagtgtaccctcctggcagaggcaaggctgccatcgaggctagagcaaggctcagattgggtggcatgcagttgtggcctatttctgtttgctgtgtggcagtttggagatcccatttctttttctggatatcacccccctacctcctcctgtcattcctt

SEQ ID NO: 70728 - DNA, 601 bp, Human
gcaaggctcagattgggtggcatgcagttgtggcctatttctgtttgctgtgtggcagtttggagatcccatttctttttctggatatcacccccctacctcctcctgtcattccttaggccagcctctaaattcagtgaccatcagggttgaaaagggcagtgtggggcctagaaaggagctctctcctaggagttaggagacctgccagcagtgaactgtgtgaacttgtccctttgggcctcagttttctcatctgtaaaatgagaattggataagttggtcttcaaggtccctcccygagatacattttatgctgctgcttgatttaaaccactgagccacaaatgaaaggttccagttgcaacagtgtaattaggcttagcagatgggtgagatgaaaggaaggacatgttcttgcccataggattatcctttcccacccatttccttgcacctcactggtgtttccaaaaagcaaatgacaacccttgtttttctctgcattcccattcaaacctttaatcttcttttatcttgatgaacttgtatttaccgttagacagccatgatgcagaattcacattacagtgtgtggttc

SEQ ID NO: 70729 - DNA, 601 bp, Human
tgtgaacttgtccctttgggcctcagttttctcatctgtaaaatgagaattggataagttggtcttcaaggtccctccctgagatacattttatgctgctgcttgatttaaaccactgagccacaaatgaaaggttccagttgcaacagtgtaattaggcttagcagatgggtgagatgaaaggaaggacatgttcttgcccataggattatcctttcccacccatttccttgcacctcactggtgtttccaaaaagcaaatgacaacccttgtttttctctgcattcccattcaaacctwtaatcttcttttatcttgatgaacttgtatttaccgttagacagccatgatgcagaattcacattacagtgtgtggttctaactctgccatggtgaatgtgatggaggttggagccgatcacagctggtccctggagagagggctgtgtgtgtcagatttattgtgctgcagctccagttttgttttggtttagtttttaaatccccagtgtcagttttgctgatttcagttaaaactaaagattgtgaagggagacagagacaggttcatgccctctgagttttagagattggtgatat

SEQ ID NO: 70730 - DNA, 601 bp, Human
gtgtagaaatgtgtcaaaaatttcttgcttcttccattagtttctattttgacccaccccagtgaatgaaataagcatagaattgttacttctattttacagaagagaaattcttatttttttgttgtttttatttttaagttcaggggcacatgtgcaggatgtgcagatttgttaacataggtggacctgtgccatggtagttttctgcacagatcatcccatcacctaggttttaaggccagcatctattagctattcttcctgatgctctctctcctcccccactgacaggccccaktgtgtgttgttcccgcccctgtgcccctgtgttctcaccattcagttcccacttactagtgagaacatgcggtatttggttttgtatacctgcgttagtttgctgagaataatgacctccagctccacccatgttcccgcaaaggacgtgatctcgttcctttttatgtctgcatagtattccatgatatatagaggagaaatctgaaatgtggcaaggttaagtgacttgtccatggtcacacagctggttgatgaacaatttgtgataagaatccaggactcttgaatactagtgatt

SEQ ID NO: 70731 - DNA, 601 bp, Human
ctgagaataatgacctccagctccacccatgttcccgcaaaggacgtgatctcgttcctttttatgtctgcatagtattccatgatatatagaggagaaatctgaaatgtggcaaggttaagtgacttgtccatggtcacacagctggttgatgaacaatttgtgataagaatccaggactcttgaatactagtgatttgtcaacacgattccatctccagtcctcatccatacacacctgccattaggaaagtctttgccaccccagcctatagtctttgtcatttctctcactggccarcttctgaaagtacaggtcagaagccagttcattagctggtagggtgggtggttaaacggcaaggcataggaggtagaggagggagaaaggaagcacaaagctcaggcttagtttttcctccagaaggtgtaagaattacttatttcaaagagtcagaaaagtgaacagagtcagcattcccttttcctttgcaaattgattgaatttctatggcgagtattagctgcaaggcagtgttaatctgctccagcagatccatcatcagattgatgtgcaggggagacaggattgtctctggtg

SEQ ID NO: 70732 - DNA, 601 bp, Human
agcagggtgccagcatggttgggttttggcaagagccctcttcctggcttgcagatagctgccttcctactgtgtgcttgcatggcctttctttgatgtgtgcagcaggtggggtggggggaaaatcagtgaggaaaatcagtaacctcggccttgcatcttctttggtcccatgcatgatgttatttgtaaggcagtgtcagatctcctcatacatggagaggcattaagtcttcatttccctgtcttctagaggtttgggatagagggtgtgaaggaagagcagattatgcttactctrtcttttaagctcagaactggggtgtgtgtgttggcaggaacaccaacatgatgatgtataatgaaggcctatcttgtcacctgtgtcacttcagccaccccacacaattgtcactgacatgcttcacctcccgggacttcaatttgaaacccaatgaaatccagtgaaacacagtggaaactcttaccaccttcctgttaaccaactcacaggagtgatgaacacttttcagttccctggatgaaacactcttgagcaatgcccacagcatgctgaatgcactgcaggcaggctgctctc

SEQ ID NO: 70733 - DNA, 601 bp, Human
cagcatggttgggttttggcaagagccctcttcctggcttgcagatagctgccttcctactgtgtgcttgcatggcctttctttgatgtgtgcagcaggtggggtggggggaaaatcagtgaggaaaatcagtaacctcggccttgcatcttctttggtcccatgcatgatgttatttgtaaggcagtgtcagatctcctcatacatggagaggcattaagtcttcatttccctgtcttctagaggtttgggatagagggtgtgaaggaagagcagattatgcttactctatcttttaagstcagaactggggtgtgtgtgttggcaggaacaccaacatgatgatgtataatgaaggcctatcttgtcacctgtgtcacttcagccaccccacacaattgtcactgacatgcttcacctcccgggacttcaatttgaaacccaatgaaatccagtgaaacacagtggaaactcttaccaccttcctgttaaccaactcacaggagtgatgaacacttttcagttccctggatgaaacactcttgagcaatgcccacagcatgctgaatgcactgcaggcaggctgctctctgccataccc

SEQ ID NO: 70734 - DNA, 601 bp, Human
tttgatgtgtgcagcaggtggggtggggggaaaatcagtgaggaaaatcagtaacctcggccttgcatcttctttggtcccatgcatgatgttatttgtaaggcagtgtcagatctcctcatacatggagaggcattaagtcttcatttccctgtcttctagaggtttgggatagagggtgtgaaggaagagcagattatgcttactctatcttttaagctcagaactggggtgtgtgtgttggcaggaacaccaacatgatgatgtataatgaaggcctatcttgtcacctgtgtcactycagccaccccacacaattgtcactgacatgcttcacctcccgggacttcaatttgaaacccaatgaaatccagtgaaacacagtggaaactcttaccaccttcctgttaaccaactcacaggagtgatgaacacttttcagttccctggatgaaacactcttgagcaatgcccacagcatgctgaatgcactgcaggcaggctgctctctgccatacccactcgcttcagcacccactggctgaattatgtgcttaccaagagccagcttgttcccaaacccatttgttcagctgtagct

SEQ ID NO: 70735 - DNA, 601 bp, Human
gattactctgcaagtaatcacaatataactttaaccagctttaacaaatcaggaataggaaattgtcgacaatgtattatgttctggtccatgtgcgaaggatgatgtggacctcttaaccagtgggtcctctttggacccttattcaaagagtcttgccctatgttaaagaatgggcgaatgaatgcagatttatatacattgagtaaaaataagaattttagatatgtaatttttatgattttttgctgtgacttttttgattaacctggttcctggacctgattacattgaaaatgargatttctactgttgtgattcagtttaaagttggtttgatttcattttagtgaatttagggtattttattttgcgtatggtaaaaacaataaaaccaacagtagtggggctttttaaactggggttttaaagcaaattaaggtggctcattctggattttagtaggttcttttgttcctctcattgacttgcagcatactgagtgagaaagacctaattttttcactttataaatgaggaaattgaagccctgagaggtaaagcatgttggtgatagtcatcccgggtggctggagtgaag

SEQ ID NO: 70736 - DNA, 601 bp, Human
cttagactttggcttagtctcaaccacatcaggctcctgagctcaaggaagaatcttttgggcagcctaggttagcatacctgagttcctcatacccttctactttcacaactcttgagtgtgaaccaagtcctcaaggtcaatttcttttcatatctgagctccaaagcctctcttggagtaagccctcccttaactttgttcctgtctaggctcccaggagccgaggcacagctggaacagcctccagtgccaatgcctgccttagtacaatgacactcatttcttggttgagcagaamcttgtttgtaacaacttaacctgtttctcctccctctaccttaaagagcttaaacatttaacaagactatatctttcatcccttcctccctctttctttcataaaacctctctttcttccacctttctccagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggtatgtgacaccctctcagcc

SEQ ID NO: 70737 - DNA, 601 bp, Human
ggtgcaaggctctggagttaaaaagatgacataatctactgtaagggcagcctgaagggtttctctgggtttctgtatgatgcacgttagtggaaggagagggcaatggagagagagggcattcatgggctaattaatcatatgcatgttagctgccaatcattttaccactatgttcttggagtccctccttttcttcagatataagtcttccaacacactgtgcaacttagggaattctgcaagtattagtctttgctttattctccctgggctgatggcttagagatgagggctgacrtgagtctgcacacttggtggctgttgtgctttcagtccagtattgtgtctctcagctcctaccccattttattcctgatacttgagacctgccctgacctttagaatagggatcctggtgtgcagccttaatgaactttagaagaaccctcctgggaggattctctacttgtgcctccattattttgaacctctcttcattgtaatgatcacgaagtgctgcatccactgttataggcatctgctgacatttgtgggtgccatatggaacctaaatcctaaaaacgtcttctgcacatct

SEQ ID NO: 70738 - DNA, 601 bp, Human
cctgaagggtttctctgggtttctgtatgatgcacgttagtggaaggagagggcaatggagagagagggcattcatgggctaattaatcatatgcatgttagctgccaatcattttaccactatgttcttggagtccctccttttcttcagatataagtcttccaacacactgtgcaacttagggaattctgcaagtattagtctttgctttattctccctgggctgatggcttagagatgagggctgacgtgagtctgcacacttggtggctgttgtgctttcagtccagtattgtgtcyctcagctcctaccccattttattcctgatacttgagacctgccctgacctttagaatagggatcctggtgtgcagccttaatgaactttagaagaaccctcctgggaggattctctacttgtgcctccattattttgaacctctcttcattgtaatgatcacgaagtgctgcatccactgttataggcatctgctgacatttgtgggtgccatatggaacctaaatcctaaaaacgtcttctgcacatctaaaggttagagaaagtgcttgttccttctttcctcaatgagagcagagca

SEQ ID NO: 70739 - DNA, 601 bp, Human
gaattctgcaagtattagtctttgctttattctccctgggctgatggcttagagatgagggctgacgtgagtctgcacacttggtggctgttgtgctttcagtccagtattgtgtctctcagctcctaccccattttattcctgatacttgagacctgccctgacctttagaatagggatcctggtgtgcagccttaatgaactttagaagaaccctcctgggaggattctctacttgtgcctccattattttgaacctctcttcattgtaatgatcacgaagtgctgcatccactgttayaggcatctgctgacatttgtgggtgccatatggaacctaaatcctaaaaacgtcttctgcacatctaaaggttagagaaagtgcttgttccttctttcctcaatgagagcagagcattctctgtgggaagcatatgaacatttctggcttggtcctagtgcttggcctggggtgctgattattttctgcttgggtcttggcttcccctcagggagctgtttcttatcccttgggtctcttgtgttcttttttttttttttttaatttatttttattttttagggtgatgaagggtttttt

SEQ ID NO: 70740 - DNA, 601 bp, Human
gaagggtttttttcccctttctttttttttctttttgtttttttagacagagtctcgccctgtcacccaggctggagtgcagtggcgcgatgtcggctcactgcaacctccacctcccaggttcaagtgattcccctgcctcagcttccagagtagctgggattacaggtgcgcaccaccacgccccgctaatttttttctatcattactagagatggggtttcaccatgttggccaggctggtctcgaactcctgacctcatgatctgcccgcctcggcctcccaaagtgctgggattayaggcatgagccaccgtgcccaaccaatctttttatttttcttacattgacctcttttgagatactaggaggcttcttcatttacattgaccttttttgagatgctaggtggcatccttattctggaattctttattcactttgaacttacagatgttgatcacatctcttgtgcccttgccatgtcctccccttccttcaagccttcctcctccttcaggagaaaatgacactggaaatgactggagttggtttcccattctcttagcccatttccagtgactgcaggtcagtttttccc

SEQ ID NO: 70741 - DNA, 601 bp, Human
caggtcagtttttccccccatggatttggctctctggaaatagtgagatgttcctgcacaagtctctggagttatcgtggagagcatgagactgggaggggaaaatgtttcaagggccaagcacagtgtctggcacctgttaggtggtatgtgttgagtgactgaatgagagtggccaggatggggaagacctggtcaggcttgggactcgatgggggagggttaggccttggagcctgccataggaccttttggccctgggtgtacatagacccagagggcagctagaatagtcagtcastggtagtgaagaggctcaggtgctgccggagcgtctagatgggaccatgtaggaagcagctgtggcctgaagaccaggcagccatgagagccagagtggctttctgcttcagctctgggcactctcagcccttccttattcctgagcaggtcctgttgcaggaaaggccctgccctggcttcctctggatggaaaattctgactgtgggctgctgcttcccttggaccttctgctttgcctcagcttcagtttttcaaaggtgttgtcaggtagagagacctctgttcgatagccacatc

SEQ ID NO: 70742 - DNA, 601 bp, Human
aaaggacattgcaaaggatacagatgaagagacacataggacaaggtatgggagtggggtacgaagcttccatgccttccctgggcgcaccaccctccaggaacctccatgtgttcagctgtcctgaagttctctgaacgcagccttctggggtttttttgtgtgtgtattttttttttttttttttttttttgagacagagtctcgctgtgtcgcccaggctgagtgcagtggtgtgatctcggctcactgcaagctccgcctcccaggttcatgccattctcctgcctcagccacagcygaaagttatcacttgaaagaatagttagaacattgtcactaactggtctggtattctcgatcttaggatggaggttctctggatcaagtcctgaagaaagctggaagaattcctgaacaaattttaggaaaagttagcattgctgtgagtatgttatgaagtttttcttctaagttcctcattgataagttaatgagtcggtaagaaatggacaagagaggaagatgggaagtcaatgaggggaaagtttataagaaaagtggtattttctcactagactcttccctgtctggagtctat

SEQ ID NO: 70743 - DNA, 601 bp, Human
gtcactaactggtctggtattctcgatcttaggatggaggttctctggatcaagtcctgaagaaagctggaagaattcctgaacaaattttaggaaaagttagcattgctgtgagtatgttatgaagtttttcttctaagttcctcattgataagttaatgagtcggtaagaaatggacaagagaggaagatgggaagtcaatgaggggaaagtttataagaaaagtggtattttctcactagactcttccctgtctggagtctatatacactattctctctcacattagaatgagaaaartgactttctttatattaaaatctgtgtgtcttgaaaaacaggggccaggcacagtggctcgcacctgtaatcccagcactttgcgaggccaaggcaggaggactgcttgagcccaggagttcaactccagcctgggcaacatgatgagacctcgcttctacaaaaaaataaaaataaatagctgggcgtggtggtgcacacgtgtagtcccagctacttgggaagctgaggtgggaagatcacttgagaggctgcagtaagccataatccatgattgtgccattgcactttagtctgggc

SEQ ID NO: 70744 - DNA, 601 bp, Human
gttcaactccagcctgggcaacatgatgagacctcgcttctacaaaaaaataaaaataaatagctgggcgtggtggtgcacacgtgtagtcccagctacttgggaagctgaggtgggaagatcacttgagaggctgcagtaagccataatccatgattgtgccattgcactttagtctgggcgacagagtgagaccctgtctcaaaacaaaacaactctttataccatgtaaaaagatggttgcttgataaggcaggttaagaaaatgaaacaaaagagtaaaaaataaggggctgggcgyggtggctcatgcttgtcatcccagcactttgggaggcggaggcgggcagatcacctgaggtcgggagttcgagaccagcctgaccaacatggagaaacccccatctctattaaaaatacaaaattagccgggggtgttggtgcatgcctgtaatcccagctactcgggaggctgaggcaagagaatcgcttgaacccgggagggggtggttgtggtgagctgagatcacggcactgcactccagcctgggcaacaagagcaaaactctgtctcagaaaaaaaaaaagcccaggcacggtg

SEQ ID NO: 70745 - DNA, 601 bp, Human
tggtggtgcacacgtgtagtcccagctacttgggaagctgaggtgggaagatcacttgagaggctgcagtaagccataatccatgattgtgccattgcactttagtctgggcgacagagtgagaccctgtctcaaaacaaaacaactctttataccatgtaaaaagatggttgcttgataaggcaggttaagaaaatgaaacaaaagagtaaaaaataaggggctgggcgcggtggctcatgcttgtcatcccagcactttgggaggcggaggcgggcagatcacctgaggtcgggagttygagaccagcctgaccaacatggagaaacccccatctctattaaaaatacaaaattagccgggggtgttggtgcatgcctgtaatcccagctactcgggaggctgaggcaagagaatcgcttgaacccgggagggggtggttgtggtgagctgagatcacggcactgcactccagcctgggcaacaagagcaaaactctgtctcagaaaaaaaaaaagcccaggcacggtggcttacacctgtaatcccagcactttgggaggccaaggtgggtggatcacctgaggtcaggagttcgaga

SEQ ID NO: 70746 - DNA, 601 bp, Human
tgtctcaaaacaaaacaactctttataccatgtaaaaagatggttgcttgataaggcaggttaagaaaatgaaacaaaagagtaaaaaataaggggctgggcgcggtggctcatgcttgtcatcccagcactttgggaggcggaggcgggcagatcacctgaggtcgggagttcgagaccagcctgaccaacatggagaaacccccatctctattaaaaatacaaaattagccgggggtgttggtgcatgcctgtaatcccagctactcgggaggctgaggcaagagaatcgcttgaaccygggagggggtggttgtggtgagctgagatcacggcactgcactccagcctgggcaacaagagcaaaactctgtctcagaaaaaaaaaaagcccaggcacggtggcttacacctgtaatcccagcactttgggaggccaaggtgggtggatcacctgaggtcaggagttcgagactagcccgacaaacatggagaaaccccatctctactaaaaatacaaaattagccgggggtggtagcgcatgcccgtaatcccagctactcagggggctgaggcaggagaatcacttgaacccgggag

SEQ ID NO: 70747 - DNA, 601 bp, Human
tggtgcatgcctgtaatcccagctactcgggaggctgaggcaagagaatcgcttgaacccgggagggggtggttgtggtgagctgagatcacggcactgcactccagcctgggcaacaagagcaaaactctgtctcagaaaaaaaaaaagcccaggcacggtggcttacacctgtaatcccagcactttgggaggccaaggtgggtggatcacctgaggtcaggagttcgagactagcccgacaaacatggagaaaccccatctctactaaaaatacaaaattagccgggggtggtagcgyatgcccgtaatcccagctactcagggggctgaggcaggagaatcacttgaacccgggaggtggaggttgtggtgagccgagatcgcgccattgcattccagcctgggcaacaagagtgaaactgcgtctcaaaggaggaaggcaaatttgtgatgatgataaatgaagtattttcctagagtattttaaaatagattgagtatttttcttatcaccagtattttcttttcttttacattccctttcctctaggtaataaaaggcctgacatatctgagggagaagcacaagatcatgcac

SEQ ID NO: 70748 - DNA, 601 bp, Human
ataaaagaaactgatttattgctgggtacagtggctcatgcctataatcccagcactttgggaggccgaggggcggcggggggaggtcgggggggtggatcatgaggtcaggagttcgaaaccagcctgacccaacatggtgaaacccccctctactaaaaatacaaaaattagccgccagccatggtggcgagcacctgtaatcccagctacttgggaggctgaggcaggagaattgcttgaacctgggaggcggaggctgtggtgagccgagattgcactgctgcactccagcctgggyggcacagcgagacacagtctcaaaacaacaacaacaagaagaacaaaacacattaaaaaaagaaagaaactgatttattttaataaaggtacacatacacttaaccatgtgaccataccatcttaggcatttgtccaagataaaatataacatgcatccacacaaatgtttaaagaagctgtatttcttgtagaaacaactgaaatgtccttcaacaggcaaagagagaaacaaattgtagtatatctatacaacagaatactcttcaacaataaaaatgaaaagactactgataacacc

SEQ ID NO: 70749 - DNA, 601 bp, Human
aaaaaaaatccttgaggggtacagcatcacttggattctgtttccaatagccatagtaggaagagtgcttcagaatttggcacaaactatgccactggttctgtgggcccgagttacctttctccagattactccagtgttgtttggtttaccaccaggagtcactgtgttgttctttgctttgtatacataagcacatctcttgcccaaatagaattctgtttcatctcgggcataaacactttcaattttaggaagaactgcctgctcccattggttccggataccctgcttatagccrgcaaaaatggccttgcaccacagccttccacatatttccttttagaagtcctgttcccagcaggcctccatggcatccaagatggcgggaagtgcaaatgttatatcttgacaatggtgatggatacatggctatatacattcgttgaaagtcagctgtccactaatgtgactgcattttatagtatgtaaattatacctcagtatagttgcttttaaagaagatgaagccagaggacaggaaattggtaaacatagtgctgtcggccatgtcccttcagccacagcactgccaacactg

SEQ ID NO: 70750 - DNA, 601 bp, Human
cagcactgccaacactgactggtgttgagaggagagctgaagcggagatgagtggactagggtgggctgttggaactgactggacagcttacaagccccgtagattaggtgatacatcactggtgagcaagctgagcactgagtggagccacctttgacatggctgactcctggatgcattttttttttttttgacgtcccccttctctcccctagtgttctttttgttagtctaacttcttccagatactgatctttcaggtcttcagttagaggtcacttaattatgacagtgtttgcragtgttggagggtggttctgattcagtaggtctggggtagggcacagggacctgaaaatttagaaataggcaattagctgggcgtagtggctcatgcatagtaatcccagcactttgggaggccgaggcgggcggatcacttgaggtcaggagtttgaaaccagactggccaacatggtgaaaccccgtctccactaaaaacacaaaaattagctgcgtgtggtggcgtgtgcctgtaatcctggctactcaggaggcttaggcaagagaattgtttgaacctggggggcggaggttgca

SEQ ID NO: 70751 - DNA, 601 bp, Human
aaaatttagaaataggcaattagctgggcgtagtggctcatgcatagtaatcccagcactttgggaggccgaggcgggcggatcacttgaggtcaggagtttgaaaccagactggccaacatggtgaaaccccgtctccactaaaaacacaaaaattagctgcgtgtggtggcgtgtgcctgtaatcctggctactcaggaggcttaggcaagagaattgtttgaacctggggggcggaggttgcagtaagctgagatcatgccattgcactctagcctgggcgacagagactctgtctcaaaaaaaaaaaaaaagtttaattgtaaaaaatatatacataaaatttaccattttctcaagttttcagtgtatagttcagaggcattaagtacattcacattcttgtgcagccatcaccaccatccatctccagaacttttttcatcttacagacctcaagctgtgtccatgtaacaactctcaccgggcgtggtggctcacacctataatcccagcactttgggaggatgaggtgggcagatcacctgaggtcaggagttcgagaccagactggccaacatggtgaaaccccctatctct

SEQ ID NO: 70752 - DNA, 601 bp, Human
gtaacaactctcaccgggcgtggtggctcacacctataatcccagcactttgggaggatgaggtgggcagatcacctgaggtcaggagttcgagaccagactggccaacatggtgaaaccccctatctctactaaaaatacaaaaattagccaggcgtggtggcacacgcctgtaatcccaggtacttgggaggccgaggcatgagaatcacttgaacctgggagacggaggttgcagtgagctgagattgtgccactgcactccagcctgggcagcagagcaagactccatctcaaaaamaaaaaaaaaaaaaaaacccactatttccccctttccccatccactggaaaccaccaatctaccttctgtctctatgagtttgactactctaggtacctcatatgagtggaattacacagtatttgtcctttagggactggcttgttttagttagaataatgtcttcaaggttcatccatgttgtatgatgtgctagacactggttcttaagtaagtgctggttctaatgctgtggtccatagccacattttgggaaacactgcattgggggtagagtgagtagctaggtgggctgtgtag

SEQ ID NO: 70753 - DNA, 601 bp, Human
aactctcaccgggcgtggtggctcacacctataatcccagcactttgggaggatgaggtgggcagatcacctgaggtcaggagttcgagaccagactggccaacatggtgaaaccccctatctctactaaaaatacaaaaattagccaggcgtggtggcacacgcctgtaatcccaggtacttgggaggccgaggcatgagaatcacttgaacctgggagacggaggttgcagtgagctgagattgtgccactgcactccagcctgggcagcagagcaagactccatctcaaaaaaaaaamaaaaaaaaaaacccactatttccccctttccccatccactggaaaccaccaatctaccttctgtctctatgagtttgactactctaggtacctcatatgagtggaattacacagtatttgtcctttagggactggcttgttttagttagaataatgtcttcaaggttcatccatgttgtatgatgtgctagacactggttcttaagtaagtgctggttctaatgctgtggtccatagccacattttgggaaacactgcattgggggtagagtgagtagctaggtgggctgtgtagaaaga

SEQ ID NO: 70754 - DNA, 601 bp, Human
ctcaccgggcgtggtggctcacacctataatcccagcactttgggaggatgaggtgggcagatcacctgaggtcaggagttcgagaccagactggccaacatggtgaaaccccctatctctactaaaaatacaaaaattagccaggcgtggtggcacacgcctgtaatcccaggtacttgggaggccgaggcatgagaatcacttgaacctgggagacggaggttgcagtgagctgagattgtgccactgcactccagcctgggcagcagagcaagactccatctcaaaaaaaaaaaaaamaaaaaaacccactatttccccctttccccatccactggaaaccaccaatctaccttctgtctctatgagtttgactactctaggtacctcatatgagtggaattacacagtatttgtcctttagggactggcttgttttagttagaataatgtcttcaaggttcatccatgttgtatgatgtgctagacactggttcttaagtaagtgctggttctaatgctgtggtccatagccacattttgggaaacactgcattgggggtagagtgagtagctaggtgggctgtgtagaaagaggag

SEQ ID NO: 70755 - DNA, 601 bp, Human
tcccaacacttggggaggccgaggtgggtgaatcacaaggtcaggagttcaagaccagcctggccaacatggtgaaacccccgtctctactaaaaatataaaaaattagctgggcgtggtggcggatgcctataatcccagctactagggaggctgaggcaagagaattgcttgaacctgggaggcagaagttgcagtgagctgagattgcgccactgcactctagcccaggcaacagtgtgagactctgtctcaaaaaaaaaaaaaaaaaaaaaaaaaccaacaacaaccaaaaacattsagagagaggacaaccattttggaaaacaggtattaaaatttcttgttaaattataccaccatgaactgcactccttggcatttacctaagataaatgaaaacatttgctcatgcaaggacttgttacacaaatattcatagcagctttatttataattgcccaaaattagaagcaacaaaaatattattatcagatgagtgggtacattttagtgtattcaaacaatggagtacaactcaggaataaaactattgatacatataacttcgatgaatctcaaaaacatgctaagtggaaga

SEQ ID NO: 70756 - DNA, 601 bp, Human
tattagtttctaggaaataggagtagctgaaaggagaggaggagtgaacattcttaagcatggagttatgttctaggctgcgattgacatatgcagtctaccactatgcaaggacgaatgaggtcagtgttgtaggaacatctggtggagtaaaggcatcccatcatctgtgaagtggagtccgcctgcctactcagaggttgctgtgaggattaagaaattacatatggaaagcaactggcaaagtgttttgcttatagaaagctctaatatgctaattgccttccccgtttctttatayaatttataaggaaactaaaaaccagcgattaaaaccttagctttggtttctatatgtgtaaaatatagttcttatgtttgtctctcattaacctgtaagtttcttcaaatctgggaacatgtctaattgctgtgtatatatcttcagtcctgaagatgatagtagaaaacagttcttctttgaaggtttgttacatggatggatggatgattaacttgtgccagaacacacaggagtcaacagtgaaactgggccaaggacccatgtctcttactcttaacacagtgtttctttctagtc

SEQ ID NO: 70757 - DNA, 601 bp, Human
gctctttggcatgaagagatgctttgtgagccagatgggtctctgaacagatgtctttgatggagagtttaccacttgcacagccaagaaagggaagtcactagaaggacttctgtgtgggctggcctggctgctcagcatttcagactcctgttgtttacaagtcttctccagaagccctggaagaatgaactgtaaggcctggactatggaatggtacctgtgcaccagcaattcctgagcaagcagcacagtgagtagatgattcctggaaacctgagttcaggtgaaaatgagagasagcagtctccttgtccctgcctatgggcttcctcatggccagttctacctctgttctaaatatattcttcactgatgaaatttcaacttcatttattcttctgtccttgaggaaaagtggggaagagtaaagaggtcttttctctgcctcaaatttttatttgttcttatttgttgatacttatttgctggagatagcttagtggtttttttctctttctttttgagacagggtcttgctctggtgcccaggcttggagtacagtggtgcagtcatggctcactatagccttggcctcct

SEQ ID NO: 70758 - DNA, 601 bp, Human
aactgggcttttaagcacaaaactatggtggctgtagcctgtaatcccagcactttgggagatcaaggcgggtggatcacctcaggtcaggggttcgagaccagcctggccaatgtggtgaaaccccatctctactaaaaatacaaaaaattagccaggcatggtagcagacgcctgtaatcccagctactcaggagcctgaggcaggagaatcacttgaacccaggaggcagaggtttcagtgagccgagatcgtgtcactgcactccagcctgggtaacaagagcaagactgtctcagaaaaaaaaaaaaaaagaatttaaacacaaaactaaacttttaaatgtgtcagctttaagttctcaaggaaaacatgataagtgacgtgggtaggagacaggattatttttcctgatcctggagctctgaaaagaattagctgccaaaatttatgtcgagtcttttcatctgaagctgaaccaagtaggtagttgtgctgtgagttaaaaagggttggaggtgaagagggcgctaggatactgctctctttcattctatttaaagcaataatttgcattgccaccctgccgttcttaacctg

SEQ ID NO: 70759 - DNA, 601 bp, Human
ccaggaggcagaggtttcagtgagccgagatcgtgtcactgcactccagcctgggtaacaagagcaagactgtctcagaaaaaaaaaaaaaaagaatttaaacacaaaactaaacttttaaatgtgtcagctttaagttctcaaggaaaacatgataagtgacgtgggtaggagacaggattatttttcctgatcctggagctctgaaaagaattagctgccaaaatttatgtcgagtcttttcatctgaagctgaaccaagtaggtagttgtgctgtgagttaaaaagggttggaggtgragagggcgctaggatactgctctctttcattctatttaaagcaataatttgcattgccaccctgccgttcttaacctgctctaattatcaaggccttattttgactaagaccctgaaaaagcgttgtatgatttagatcaatacgcagttcatccaacttagccgtaaattatttctgccttggagttgttagctgataaagatcaataaatgttaacaacagttttaaattataactcaacttgtttttcttttccttctatctaatgaaaccatgtgtaacctagatttttaaatttt

SEQ ID NO: 70760 - DNA, 601 bp, Human
cagctttaagttctcaaggaaaacatgataagtgacgtgggtaggagacaggattatttttcctgatcctggagctctgaaaagaattagctgccaaaatttatgtcgagtcttttcatctgaagctgaaccaagtaggtagttgtgctgtgagttaaaaagggttggaggtgaagagggcgctaggatactgctctctttcattctatttaaagcaataatttgcattgccaccctgccgttcttaacctgctctaattatcaaggccttattttgactaagaccctgaaaaagcgttgyatgatttagatcaatacgcagttcatccaacttagccgtaaattatttctgccttggagttgttagctgataaagatcaataaatgttaacaacagttttaaattataactcaacttgtttttcttttccttctatctaatgaaaccatgtgtaacctagatttttaaattttacgtatttatgtgtgacatgtatgtgtgtatgtataaatgaacgaatgacaggtctcgctcactctgtcgcccaggctggaatgtggtggtgcgatcatggctcactgcatcctcaacctccccagc

SEQ ID NO: 70761 - DNA, 601 bp, Human
aaaaaaaaaatgtttttgggctgggcacagtggctcatgcctataatcccagcactttgggaggccaagatgggtggatcacttgaggtcaggagttcgaaaacagcttgaccaacatggtgaaaccccgtctctactaaaatacaaaaaaattagcctggcatggtggcgggtacctgtaatcccagttactcaggaggctgaggcaggagaatcacttgaacatgggaggtgggggttgcagtgagccaagatcacaccactgcactccagtctggatgacagagcaagacaccatctsaaaaaaaaaaaaaaaattttttttgtatccttttcctggggagagctgggagtctccaaagtgtctcacggtgtcccagtgacagcctccagcaaatggggtcttcagcaatggtcaggattacaacctctaaattcttcctctccattcagacttgttggcactgatagcaagatctgaagtggcttgtttggttttgttttgttgttttataagctgtttgtagcagactcacacgtaatgatttgagtggtttcttctgcaatttttgcaaggaactatgctgcctctgccaggcat

SEQ ID NO: 70762 - DNA, 601 bp, Human
gtgcctgccaccacgcccaactaatttttgtatttttagtagagatggggttttaccatgttggtcaggctggtcttgaacttctgacctcaagtgatctgcctgccttggcctcccaaagtgctgggattacaggcatgcgccaccgcgcccggtggctcacaagcaaagatcatcctgttttgggctgggtttatagttttgtaatccctatgccaaattttgacaccttataatatttggcagggatacatatgaaatttcttgatcaaaaaatgcaaacaaaaatgtaccctggctrttcttaaggcatttctaatagtactttaccaacaattttaaaggtagcttatctatcaaagattttacgtaaacttgagaaaacatttgactagtctttcattttctgataaggtatttgatttgtgcttttatttttccttaagccaattaattagagctgttttatattttttagtagtaaatcattgtgtacacaacacataaatacgtggacatattagacatactgatagaagtacatcttaaaggtaagacagacctcctttttttttccccccttctgtctaagacttgcaaa

SEQ ID NO: 70763 - DNA, 601 bp, Human
gctggacgtggtggtgcgtgcctgtaatcccaactacttgggaggcttaggcaggagaatcgcttgaacccaggaggcggaggttgcagtgagctgagtctgtgccactgcagtgagctgagtctgtgccactgcactccagcctggcaacagagcaagactccgtctcaaaaaaaaaaatttttttttttggctgagcacagtggctcatgcctgtaacctcagcactttgggaggccgaggcgggtggatcatgaggtcagcagttccagaccagcctggccaacatggtgaaaccccrtctctactaaaaatacaaaaattagcaaggcatggtggcaggcgcctgtaaccccagctactccggaggctgaggcaggagaatcgcttgaacccaggaggtggaggttgcagtgagccgagaccgtgccattgcactccagcctgggcgacagagcaagactccgtctcaaaataaaagttttttaaacaaagacatttctaagtgtctaaactacactcttcattaaaaacccaagagtagcctctgttgcaataactattttagtcagaaaatcaggtaacacaatacaaaagcagt

SEQ ID NO: 70764 - DNA, 601 bp, Human
tgagtacttagtacctgccagacattagcaggtaggagttactattcccacctgacagtcaaggaaaggctcagagaggttctgtaactgggctggggccacagagctagtagatgatagagctaggattcaaacccagatctgcctaacttcagatcaaggttagtggtgctgtttccacaccaccctaaatggcctacttaataatgaaatttatgatgccagctgatgataagaatcactgggtgttaagattcttggttgctaatgaacttgaattagctcaaacaataaagatgatttttttttttgtatcagctaaccaaaccccaggaaggatagaaatacagctggcctgatggataattgtatccagggactcaaatgccattagctcttatactttgattaaaatatactttaaaaagatgctgttagtggccgggcatggtggctcaccctataatcccagcactttgggaggccaaggcgggcagttcgtgaggtcaagagattgagaccagcctggccaacatggtgaaaccccgtctctactaaaaatacaaaaattagctaggcgtggtggcaggtgcctgtagtc

SEQ ID NO: 70765 - DNA, 601 bp, Human
catctctactaaaaaatacaaaaattacctggatgtggtggtgggtgcctgtagtcccagctatttgggaagctgaggcagggagaattgcttgaatctgggaggcagagttgtagtgagctgagatcgtgctactgcactccagcctgggcgacagtgtgagacttcgtctcaaaaaaaaaaaaaaaatgctgttagatctctccctctcacttgtttccctttcgatgttggctttcttctctcgggccagctgtctaccagatggaaccatggtttcctgctttacagttttgttatyagaagagtttttctcacttcaattagaaagttctgagtgaggactcctgattggactgttaggggtcgtgtgcccagacctatgagatcaccgtggccaggtgacagggagctgtaagtggcccagcctgggtcagggggctgccctgtagccagggacaaggttctcattgtgtcagtctccaccttaagctgcatttgccccaaagaagtatgtgtgatgaggagacaaggaatgcctgacatctgtctttaaattgtcaaacacattcttctaagtctttccattacgggttatccc

SEQ ID NO: 70766 - DNA, 601 bp, Human
cagagttgtagtgagctgagatcgtgctactgcactccagcctgggcgacagtgtgagacttcgtctcaaaaaaaaaaaaaaaatgctgttagatctctccctctcacttgtttccctttcgatgttggctttcttctctcgggccagctgtctaccagatggaaccatggtttcctgctttacagttttgttattagaagagtttttctcacttcaattagaaagttctgagtgaggactcctgattggactgttaggggtcgtgtgcccagacctatgagatcaccgtggccaggtgayagggagctgtaagtggcccagcctgggtcagggggctgccctgtagccagggacaaggttctcattgtgtcagtctccaccttaagctgcatttgccccaaagaagtatgtgtgatgaggagacaaggaatgcctgacatctgtctttaaattgtcaaacacattcttctaagtctttccattacgggttatcccaagctaggaataactggtgagtagtttcttgaccttttttccagaccttttttggtgaattatgttaagctgtgacccaggcacaaatggggaggccatactttg

SEQ ID NO: 70767 - DNA, 601 bp, Human
aaaaaaatgctgttagatctctccctctcacttgtttccctttcgatgttggctttcttctctcgggccagctgtctaccagatggaaccatggtttcctgctttacagttttgttattagaagagtttttctcacttcaattagaaagttctgagtgaggactcctgattggactgttaggggtcgtgtgcccagacctatgagatcaccgtggccaggtgacagggagctgtaagtggcccagcctgggtcagggggctgccctgtagccagggacaaggttctcattgtgtcagtctycaccttaagctgcatttgccccaaagaagtatgtgtgatgaggagacaaggaatgcctgacatctgtctttaaattgtcaaacacattcttctaagtctttccattacgggttatcccaagctaggaataactggtgagtagtttcttgaccttttttccagaccttttttggtgaattatgttaagctgtgacccaggcacaaatggggaggccatactttggtggagcctgggtcacataaatatggtgaccttactagaaattctttcctacttactcattgtttaataatgaacag

SEQ ID NO: 70768 - DNA, 601 bp, Human
gcctttagtcctgttgtctgggccctgattttttagatcctggagagaacgctccctcaggggtctgagttctaacccttggccctatcgttaactccctgtgccaccctaacaggtgacgccttcctattctaggcctcagtgtttctcatctgtgtgcaatggtttataatgcttacctcacagtgttactgtaaggattaaagaagatagtatatttgaactggggaggcggaggttgcagtgagctgagatcatgccactgcacgctagcctgggtgacagagtaagacttgtctcaaaaaaaaaaaaaaaagtatatttaaaaggcctgacatagcaggtgttccataaatcagagctgttgtaggatcttcttaggtctgctaggctcgcctgcacctctcattctcccacctagtctctcagctgcatcctggcttttttttcccaatgctcttggggaaggaaatttgggtgggggaaaagagcttacaggtaatggctaattgaagagttggggattttctcagaattttaattatctctgctacttaattagctccttgaggccatggatagctggaggtggctctgtaga

SEQ ID NO: 70769 - DNA, 601 bp, Human
gcctgagcagcagctgtagtctgaagagaggtgtctgagccagcagaggaagaagctgctggactgggtggaggagactgttcttgtggggaaggagaggtgtctggttctgtgaactgccgatcttggagggcagcctgtgaagcaatcattgtctattcctataacatggtgtgctgcttatatgccatgccttattacatcaatcctggtctgtaacttgtgatggtatgagagccgccattgtgactgtttcaatcatggcaaaccatggcccagaaaagtcaagtgacttgctcasggctgcatgtagagtaagtggcagggtcaggatttgacacagggcttctgtctcactagccagtgctgctcttttactctaaaacaggcttaacagatcatgcctaaacagcccatggggagagtgtgggccgggtgagggagcctggtgccgtgtggcctggcatggatgagaggcaatggcactgggtgggaggagtggaagagggcttgtgttggagccccttggtgtgccgccccagcaggcgctgtcacaccccttacccttctcagtctcgttccattttcagcatcattttcc

SEQ ID NO: 70770 - DNA, 601 bp, Human
agccgccattgtgactgtttcaatcatggcaaaccatggcccagaaaagtcaagtgacttgctcacggctgcatgtagagtaagtggcagggtcaggatttgacacagggcttctgtctcactagccagtgctgctcttttactctaaaacaggcttaacagatcatgcctaaacagcccatggggagagtgtgggccgggtgagggagcctggtgccgtgtggcctggcatggatgagaggcaatggcactgggtgggaggagtggaagagggcttgtgttggagccccttggtgtgccrccccagcaggcgctgtcacaccccttacccttctcagtctcgttccattttcagcatcattttccaaatcctgaacacctgacctccaggggccaggtacccaacaccggtcctctgaggggccatgggcatggtgggatgaggaggtacacctccaacaagcaactgctggactcatgcctcggctgaagtgtttgtgggctctgtcctaacactaggcccagggaaagaacagagctcgcccctctcctcccgaagttcagaatctccccatggttctctgagaggctgcatggctcg

SEQ ID NO: 70771 - DNA, 601 bp, Human
gcaactgctggactcatgcctcggctgaagtgtttgtgggctctgtcctaacactaggcccagggaaagaacagagctcgcccctctcctcccgaagttcagaatctccccatggttctctgagaggctgcatggctcgctccctctctctgttcacatcgttgctcaaatgtcctctcctcacagggccgttccttgccaccctgtcacaacagtacccccttactctctctgtcctcacagggttttattatatatatatataaaaatctgtgtatatatatttaacatatatatatayactatatatacctgtatatatatagtatatatatatgttatatatacacacatatatgttaaatatatatacacacatatgttaaatatatatacacagatatgtgtgtgtgtatatatatatatacacacaggtatatatatatacaggtgtatatatagaggtatatatatatatattttttttttgagacagagtgtcactctttgcccaggctggagtgcagtggcacgatctcggctcattgcaacttctacctcccgggttcaagcaattctcctgcctcagcctccctagtag

SEQ ID NO: 70772 - DNA, 601 bp, Human
ttgttcattgatttgtctgtctcctcacaataaaatttaagcttcatgacagtgggggacttggtcagtttcttgactgcccacacagagcccacaggtaaggtagcaggtgttcagtggacagtaggtgatgaccgttagagcatggcagcagggtgggtagaagaggacaggtgtaagtgtcagagggcctgggatctgctttcagctttacccagtttttgctgtgtgactttgaacaagttgctggatctcttgggccttagccttctttttttttttttggagacagaggagtctyactctgtcacccaggctggggtgcagtggtgtgatcttggctcactgcaacctctgcttcccgggttcaaacgattctcctgcctcagccttctgagtagctggggattacaggcgtgtgccaccacacctggctaatttttgtatcttcactacagagaaggtttcaccatgttggccaggctggtcttgaactcctgacctctggtgatctgcccacctaggcctcccaaagtgctgggattacaggcgtgagccaccatatcctgctgggccttagactttttgttttcatcatgaa

SEQ ID NO: 70773 - DNA, 601 bp, Human
attacaggcgtgagccaccatatcctgctgggccttagactttttgttttcatcatgaaggggaggaactaggtgccctctaaggctgcttttggcacctctcttctgaaagtctatgtgtaggagacgagggtcgcagaggggtttgcaaagatttgtatcctgtgttcctttactgaagagcctgacttgggtctgcacactgtggggtaggggagtgacatgatgagggctgggtcttaggaggactacaccagtgatgcagtgtgtgcatgcatgtatccatggtgcatttagaacyattcattcaacaagggcttttggagcacctgccctctgtcagatacagtttgggctcagggcttagagtggtgaggcagacagccaacgtcctgccctcctgcagctgattggggcagagagaggctagagctggcctggaatggtgattacccccaggctgaagatgaagaggggccaagtggagttggggcactgggatattagagggtcatgatttttttttattatttttatttttatttatttttttgaggcagagtttcactcttgttgcccagactggagtgcaatggcgtgg

SEQ ID NO: 70774 - DNA, 601 bp, Human
tacctggacccctcgccagagtctctgctccacttcagccaacaccctgtgttgagggtatttcctcctgctcctggctctgctggctcacactgtcaccagagcattgtgtggggccatcctcacactatggcagcaccagcgtgttttcttccctcctccataccaccggttccttggggacagggacaaggtgtctctcttgtccctagtgcctggcatggggcctggcatgtggtaggtgttcagggaatgcttggcaagtgggtagatgtttagttggctgagtgggagggtacakggataaaacatttctgagaatgatttggaaaggtggaaacgtgagtctgggccagtgctgaagtgcggcaaagtggaggagcgttggagtgagtaggcagtctttacagaagtggcggggagtgcaggcccgcgtggagagggggacaggcgcagaggctcagatcttaacttgtacaaagcattttatgtgttctctgtcaaagcacatgtcatgtccctggaaggtctcatttgatccatgtggttgtcccaggaaataaagattattgttcccattttagaggtgaggaagtctaga

SEQ ID NO: 70775 - DNA, 601 bp, Human
agcagtcttcctccctcagcctccagagtagctgggactacaggttataatttatttgcgggggttgggagggaaggggctcactctgtcacccaggctggagtgcaatggcatgatcacagctcactgcagcctcaacctcccaggcccaagtgatcttcctacctcagcgtcctgagtagctgggaccacagtcacatgccaccatgctcagctaggttgttgtttattttgtagagatatagtctccttatgttgctcaggttagtcttgaacttttgggctcaagcaatcctcccgyctcagcctcccaaaatgctgagattacaggcatgatccaccatgactggcttctaatttgtgggttttttttgttttgttttgtttttgatactgggtcttgctctgtcacccagggtggagtacagtggcgccatcatggcttactgcagccttgacctcttgggctcaagtgatcctcctgcctcagcctcctgagtagctgagaccacaggcatgcgccaccatgcctgactaatttttttaatttttttgtatagatgaggtctcactatgttgactaggctggtctggaactcct

SEQ ID NO: 70776 - DNA, 601 bp, Human
gccttgacctcttgggctcaagtgatcctcctgcctcagcctcctgagtagctgagaccacaggcatgcgccaccatgcctgactaatttttttaatttttttgtatagatgaggtctcactatgttgactaggctggtctggaactcctgggctcaagtgatcctcctgccttggcctcccaaagtggtgggattataggcatgagccactgcattctaattttttaatcatgacttttggtagatttattttttattgagatatagaattcacataagacaaaattcacattttaaagyatgtagttcagtggtttttagtgtattgttaccatgttgtgcagccatcaccactgtcttattctggaacattttcattaccccagcaagaaaccccatcccccactcccccctgcctgatccactgacaaccactaatctactttctgtgtccacggatttgcctagcattatataattttaatagcatttcatttgtgatcacgactataatctgaattttaaagatgaggaaactgaggcacagtgcacttgtcaaggccacataggcttgcaagtagccaagtctgactcccaaga

SEQ ID NO: 70777 - DNA, 601 bp, Human
acttgtcaaggccacataggcttgcaagtagccaagtctgactcccaagatgataaacactgtgcagtaccacctgcctctctgaatgtgaatactgggaagtaaacctggtactcagggaatagcctgacctagccaactgttttttatgtagctcctgtctggccagggatacctgccctgtacctccatgaggtccacatgagagagagcttgtataaaggggaaagcagagggggctagaggtagctgatggcaggtcattggaggggctggtggctgtggcctctgaggctcgccrgtgactctaggagacaaaaggaagaaacgcaacttcatggagaattaaaactaagtcctttagttatttagttgctatctcatttgtgcctctctcaatagaaggaagggggaaaggacagacataattattatgtctctgctttacaaaactcagaactttgtttggctcagcagtgaactgatttgccaaaggttacgaacttaagatgtggcagagcccagacttgtaccctggcctttgctggtcccctctgtgttcaagccttatctgtggctgtttaatgtttattgtccatga

SEQ ID NO: 70778 - DNA, 601 bp, Human
tggtactcagggaatagcctgacctagccaactgttttttatgtagctcctgtctggccagggatacctgccctgtacctccatgaggtccacatgagagagagcttgtataaaggggaaagcagagggggctagaggtagctgatggcaggtcattggaggggctggtggctgtggcctctgaggctcgccagtgactctaggagacaaaaggaagaaacgcaacttcatggagaattaaaactaagtcctttagttatttagttgctatctcatttgtgcctctctcaatagaaggaasggggaaaggacagacataattattatgtctctgctttacaaaactcagaactttgtttggctcagcagtgaactgatttgccaaaggttacgaacttaagatgtggcagagcccagacttgtaccctggcctttgctggtcccctctgtgttcaagccttatctgtggctgtttaatgtttattgtccatgaccctgttctggtcccagggatccatgcccaaccccttgcctcatattaacaagtaatctgtttctgagaagtattttttctttttataaaatttgtagcatacggaat

SEQ ID NO: 70779 - DNA, 601 bp, Human
ttgattccctcagcagtggggacagtctgcagaatggggcttgctctgggtcactgttctaagagctgagttctagtcctcacctaagatcagactgacatggccctcaaaggaagagcactaggttgggctttgtggtggggatcagtgtctcatttttagtcccaaattaaaaacgagattttgggctgtacatcagagcagtgacatcatggacattatgtctgtgggtcagcatgggtacacacagctcccagcccaggtacataagtgggcccacatttcctggactgcatggaaygccatgagcccagtgctccagagccttgtactgtatagtgctgcatgatcaccatgggaaaatctgaaaacagcctcatttctggaatgtacaggtaacattcttccagatccagccctctgtcagttaatgttttattaacttttcactgcttctctagggctcagaaaagggatttttaaaaaccggtttgcttctgcaggtgctgtcagacctgggctatgcctggtggtttgcacgtgcccctagctgttgctgccagtaaattgctggttacgttcccatgccgcactccaagat

SEQ ID NO: 70780 - DNA, 601 bp, Human
atgggttctgagaatggattggtagctgaataggactggagaatatttttcagactggtaggatattttacatgcttgccagggttatttttcggagtaaggagaaatggactcatttattcagcagagatcacgtgccccctatttacaaggaattgtgctaggtgcaaagtctattgctattgtagtgttttgctgaagcaagttttctttgttttaaattagtgtacgtctttttttttttttttttaactttatctagcatccagcacagaataatccaataaatgtgtagggcgcmtttgaaaaactgcactattaatgttaaaatgtagaaaatgtttaataaaggtacaagattaatttaaaagggtgatagaaccctaataaaacatttaggtaggtgttgtaaccaagatgtatttttactctaggataagtttggctcttttgatcaaaattcctgtgaatatatttctacttgccattataaagatgcagagggctctgtcctttgaattttttccctttggtgcttgaatgatatttaagcacccagcattctgaagttgctgttttgaagtaatttcatgcactttcc

SEQ ID NO: 70781 - DNA, 601 bp, Human
cagaacagaccggttttgctggggttagggctgactttctttgagatgatagaacagttcagtgtcttgtttatggtgatggttacatgaatctgtacacatgacacaatgtcctagaattagacacacaaaagaatgtaaaagctgacatttcaataagtagttcagtgatgaatattgtattagtgtcactttcctgcttttgataattgcacagtgcttgtccattttatggctgtatcacatttaaccatttacccatggaaggccatgtgggttgtttctggtttttggtgattgmaggtaaagctgctatgaacattaatgtacaggttcttttgtgactgtaagttttaattgttctagaataaatatctagaaattcaactgctgggtcatatagtgataaaaccttgagccctcttattctgtcccaggtggggtgtaaatcatccctttgtccagcatatccacactgtatacactacccaccagctagttagtcactcttggttatcagattgactgtctggtgtcttggtgcttgtgtttgagaatcccttattgtacttagtagtgaccccaagtgcaagactagtga

SEQ ID NO: 70782 - DNA, 601 bp, Human
atgaatattgtattagtgtcactttcctgcttttgataattgcacagtgcttgtccattttatggctgtatcacatttaaccatttacccatggaaggccatgtgggttgtttctggtttttggtgattgaaggtaaagctgctatgaacattaatgtacaggttcttttgtgactgtaagttttaattgttctagaataaatatctagaaattcaactgctgggtcatatagtgataaaaccttgagccctcttattctgtcccaggtggggtgtaaatcatccctttgtccagcatatmcacactgtatacactacccaccagctagttagtcactcttggttatcagattgactgtctggtgtcttggtgcttgtgtttgagaatcccttattgtacttagtagtgaccccaagtgcaagactagtgatgctggcatttttttttttttttttcttgaggcaggtctcttatcttgtcccccaggctggagtgcaatggtgtgatctcagctcactgcaacctccgcctcccagggtcaagcgattctcttgcctcagcctccctagtagctgggtcacaggcgcctgctgccacgca

SEQ ID NO: 70783 - DNA, 601 bp, Human
gtacaggttcttttgtgactgtaagttttaattgttctagaataaatatctagaaattcaactgctgggtcatatagtgataaaaccttgagccctcttattctgtcccaggtggggtgtaaatcatccctttgtccagcatatccacactgtatacactacccaccagctagttagtcactcttggttatcagattgactgtctggtgtcttggtgcttgtgtttgagaatcccttattgtacttagtagtgaccccaagtgcaagactagtgatgctggcatttttttttttttttttyttgaggcaggtctcttatcttgtcccccaggctggagtgcaatggtgtgatctcagctcactgcaacctccgcctcccagggtcaagcgattctcttgcctcagcctccctagtagctgggtcacaggcgcctgctgccacgcaccgcaaatttttgcattttaagtagagacagggtttcaccattttggccaggctggtctcgaactcctgacttcaggtgatccgcctgcctctgcctcccaaagtgctgggactgcagggagtgagccaccgcatctggccgctgacatattgtta

SEQ ID NO: 70784 - DNA, 601 bp, Human
tagatcttggtacatttttcttttccttttgtccatggatgtccagttgttccaaaaccatttgttgaaaagtctaccctttctccattcaataagttttaaaaatcaaaaatcagttggccatatactgtaaattaggtatcaaaacaaagacaggaagaaatgaatgagcaattaactattaataaatacaggtttattgaaggtataacatggctggagtctggaaaaagtgggaaaacattttagagaataacatgggcaaagatctgttctagagaaaataagtaagaactggctrtttttgggagtcatgcaagtgaagggaagtagagaagtaaaggaaggatcattggttcgtgaaaaagaaagagtatataaacttctggctagattgaagcatttgtaatcagtttcattggctattaggaaggtgctgtatattcttaatcaggaaaatggtatgatagaaatggtattaaagagaagttgttttaggaccatttgtggcagtgatacgttggtaggaagaacaggatataatcatgacccttgacttacaactttgttttacaaatatctgccagaaagctaaaaaagt

SEQ ID NO: 70785 - DNA, 601 bp, Human
gttttgaactcatgtgtaaatggaataatgccctctggactttttttttttttttttgcttgacttcttttactcgatgttgtgtctgagattcattcatgttgttgcatgtagtttgttatttttaaaaatagctctgtagttgtggttatctatccctgcataacacactagttttgattattggttattgcgtaacacaccactccaaacttactagtgtaaaataacaaccattttattatgctcatggattctgtggattgggaatttggtggttatggcttatcactgccctacratgcttggggtctagaatcatttagaggcttctccactttcctgtatggtaccttgactagaacgtctagaagactgggatcatctgatactgttgaccaaacctacatgtggggtcaggaggttttggcttttcacagcatgttggctgagtaccttgactagaacgtctagaagactgggatcatctgatactattgaccaaacctacatgtggggtcaggaggttttggcttttcacagcatgttggctgagtgtccagaggaagcttcctgagagtggcttatcttcagaagtcat

SEQ ID NO: 70786 - DNA, 601 bp, Human
gtgtttaagaagtttttgctactctagggcgatgaagctattttcttatgttatcttctagaagctttagtattttgcctttcagatttaggtcaaagtccccaggaatttgtttgtgtgttatgaggtagggatcaagccttcttttacttttttcatatggttatctatacaagtagtaacaggtggcattgggtctgttggacacaagcctgggagttaggattccagtattctccaccttagattacctttaatgagccttctgcacttgggcatattcttaaatccgtcttgactsagcttcatttgtgaaatgaaggatttgaatggaatgttttctgattttcattctgactgtggtttgttagatctctacctacttttgtagttgtattgaggcttgttagaatcttcttatatctggattgtgttatctaaaatattcataacatctcccagctttatgttgttcccagttcgaatgtgctatctagaacttagctgctgatgaaagatagttttattgatcacgttggcaagtccaagatcacctgttcttctgatttttttttttaatttttttttgagatggagtgtc

SEQ ID NO: 70787 - DNA, 601 bp, Human
attgggtctgttggacacaagcctgggagttaggattccagtattctccaccttagattacctttaatgagccttctgcacttgggcatattcttaaatccgtcttgactcagcttcatttgtgaaatgaaggatttgaatggaatgttttctgattttcattctgactgtggtttgttagatctctacctacttttgtagttgtattgaggcttgttagaatcttcttatatctggattgtgttatctaaaatattcataacatctcccagctttatgttgttcccagttcgaatgtgcyatctagaacttagctgctgatgaaagatagttttattgatcacgttggcaagtccaagatcacctgttcttctgatttttttttttaatttttttttgagatggagtgtcactctgttgatagtgcagtggcgctatctcggctcactgcaacctccgcctcctgggttcaagcggttctcccacctcagcctcccaagtagctgggattacaggtgcacgccaccacgcccagctaattttttgaatttttagtggagatgggatctcaccatgttggccaggctggtcttgaactcct

SEQ ID NO: 70788 - DNA, 601 bp, Human
ctaaaatattcataacatctcccagctttatgttgttcccagttcgaatgtgctatctagaacttagctgctgatgaaagatagttttattgatcacgttggcaagtccaagatcacctgttcttctgatttttttttttaatttttttttgagatggagtgtcactctgttgatagtgcagtggcgctatctcggctcactgcaacctccgcctcctgggttcaagcggttctcccacctcagcctcccaagtagctgggattacaggtgcacgccaccacgcccagctaattttttgartttttagtggagatgggatctcaccatgttggccaggctggtcttgaactcctgacctcaagtgatccacccaccttggcctcccaaagtgcagggattacaggtgtgagccaccgcgcccagcctctgatcttactaatatactgtgtcccttgccaggagctcatcatgctttgtttagtaagtcatggtagaagacaccaattccattaacaaaaaaattagctatctcctgcagaagggagcaaattccatttttgaaagtcatctgcacatactattcatcttacttgtccctac

SEQ ID NO: 70789 - DNA, 601 bp, Human
cagctttatgttgttcccagttcgaatgtgctatctagaacttagctgctgatgaaagatagttttattgatcacgttggcaagtccaagatcacctgttcttctgatttttttttttaatttttttttgagatggagtgtcactctgttgatagtgcagtggcgctatctcggctcactgcaacctccgcctcctgggttcaagcggttctcccacctcagcctcccaagtagctgggattacaggtgcacgccaccacgcccagctaattttttgaatttttagtggagatgggatctyaccatgttggccaggctggtcttgaactcctgacctcaagtgatccacccaccttggcctcccaaagtgcagggattacaggtgtgagccaccgcgcccagcctctgatcttactaatatactgtgtcccttgccaggagctcatcatgctttgtttagtaagtcatggtagaagacaccaattccattaacaaaaaaattagctatctcctgcagaagggagcaaattccatttttgaaagtcatctgcacatactattcatcttacttgtccctaccttcagtttcgtacttgaactt

SEQ ID NO: 70790 - DNA, 601 bp, Human
cttactaatatactgtgtcccttgccaggagctcatcatgctttgtttagtaagtcatggtagaagacaccaattccattaacaaaaaaattagctatctcctgcagaagggagcaaattccatttttgaaagtcatctgcacatactattcatcttacttgtccctaccttcagtttcgtacttgaacttttaagaatcacatacacagcatagagtttcatgaatcagcagaagtcattcaagatcagtgagttgtagtcttggcaaattctctcttccatcttggaaagtggcatacrttccaaattactgtataatatgtttgtgtctctaagaagagtgagtcaggaactaccctggatgacagaacagaaaatctaccatttgctggtttctttgtgttcttagtggcctgctttgaggtgcttttaacccttctttgaaaagatttagtttagtttccacagaacgctataatccagtgtagctatttttctttgttatccttgctatcacattttccctctcattaaccttttttttttttaaagcaaacagctttagtgagatataacttacataccatacaattcattcat

SEQ ID NO: 70791 - DNA, 601 bp, Human
agtgagttgtagtcttggcaaattctctcttccatcttggaaagtggcatacattccaaattactgtataatatgtttgtgtctctaagaagagtgagtcaggaactaccctggatgacagaacagaaaatctaccatttgctggtttctttgtgttcttagtggcctgctttgaggtgcttttaacccttctttgaaaagatttagtttagtttccacagaacgctataatccagtgtagctatttttctttgttatccttgctatcacattttccctctcattaaccttttttttttttaaagcaaacagctttagtgagatataacttacataccatacaattcattcattaaaaggtataattcagtagcttttagtgtatgcacaggactgtaaccatcaccataatctaattttagaatgctttcatcagtactaaaaccccctactcattaacagtcattctccattccctacttgatccctaagaaaccacgaatagttttgtctataaatttatcaattctggaaattttacgtaattggaatcatataatatgtagtgttttgtgaccagtttcttaacgtgtgttcaggg

SEQ ID NO: 70792 - DNA, 601 bp, Human
ttaaaacttaaagaggaaaatatatcagttaaatatttaggttgacattgttaggaaccaaggtttttaacaaatgagaaaaaaagccgggtgcggtggttcgtgcctgtaatcccaacactttggaaggctgaggtgggaggatcacttgagctcaggagtttgagaccaacctgggcaacatagccagacctcactctactaaaaaaaaaaagaaacagaacaaaacaaattcgtgggcatggtggcactggtctgtagtcccagctgcttggaaggttgaggtgggaggattgcttakggccgaggctgcagtgagccatgattctgctattgcactcagcctgggtgacagggagaccctgtctggaaaaaaaaaaaaatcttcttgctctgtccactcaaaaaacctagaaataatattttagtgcccagattttggtctccgagtaccactttcaactaaaaggaaatagggccccttgtagaagtggctgattgtaggcttgagacaggaaaatgtacagaaggaacctggaacattttgtactaggaaagcaaggaaaagctccaagactagtagggttgtatcaggaaacag

SEQ ID NO: 70793 - DNA, 601 bp, Human
gatttatttttaaaaagtacctgttaaaagtatttacatatgaaatgatgtgttgtctgaggtttgctttaaaataatcttggaaggggttagtagaaacaaacaaattggccatgtgttgttgatagttgttgaaattagctgatgtttaggtggacactcattatatcacttctctacttcatatgtatttgaaaattcttctaaggagaagtttttttctttaaagccatatttatttctttttctgtgagtgtgcctcttcatattcttccatttttctgttgggctttagtcttayaatttaaagggttctttaaatactaagaaaatttgcctttagtcatatgttttgcaggtatttttaatttgttttttgaatttgtttatggcttttttttaatctgtggagaatttctatttttattttgttaaatttatcagttttctttatggcttgcgtgttttgtgtgtttagaaaaatcttcttgtctctgagattctgaaaagttctttcatgttttcatgaatttttttaatgaccacagtacacttctgttatactttatttagtcaccttaatttcctcttagagtatttg

SEQ ID NO: 70794 - DNA, 601 bp, Human
ataatcttggaaggggttagtagaaacaaacaaattggccatgtgttgttgatagttgttgaaattagctgatgtttaggtggacactcattatatcacttctctacttcatatgtatttgaaaattcttctaaggagaagtttttttctttaaagccatatttatttctttttctgtgagtgtgcctcttcatattcttccatttttctgttgggctttagtcttataatttaaagggttctttaaatactaagaaaatttgcctttagtcatatgttttgcaggtatttttaatttgtyttttgaatttgtttatggcttttttttaatctgtggagaatttctatttttattttgttaaatttatcagttttctttatggcttgcgtgttttgtgtgtttagaaaaatcttcttgtctctgagattctgaaaagttctttcatgttttcatgaatttttttaatgaccacagtacacttctgttatactttatttagtcaccttaatttcctcttagagtatttggaaatattctcccatagagccctgccccaagactatatagggaaaaatgttgttcagtagctgttctatcaga

SEQ ID NO: 70795 - DNA, 601 bp, Human
tggggctgttgtggagtaaggcctttactgttccaaagttccactgataattaggttggtgcacaaataattgcggttttggactgtgaattttaaatcattataactaggctcaaacacatctttatcaaaataggagccattgcagtcaacacatttttgccaatgagaagtaagttagtttattcctgtagtgtaaaaatccgtgttttgggattcgatgaactcttggaaagcattttctgcatcctgctggttgtgcaagcgttttccctgcaaaaatttgttgatatgcttgaaraagtggtagtcggctggtgagaggtcaggtgaatatggcggatgagacaaaactttgtagcccaattcattcaacttttggagtgtttgttgtgcgacgtgcagtcgggcgttaccctggagaagaattgggccctttctgttgacgaatgctggctccaggtgttgcagtttttggtgcatctcatcgatttgctgagtgtacttctcagatgtaatggtttcgccaggattcacaaagctgtactaggttagactggcagcagaccatcaaacagtgaccatgacctttttttggtgc

SEQ ID NO: 70796 - DNA, 601 bp, Human
acttcaggtcatatctgacttcagaagagataggtctttaggtatggggaaaatgtcaatcaatgtataaggagaggttaaatgagagaaaaggctttgtgctgggaagaatggagataaaaatatgttggttccatgttaatagaatggtggagtccagtttgtccagaattatccttgaatcagagtgtctctatacagtgtaaaacatatcagagaagtttatgactttaaagaaaatttcataaaaatacatgaccccctaaaggagtttacatgcagaactattttggggaaaatktatgagtagtcattcagtatataacgagctttattcagcattgtaattttccagtttgtgtatgatgaattcatagagctcattaagtgtaagtgtcattgttgtgattcattcaagcctttttcctctcttcagcagaaggttaaaaaaaaattccaaatttgaatccaggacttgaagaatgccagttgtctaaatacagtaccatattgtgataaatatagctattgaaatttttaaaaatctattcacaaaactttattttaatattcatagcagaactttttttggaatgttatc

SEQ ID NO: 70797 - DNA, 601 bp, Human
taactttagtaccataattactctgtttacaattaaattttggtgaatatgctaatatggaatataccaatgagtgatttcagcaaagggcagtattgatttgcatcttgatgtgcttttcagttgcatctgcatttcatttaatatcagaggaaaagaagtggtcagattatgtaatgctaaacttttttttctttgaaacctctctgttgcattggctactataaaagtagacttgcatagagtcagaggggctgaaattatgtggaaagatttaattttgttaaagtttgtgcctttyagtatattcattaatagaaaccttaatgcaagcatcggtttcattattagaagaaacctataatgtactaaagtgattgtttaattctaattagtattttaagttcttcagaaaactcactaacttactgaagcaaatacttgtgattattttatttctttgagcagggacttctggttttaaataattcctcttttaagaaattgcctgaaaagcaacaaggagattgagaaacagtgatttcatattctgagaaactgagaagcttctgtagccctgaactagaaaataaggagctgc

SEQ ID NO: 70798 - DNA, 601 bp, Human
aactttagtaccataattactctgtttacaattaaattttggtgaatatgctaatatggaatataccaatgagtgatttcagcaaagggcagtattgatttgcatcttgatgtgcttttcagttgcatctgcatttcatttaatatcagaggaaaagaagtggtcagattatgtaatgctaaacttttttttctttgaaacctctctgttgcattggctactataaaagtagacttgcatagagtcagaggggctgaaattatgtggaaagatttaattttgttaaagtttgtgcctttcrgtatattcattaatagaaaccttaatgcaagcatcggtttcattattagaagaaacctataatgtactaaagtgattgtttaattctaattagtattttaagttcttcagaaaactcactaacttactgaagcaaatacttgtgattattttatttctttgagcagggacttctggttttaaataattcctcttttaagaaattgcctgaaaagcaacaaggagattgagaaacagtgatttcatattctgagaaactgagaagcttctgtagccctgaactagaaaataaggagctgcc

SEQ ID NO: 70799 - DNA, 601 bp, Human
agagtcagaggggctgaaattatgtggaaagatttaattttgttaaagtttgtgcctttcagtatattcattaatagaaaccttaatgcaagcatcggtttcattattagaagaaacctataatgtactaaagtgattgtttaattctaattagtattttaagttcttcagaaaactcactaacttactgaagcaaatacttgtgattattttatttctttgagcagggacttctggttttaaataattcctcttttaagaaattgcctgaaaagcaacaaggagattgagaaacagtgayttcatattctgagaaactgagaagcttctgtagccctgaactagaaaataaggagctgccaaattcagtgaaggtcaaacagggtatgggaggatgctgaaagggaacctgagacacagatgtcaggaaagctggcagaactgtgttctctaaagaaaggggcacaccctgagaggcacattaataagcctttgtctgggagaacaggaataggtgttggcaggcaggggcactagggaactttatggtgtgatgaaaatgttctctgtctggtggtcgcacaagtgtatgtacgtttgt

SEQ ID NO: 70800 - DNA, 601 bp, Human
agaacaggaataggtgttggcaggcaggggcactagggaactttatggtgtgatgaaaatgttctctgtctggtggtcgcacaagtgtatgtacgtttgtaaaattttgtcagtttactttgtgcaagttagtaatttattgcctctcaactccaaattcacccctttttgctctatttatatactcgagccagaccttttaaatattttttcttttcctggacagtgttagattttgtcagtagaaggtgaggaagggatactgcaagacttagcagagaaagtgcttctcttgttgccrtgtgcttgtttttttgttcgtttgtttgtttttcttaatctcttaaggtgtggctgtcagctctactaactctcctgtaagcttcattagcaccctggtaggcagcttcttgctcccaccagtatctcgtgggcagcagattcctgtggataagctgtagctcactggccctacagagaactaccctaccgctcagtgggtcactgccacagtctgtccagtgaagtgttcctttcttgggcactctcccttagccttggagacagtaactgctccctatatttgctagttccatattcc

SEQ ID NO: 70801 - DNA, 601 bp, Human
aaaatgatcgaaacagtatacagtgtaggagagttctgtttgttccaactccttaccaacactttgtagtgtcagacttttgcagttgaagtcttcaaaaccttaaggaatagatcaaatgctgcttaaactccttagattgtggtaaaggaagaaaagcttccaaaatcttattatgaagtgagcataatattgatacttaaacagataaatgtagcagaaaaaataaactacagaccattcttatgaatatcagtcttgtctatggctataccaccctgagtgtgcccgatctcgtctraatatcagtcttgttcctaaataaaatattagcaaatagaattcagcagcacactaaaaaaattataactgccaccaagtataatttttttttttctaggaaggttgtgttaaatagctctatatgagtatgtggtataccagctgtatttaagtcttttgtgtttctcaagatgctaaaagataagtattgaacaagtatttattagtacactgccattggccctgcttatacctggctgaagcaggccctaaggattgacagggcctttggttgcctgaggccacctgagattatagg

SEQ ID NO: 70802 - DNA, 601 bp, Human
tctacagtgtcagtacatttgcccattatatactcttttctctcttttataacccttgttgagtctcagttctacaagtatatatttactgctcactgatattgacatttctttagtcattttggatattgctatgggagtggcagaccccttctactgggcttcttctctagtagattcttattgctgttttctatattgataacacttagcagtctttatactcgaaatttagctgggtataaaatctttggttcatgtttcctttcttagagtcttaaatatgttactttttttccctggcataaaatgttgctgttaaagtgatgacaatttgattttattttccttataaaatatctgcagatgctcaaaaagtattttcatttactattaagttaactaaattatatcttggtgatggtcattctgggttgatttttcaaatgtatgtgatatgacctttcaaaatgtagttttatgtttaaatgaagttcaggaaagttttcttgaattaaatgatttttaatattctgttcccttgctttgattttctttgttatatgtatgttggtttttttgtgtatgttttcttaaacat

SEQ ID NO: 70803 - DNA, 601 bp, Human
tttcctgtcactcttgaaagttgtgctccttcctcacagtgacttccataattgtggagcatgttggtgaggtcttggagccaggtggtcaccggtgcaattttctgttgttccaccacttaccagcttgctgagccttagtttcctcgaaatggaggtgataatgtaatcttcacagagtcatgaggatggatgggaacctgtgtaaagcatttactagcatgtcccgggaacctttgccccttccccttgtgctcagttgccttatgttttcaatctctgcactgtgttctatcatatyggtattgaccttaataaactcttcattttgttcctataaaatgtgcattctaattggatgcacctttccctctcagcttcatagagcaattctttgttgttattaaatagcatttttagttgtagttgatcattatgccattggacttaaacctaattatttccttgaaaatagttgcatatatgattttattgtttcttctccaaagttaagagataatcaaataggatttgagccattataagtcagaattaacaggtatcctttaagttttggagtaagtaggaatttgaacagcat

SEQ ID NO: 70804 - DNA, 601 bp, Human
tgccattggacttaaacctaattatttccttgaaaatagttgcatatatgattttattgtttcttctccaaagttaagagataatcaaataggatttgagccattataagtcagaattaacaggtatcctttaagttttggagtaagtaggaatttgaacagcatctccgtacggaagttttccttagggaaaaatgttttaaacacttctaagattagaattctgaccatttctttgttttatgttatagtgaaaatgcctcgtgtaaaagcagctcaagctggaagacagagctctgcraagagacatcttgcagaacaatttgcagttggagagataataactgacatggcaaaaaaggaatggaaagtaggattacccattggccaaggaggctttggctgtatatatcttggtaagtgtgtgactgcttctaatgatcaatccaaagatttatatgttttcttatgaaaatggtttctcatttatgagctgttatgggatgttcctaataatctgcagtcaacttaatagtttctgattaagcaaaaatgcatctctgacgtaggagtggaaattgttaatgcagtcacaacagaa

SEQ ID NO: 70805 - DNA, 601 bp, Human
tgtcttgagtttttttttttttttttttgccgtgaatgagttattcctgttccagaaggttatgtaaatggtattaaacagtatatattgttttgtaacttcttatgctcagcataacgttttaatggttcatccatattgttggtgtatcaatcatttgtttcattttattgctctcttgatagacattgaggttgtttccagtttttggtattatgaataaagcgtctataaacattcttgtacaagtgtttttatggagacaggtttttatttttcttggataaatactttgagttgtggtttatagggaagatgtctatttaaacttataagaaagtactaggcagatttccaaaatggttgtgcccttgtacacattggccaataatatatgacagttctgtttgtgtcctcttcaacatttggcattgtcagttgtgtgtatttgttttttagccattacagttagtatgtagatgtgacttatagtttcagtttgcacgtgcttgatgcctaatgattttgggcagttttttgttgtgcttattggccattcatgtattttcctttgtggagtgcctcttccattctttttgcc

SEQ ID NO: 70806 - DNA, 601 bp, Human
gatgcaggttagtggacagtgcatgcttgttcaggagatgcataatatgggctcttctttgtggtaaggtctgtttttgccagtcctgataaagtagatataagtgtaatgaaaacaggaaaggaatgggattttggcattaattggttaaattaggtattgaaattttattaaatctgagaaatatcttatagccccttggtgatacagttaagatgattgctcatctttgcttaagggaaagcttaataaagatgaaaattagtttaaacatttttcttaaacttctgcaggctgagcyatatatctgattttgtataatttatcacttatagaaatggaacttgagcaatataagaaatatagactaatatttctctgaacatttctaaggagtttgacttaatcttaacacagttataaacttaagtatcaaaattacattggacagaaaaatagatttgttggtcttttttgaaggttcattgaaaatatctcagtaattttaactactgctagtactaattaactcttatattttaaggaacccagtgacaatggacctctttttactgaattaaagttctaccaacgagctgca

SEQ ID NO: 70807 - DNA, 601 bp, Human
aatagatttgttggtcttttttgaaggttcattgaaaatatctcagtaattttaactactgctagtactaattaactcttatattttaaggaacccagtgacaatggacctctttttactgaattaaagttctaccaacgagctgcaaaaccagagcaaagtaagaaatacagtacacatacgtttacacttttaaaatgaccagttttttgttttaagccaagacctagagcattgtatcttattttatgactctttgttatttttttgctttataaattccacttacatgggatttgtrtgaaagaattctggtcttttaatgggtttgttgcatcaagattttatctatatagatacatagaatgaagttaataataaatgacctatgatttaggaaatattgttaaacattgagaattattgatgaaatagaacaggatatcaaggtagagagccagaacctctcctagtcactttggtcccttctgtccttcttccatgtctcttagatcttgatttcctggttgaggacttttatattgaggaagaaaaaccttttagattggtatgaaaaataggtcttcctgtagaagcaagt

SEQ ID NO: 70808 - DNA, 601 bp, Human
catattataagtaatctagagatgagataaagtatataagaggatgtgtggaggttatatgcagatattacaccattttatatgagggacttgagcatctggattttggtgtcttgaggggtgggggttcctggaaccaagcccctagaacaaaggaatgactgcactgtagttttgatttaaaaaaaatgctttttgtagatttttcattttaaagacaattttaagggcaggataacaattttgtaggttaataaaaatgttttcatcgtaaaatgcttttcgttattcgttatactgkattcttcattttcttttttatgaatacaggtgaattcttattgcatgtataaatacattttgctcttaatgattttttaaaaaattatcatttatgtataacaattgaaatcacaaagatctgttttaatttgtagttcagaaatggattcgtacccgtaagctgaagtacctgggtgttcctaagtattgggggtctggtctacatgacaaaaatggaaaaaggtaaaaatatgtgtgatttgtctttctccttcccttttgcaacattcactatttagttggtttagtcagtaattat

SEQ ID NO: 70809 - DNA, 601 bp, Human
gccttattagaataggagtgcctctctagtcagggagcttctgcagagcagtatcaactgactggaacccaactgacaaggaggaacaaagccaaacaccctgcctttttttcctccttgcctttagaaataaacaaacaaaaacgcctctgttcttcatgcaaaagggaaccccttcaggattccatttggtatttctgcccacacagaaatgttggatacataatctgcccacacaagattaggctcaccctttatgagggttttagtctagctggtgagtgaaaacaaaaatgtttgraacaattagagaacaattaagtgctaagttgtataatactgacttacgtgtcttaggagttcagagaatggagagaatgaattctttgggatagtttatttggagaaaacttctaatactttggttcataagcagcacttgatacatatttgaatgaatgaatggaacttcatggagtaaggctttggtagctgagacttgacgggtagatttagtttggaactggggatatattgcttaggatgatttcagctgcaagtaaaggaaaactttgactcaggcagtcatcaagggcccagg

SEQ ID NO: 70810 - DNA, 601 bp, Human
taaaatgtgtgtgaatttgggcaattttttgctttaatttcttcatctgtgaaatggagtaacagctacccacttaatgatgttttagtataaagctacaagagtatatgtaaaacatagatgttagcttttgctctcaaaggggtctttaatcgcttaaatgttaaaacctactggtttagaaaatcattgaagaggcagaacagcatcttaagtgggagatgaacgtgagcacaggcaggatagacttttattctactgtatgacccaatggccgtcttcctgtagcagaggaagaggrcatgtgtgtaagagagaaggaaataaacttggagaaggagtcggtggcagataatgaagacccatagaggaaagaacagtttggaacccatgtatagtaggtagtcagaagctatcacttgctcttgagcaagggatgaggtgacatggtggtgaaagtggcatttgggaaatggtttacatggtgaattaaagactgtctaaaggggagtaagacaagaaaaacccttagtgatgacttgctaggaagcaaatctgtttgactgtgtgctccagtatacaatagttatattcctaagga

SEQ ID NO: 70811 - DNA, 601 bp, Human
gtttagaaaatcattgaagaggcagaacagcatcttaagtgggagatgaacgtgagcacaggcaggatagacttttattctactgtatgacccaatggccgtcttcctgtagcagaggaagagggcatgtgtgtaagagagaaggaaataaacttggagaaggagtcggtggcagataatgaagacccatagaggaaagaacagtttggaacccatgtatagtaggtagtcagaagctatcacttgctcttgagcaagggatgaggtgacatggtggtgaaagtggcatttgggaaatggyttacatggtgaattaaagactgtctaaaggggagtaagacaagaaaaacccttagtgatgacttgctaggaagcaaatctgtttgactgtgtgctccagtatacaatagttatattcctaaggaacagtacattatgaaaaccacatttcatagagatgattggaagaaaagtgtacctggggctagagcatttttagacttggaataacagccttttcctctttccataatttgagtataaacgtcttaaaaaaaaaaaaccaagcacggtatattgcagcaaaacctaaacaccaaac

SEQ ID NO: 70812 - DNA, 601 bp, Human
tcctgccaccgtgcccggctaatttttgtgtttttagtagagacggggtttcaccatgttggccaggctggtctcgaactgctgacctcaggtgatccaccagccttggcctcccaaagtgctgagattactggcgtgaactaccaggcccggccaccactgactaattttataaccttggacaaatcactttacctccaaagaccttagttattttatttattaaaagatgtttagacaagatgattttctaattttcttccagttcaaaaatgaatagaattctgagttacttgttcarcatcttgtcttttaatgttagtcaactcttccttccctattgaacttgtcatattgttatcatagaagcctataacatataaatgggatttttgtatcctactgacatttatttcagttaatatgtagtacaggggttaaaagcatgattttgccacatactagaggacaaattatcagttttcttctgctgtaaaatgggtatgataggagttacctactttatagagtgatgtgaggtttaaatgcattaataacgttttaagtacttacagtagtgctgtgtgcataccaggtgttc

SEQ ID NO: 70813 - DNA, 601 bp, Human
tagaagggaatctatataagtataaaagaagaaagttactatactattaagatagtgtgctaatggagaaatcttaaaaaggcaatcatcaaattcatctctgctctttctagccatttctttttagatatttctaggctaagaacaaagaaaacgcagctaacaacctgaacaataagggttccattaattgaaatagtctggacttgtacagtataataaaatacaacttatatcactttgtaggtgactaaaacatgctgcctttgtttatatggaaatatttttgcagctctgttayccttcagacatatgctttggatgggattatttttccagtgttagatgtatgtgctagatctagccacatatttttacttcagtttcctcttgtgcccagatgcatgcatttgtgacatttactcagaattagagatgtaatgtgtggctatggaatggaagaaagccaagtttattagctttgtatgctaatcagacccacatgtatatgcccacgaataagtatgtatataatattaaaatttacttttaatcatgaagacttggctttagaatatagtatttagatatagataaaagc

SEQ ID NO: 70814 - DNA, 601 bp, Human
gaattaagtatttgctgttgtttgcattttggatctaaattgtttggagtgttatggaatgaccttgtaggtgaacccaccttcagatgccagtattttgtttctgtgctttaaagggttatatgtgcagtgattttgactttagtttgtcttggtgcttggaaatttataggtgtacttggtagattatggccttgcttatcggtactgcccagaaggagttcataaagaatacaaagaagaccccaaaagatgtcacgatggcactattgaattcacgagcatcgatgcacacaatggygtgggtatgtcagtagtactggagtgagaaatagactgctaatgttttcacccagattcctacatagttcttaattatgcataagtaaatgaatagataaataaaaattgaaaaggcacagtggcatgaggaaagaaggcagaggtgagactcctacaattgtattccaggaccatctgtgttcttctgtcctgccttttcctcgcagccttcaaagataaccaagaaggtggtagtggttcattcagctgccatgaggatttctttttggttttatttagtttaattggaatgtttgtt

SEQ ID NO: 70815 - DNA, 601 bp, Human
caagagaagtagcagccaaagagtgagaattggtcagtctggatatattcagaagtctttctaagcctttgctcagttgtctccttttcagggaggtctatcctgaccttatgctatttaaaattgcaacctactccccatatcaataaatacaatgtgggtttctcagaattatcccatggacctcatagcaatcagtagcctctccctcctggccgaatgagtcacttaccttaatttccaacaccaaatatttgtgtttaaaatttatagaaatggagttaatacagtgaatgaaatrtgtaacaattcctgtcctcttgaaattattgtttacttctgttagtgtccttttctttcacttagtaatgtatttgtgaaattcatccccattatcgcatgtttttttttgttattgttgttgttttgtttttttgagacagggtctcactctgttgcccaggctagagtgcagtggcacagtcacagctcactgcagccttgacctcctgagctcaaagccttgacctcctgagctcaagagatcttcccacctcagtctctgaagtagctgggactacaggcacacgccaccacacct

SEQ ID NO: 70816 - DNA, 601 bp, Human
agtgaatgaaatatgtaacaattcctgtcctcttgaaattattgtttacttctgttagtgtccttttctttcacttagtaatgtatttgtgaaattcatccccattatcgcatgtttttttttgttattgttgttgttttgtttttttgagacagggtctcactctgttgcccaggctagagtgcagtggcacagtcacagctcactgcagccttgacctcctgagctcaaagccttgacctcctgagctcaagagatcttcccacctcagtctctgaagtagctgggactacaggcacaygccaccacacctggctaattaaaaatttttttttgtggacatgtggtctcactatattgcccaggctagtcttgaactcctgggctcaagcagtcctcctacctcagcctcccaaagtgttgggattgtaggcatcagccactgcccttggccctattattgtatgtttaacagtagtttcctcattgtcatttctatatgatattctattgtagttacataccattatgtatttattctgctcttaggtcgtctccaatttttggcagttgcagcttgccaattatgcatacagatgta

SEQ ID NO: 70817 - DNA, 601 bp, Human
tctttctagagtttctcttatttaaccattgttaaataaacccttgctggcacttagcctggaacagggtacaaagagttgaataagtgcaaagcccttccattgcaaatcagtagcctgcagctgctccggtggacagctttcttcctttctttctgaagggattgcacctcgtacagcctttataccattgtagcctatagtttcagtcgggttgccctgaatgtgctctaaatttggtgaaaatctatctagctgttttagcctgatacggtaataaagataaactgtattttaattrtataaattttagattgttgaagtacattcctgttttctaatggtttgatcatagtactgtagttaagtcgagtcagcatttgctaacaatttttttctttaggtctgttattgaattctttattttgaacttcttatttggctgaattttgtcaagtggacttttttgccctaattaagtgaagttgttacgtatgtatagaaaagtacatgaataagtacacttttacacaatactcatttaaacatcacccagatcaagatgtggatcattgccagaattagttttgcaatttttggg

SEQ ID NO: 70818 - DNA, 601 bp, Human
gtactggggttgctgcagcctagggcttacttatgttgagggtttgtagatattgccaattttccaaagctgctctctcagcttacattcttatcagtagcatggaggagttccagttgctcactgacactagctcttgcattatatttaatttctcctattttggtggacgtgcactgatttgtttatggttttaatttaatctccttgaaaaatattgatttgaaacatttttgtatgcctgccagccttgataatcctttttttttggtgaagtacatttcaaatcgtttgcctattkaaaaaaaaaaaattggggtcgttagctttcttttgatttgccagagttgaatactttgtatgtaaacaatgtatgtgttgcacatatcatcttccagttggtgtttaatcttttcactcttaatatggtatcttttaatgaatagaatctcttcattttcatgaagctcagtttatcagtctttatggttagtgctttttatattctatttgggaatattttgtctacttaggatcatgaagatatgttattttcaagaaagtttatcttatccatcacatttaagtctacagtttaaca

SEQ ID NO: 70819 - DNA, 601 bp, Human
tctccaacttttatttctttagcattgtctttgctattcttcgctctttgaatttacatacaaattttagaattggcttattagtttcctcaaaaatacttctaggattttgactaaagttgactttactctatagagcaattcggaaagaactgacatcttctcttccatagccatagtaggcccctatagttacttagatgttcttccatttatctcagtcgtgtttgtagtcttctgtgtctgtagagggaatacacaacatccatgtctattttcttataactgcttaattcttctrttttttttttttggattatctgtgattatacaaagtctttcctttatgtcatctgattgtcagatatgtttgctctgttttttactattcctaatatatataagttctgtaatgattgttttgtttagctgtgtggtttcattgttatccttttgtcttttaaatcatttcctctattttttaaaaaaagtaagtatttttaaatgtagttttttaagcctctgatgcattttataaaattttcttccttgggggaggactgttttctttcagaggtggagtcttcagctatcttttgga

SEQ ID NO: 70820 - DNA, 601 bp, Human
tgaaaaatttcagaatggtgtttgctcacattcttgaagtgtctgacaaacttcatggtcatcacttttcaaaggttatgctgcaaagctatgatacttctgtttgctgctgaaatatttcttaattgttattttgggttcattacttcagattttaggtggagggaagttgtgaagtcttaacctccaaaatgtctccactcattttttaacacattttaatttgtttatgtgtgtgaacatttaattagaatttatgttcttttctcacgagtaaacagagcttgtttttacttttacmctctgagccctccacaaaccatctctcatactgcagtcatctggaatttttagttctagttttttgtgtcatttgtatactatgtattattttttagagttaatcatgagtctaacgtattttgtgttttttgtttgtttgttatccatgtcctttctcttgactttatgtttcagagtatatgctcaatctttttttaaagaaagcttctggatggtaaacttgtaaatcttgggaagtccaaaaatgtctgttttttccccagttgaaaactaatgtggctatatagtttttaattga

SEQ ID NO: 70821 - DNA, 601 bp, Human
acagacatctacttccagtgatttcagaaatgagtgaaatttgtggccagatagcttgttttttaggtgccaggactcactgcttctccagtttctttttctggtccattaacacacaaatacctcagatcattttaatggaggtgcttgtgaggctgtgggtggcatccttagttgcatattataataaattcacctgggagcttttaagtatctgtgctgcaccctagaccaagtaaatcaaaagctataagggtgggaccgtcgggatttttaaaaaacttcctaggtgatttcattrtgcagacatagttaagaaccactgcatattaaaatttgagtgtctgaatagcttctgtgcagaaaacagcccttttgtaaataggcatagcaaatacagggcattttagactttacattgtagcatttatcagccccatgaccagcttttgcatgtgggcagtgatgcacacatactattttttgatctctgtatatataagtactttactataagtgatacagaaggaaatttggtgtcatataaatgtcttgaatggtgcccagcagaatttcttgaagtaatgaaaggacatgctta

SEQ ID NO: 70822 - DNA, 601 bp, Human
ttaaaagttcagtttatgaaacagggtattaggcacatgtgaatgaagactgggttatattttacttagtgagtatgtgtgttaaaataggttgttttgaatagtaaacgattatgaattggtaaaagttgatttttgcagtgaaagacaagatgttaattactatgaaataaagactaaaatgtagctccatcttgttaaggcagaatataaacagattttttaaataagtaaaatatagctccataccttttaagaacatataagtcaaattaatgagtttgtagttatcccttttttytcttaagctaaataattgatacgagaagataatagtacttgacataaagcagaggagtcctgaccaccagagaattctgtgtctgccattttctgcctgcgtgtttaggaattaggtgttttgtggacataagtttattgagggaagatcaggtagtatgtttttaatagtaactctaatgtagcccaatttgttctgtaatacgcttgttcatgtgttgccttgagattagttaactccccaccagtatatatataggttttggttttcattgatgtatttataaagattagcctcctt

SEQ ID NO: 70823 - DNA, 601 bp, Human
ttgttcatgtgttgccttgagattagttaactccccaccagtatatatataggttttggttttcattgatgtatttataaagattagcctccttagtttatagtattatattaaatagttttcaaaatcttacatttttaattcttgagcattcctcagaagacttgattgtgctcagtacaggtaataggatattgaccctttaaactttaggttatcactgagcatttatgtagtttctatattctttcaggacctttaaattattttttataacttttgcagcatgcctgtgaaatayatttgttcataaatgatgggactaaaactcagaagaggccaggtgacttgttcagggctgtgaaatcattattattatgcatttatatagaaagttcaaggcatcctagtgattttaggcataaaatattaaagataattaaagcatgacccggccactcatttgccttttcccataaattgtacttgaaccatcttaactttgccaaaagttttcgaccttaatggtgcatgtcatggaaccctcagaggaaaacatgagtgaagagatgtgacattgactttaatctagaatagaata

SEQ ID NO: 70824 - DNA, 601 bp, Human
tcactgagcatttatgtagtttctatattctttcaggacctttaaattattttttataacttttgcagcatgcctgtgaaatatatttgttcataaatgatgggactaaaactcagaagaggccaggtgacttgttcagggctgtgaaatcattattattatgcatttatatagaaagttcaaggcatcctagtgattttaggcataaaatattaaagataattaaagcatgacccggccactcatttgccttttcccataaattgtacttgaaccatcttaactttgccaaaagttttcsaccttaatggtgcatgtcatggaaccctcagaggaaaacatgagtgaagagatgtgacattgactttaatctagaatagaatacactgacatattagtcttctagaccgtagttcattgaatctctggaaacagctttcgtcttgttaactgactatacgtttgatcatattaaagtttcatgatctccttgtaacatgaatgatgttagaatcatgaaaagccattgctgccaacaagttggaagttgaatttacggttttcaaaagtgtcattaggagatttttctaggttgtgcttg

SEQ ID NO: 70825 - DNA, 601 bp, Human
gtatcagtattttttggcacattcatataaattacctgtaatttttggtgtgctattttttgatagttacagtaaattcttaatttttcatggtattgtaagggtgggataccttgaactagtgaagaacatagatattccaaactttgtgtgccatatatttaatcattttattttgctaaccttgttccttcagacctgttaattagcaaaattgcttgagttgtacttcctttctatctccagagtaggtaactaaaaatgttgacaggagagagatctaaatttaaacaagtagacracaacaacaaaatcaagggtggactgtgatgtaatgtgtgtgttacatttcatatggattgatacttcaatgaatgaatttccatgttagtgggattacactggacacttatgtaagaacactcatttatggaaccctaaaaggatttcttatagtgcttatagcaaaacaaatagttgcagaaattaaacgtgtgtgtatttaatgtttttataaaagatgaagtttctcttttgctttaactattttatagtgtctatttttcagcttgaaaatgacagtgccaggcacacagtagat

SEQ ID NO: 70826 - DNA, 601 bp, Human
tgctattttttgatagttacagtaaattcttaatttttcatggtattgtaagggtgggataccttgaactagtgaagaacatagatattccaaactttgtgtgccatatatttaatcattttattttgctaaccttgttccttcagacctgttaattagcaaaattgcttgagttgtacttcctttctatctccagagtaggtaactaaaaatgttgacaggagagagatctaaatttaaacaagtagacaacaacaacaaaatcaagggtggactgtgatgtaatgtgtgtgttacattacatatggattgatacttcaatgaatgaatttccatgttagtgggattacactggacacttatgtaagaacactcatttatggaaccctaaaaggatttcttatagtgcttatagcaaaacaaatagttgcagaaattaaacgtgtgtgtatttaatgtttttataaaagatgaagtttctcttttgctttaactattttatagtgtctatttttcagcttgaaaatgacagtgccaggcacacagtagatgcttaataagtacatggtggtgatcttcacctctgttcagatggaggtca

SEQ ID NO: 70827 - DNA, 601 bp, Human
ggttttattttggttttttaattggtctgtagaccactggccctttctatgcagactacgtacattattagaaaagttgggcaggagttacctggctgaagtgtggattaatgcagtagagtgctttacgtaatgcatactgcttaaagcacaggtgtttcttttgttggttgaatactgtctgattttccttcctatgtaatttacctgcatggagattaagaaagcccccttttattaaataagcttgaaaactagatgaatgcacttaggttcttgggtagaatgtattggatagctrgctccctttatgatgagcatttaaaaatctgctctccaaaaactgggaaatgcattctctgctgtatggaaagcaatatagtactgaaatattcctccttaattttggtctgaacaaacaaaagtgtctgtgtttattcttgcctaatgcatcacaaatctgctgacatgctaaccttggagtcttggctggcgttaatcaggcctgtgcaccggcaggaaagatgtacctaatgcactccatcagtgcagtttgcatatggaagttctcacaggggagctgccctgtgccagctgaggg

SEQ ID NO: 70828 - DNA, 601 bp, Human
agagatgttagagaatttagaaacttaacgcaggattggacctgttagaaaatgttgtagtggtagaaacacataaaatgaaattgaaggaacatttgggaagaatggatggtgacagaatataagcactgactcctaaataacacttcactagaaaaataggacaggcccaagagaatgtaggaaatccagacgatttttgagattttcggagagctttgtacttttaagactattcatgtacagtaaggtttatggccctcttaaacttttaataaaaagtatgctaaaagagaaacawttattacaagtttttcattattgattcataaatagaattctaccaccaatgttatgtggtacaaacactgatttaataaatggggcaagacatacattttttccatttatcaaatagattatcctctccaccccacccatgttgtacaatgtggagagtatcattggcctgagtggtgatcgtgagtttgtaaaacattttgttttaaaagagtttctgtatgattagtcctgatggttaaaccatagctttgaataatgaagtatataaagcatgaaaagttagaggtggatataacaa

SEQ ID NO: 70829 - DNA, 601 bp, Human
aaccccatctctaaaataaataaaataaatgactgagctgttgtgaaagggttagtgatagagaccagaactcttaactgtcaggccaatgtctttccacttcctcacactgatcccacataactctgggtatgatagtgagtgtcaggggtcagacatgggtctgttgcagctgagctgcctgattgttccttataaagtttgtcaacctcttcttttttttgaacaagttaagaggaaaggaattaaagctttatggatgatcacttttcaaagttcttgaagcaaaaaaaaaaaaaaacacaaaaaaacaaaaaaaacaaggtatgaagtcatttttctgagatggcttataaactggcactgaaggcacttccaatagttccagaaatgacattagcaaaggcagcatctgcaaagggcagagctaggttggactttggtctgatatgtttaataaactgccagccaatgtgttccaggattcatgtgatatgatgatgtacttgactcaataaagagagctattcagtgtggcccacaatacatttttttaaaaagatttttcctgtctgcctttttttttttttgaattattatt

SEQ ID NO: 70830 - DNA, 601 bp, Human
taaagtttgtcaacctcttcttttttttgaacaagttaagaggaaaggaattaaagctttatggatgatcacttttcaaagttcttgaagcaaaaaaaaaaaaaaacacaaaaaaacaaaaaaaacaaggtatgaagtcatttttctgagatggcttataaactggcactgaaggcacttccaatagttccagaaatgacattagcaaaggcagcatctgcaaagggcagagctaggttggactttggtctgatatgtttaataaactgccagccaatgtgttccaggattcatgtgataygatgatgtacttgactcaataaagagagctattcagtgtggcccacaatacatttttttaaaaagatttttcctgtctgcctttttttttttttgaattattattttgtttgtcctgaaatatttcttggttgctaacagaaaaggcttatttttggttaaaaaaaaattttacagcataggtgccatattgagtaatgccaccaatttattttaccttccttttgctagtgacattagtgcatgtttgtggaaagcacagtattcaactttcaaagagaatcatttttgccctgatttt

SEQ ID NO: 70831 - DNA, 601 bp, Human
ttctgattggaccctttgccagtagtgtatattatgaaaatggttatatatttaattaaagagataagaaggtagttttttttgtaacaatcagaattgattattagggaaaatattgaattgatttatgcagcaaagtcaacaaggtgcgtaggactgattatataataaattccaggcagtagtagcccttttagttgcagtgagaaactttggattgaaggagatgagcagcagtgatatttaatttcagagtaaaatggcaaattaagacattaatgagaataatgctatttgaatrtaactttatagttgttaatttagtgttctttgtagtgtggttaaagatttaaaatgtgttgaaagggagatatagtattgattattgaccttgattttgtaataccctttatgccagtctcactatcgcagcattttcagttttctgtgcagaattaatttcaaatttcttgaaataggccgggcgcagtggctcatgcttgtaatgccagcagtttgggaggctgaggcgggtggatcatttgaggtcaggagttcgacaccagcctgaccaacatggtgaaagtctaagtcctactaa

SEQ ID NO: 70832 - DNA, 601 bp, Human
tagtagcccttttagttgcagtgagaaactttggattgaaggagatgagcagcagtgatatttaatttcagagtaaaatggcaaattaagacattaatgagaataatgctatttgaatgtaactttatagttgttaatttagtgttctttgtagtgtggttaaagatttaaaatgtgttgaaagggagatatagtattgattattgaccttgattttgtaataccctttatgccagtctcactatcgcagcattttcagttttctgtgcagaattaatttcaaatttcttgaaataggccrggcgcagtggctcatgcttgtaatgccagcagtttgggaggctgaggcgggtggatcatttgaggtcaggagttcgacaccagcctgaccaacatggtgaaagtctaagtcctactaaaatacaaaaattacctgggcgtggtgacaggcacctgtaatctcagctactctggaggctgaggcaggagaatcacttgaacccaggaggcggaggttgcctgagccaagatcgtgtcactgcactctagcctggcaacaaagcgagactccctctcaaaaaaaaaaataataataataaaa

SEQ ID NO: 70833 - DNA, 601 bp, Human
agggccagcctttgatggttacccatgccttagagtggccaaagccacaagaactgaacccagatcttggagaagggtgaaagtggttctccccagggcataattttctatcatttggatgaagggaaaaggaaattcatcctagggcattttaaggataagggaatgaggctcagtgatatgactcaagaaatatcccagaactaagcaaagaggtcactgaaatccaggtgtcctgtggttttcttcccttcactcaagatgcctgataatgctgcttaattcaccacattagctccayaaataaaggggaaaactgctttttaaaatacctctatgacagcacttctcaaaatgtggtacaggaactcctgcactgaatttccaaggcacttgtgaaaacacaggtttctaagctcacatcagattcactgcaccagaatctctgggagtaggactgcatagtcagtactgtcaatatacaataatcagaaggctcaggatccagttaaaagagtttattcaacaaaaagttgagggcagcagtcccaggagtagagctgcacccaagaatggtgaacagtacttccagtgtagagaa

SEQ ID NO: 70834 - DNA, 601 bp, Human
taagggaatgaggctcagtgatatgactcaagaaatatcccagaactaagcaaagaggtcactgaaatccaggtgtcctgtggttttcttcccttcactcaagatgcctgataatgctgcttaattcaccacattagctccataaataaaggggaaaactgctttttaaaatacctctatgacagcacttctcaaaatgtggtacaggaactcctgcactgaatttccaaggcacttgtgaaaacacaggtttctaagctcacatcagattcactgcaccagaatctctgggagtaggacygcatagtcagtactgtcaatatacaataatcagaaggctcaggatccagttaaaagagtttattcaacaaaaagttgagggcagcagtcccaggagtagagctgcacccaagaatggtgaacagtacttccagtgtagagaaaaatgaggactgtttacataggcaaagacagaggtgttcaacagaatgacaacttctcttgttgttgttgtttttgttgttgctgttgttgtttttgagacagagtctcactctgtcacccaggctggagtgcagtggcccgatcatggctcactgca

SEQ ID NO: 70835 - DNA, 601 bp, Human
ccaggtgtcctgtggttttcttcccttcactcaagatgcctgataatgctgcttaattcaccacattagctccataaataaaggggaaaactgctttttaaaatacctctatgacagcacttctcaaaatgtggtacaggaactcctgcactgaatttccaaggcacttgtgaaaacacaggtttctaagctcacatcagattcactgcaccagaatctctgggagtaggactgcatagtcagtactgtcaatatacaataatcagaaggctcaggatccagttaaaagagtttattcaagaaaaagttgagggcagcagtcccaggagtagagctgcacccaagaatggtgaacagtacttccagtgtagagaaaaatgaggactgtttacataggcaaagacagaggtgttcaacagaatgacaacttctcttgttgttgttgtttttgttgttgctgttgttgtttttgagacagagtctcactctgtcacccaggctggagtgcagtggcccgatcatggctcactgcagcctcagactcctgggctcaagggattctcccacccagcctcccaagtagctgggactataggagcac

SEQ ID NO: 70836 - DNA, 601 bp, Human
agaaggctcaggatccagttaaaagagtttattcaacaaaaagttgagggcagcagtcccaggagtagagctgcacccaagaatggtgaacagtacttccagtgtagagaaaaatgaggactgtttacataggcaaagacagaggtgttcaacagaatgacaacttctcttgttgttgttgtttttgttgttgctgttgttgtttttgagacagagtctcactctgtcacccaggctggagtgcagtggcccgatcatggctcactgcagcctcagactcctgggctcaagggattctccyacccagcctcccaagtagctgggactataggagcacgccactatgcctggttaatttttttgtattttagtagcaatggggttttgccatgttggtcaggttggtcttgaactcctgaccttaagtgatgcacccaccttggcctcccaaagtgctgagattacaggcgtgagcctccgtgcctggccaacattttccatacagaggctaacatacagatatacaatttgattggctactattgattacagtccaagggaattgcttaatattcttttgtaaagaggtaacatggctggc

SEQ ID NO: 70837 - DNA, 601 bp, Human
gcaatggggttttgccatgttggtcaggttggtcttgaactcctgaccttaagtgatgcacccaccttggcctcccaaagtgctgagattacaggcgtgagcctccgtgcctggccaacattttccatacagaggctaacatacagatatacaatttgattggctactattgattacagtccaagggaattgcttaatattcttttgtaaagaggtaacatggctggccgcagtggctcacacccataagcccaacactttgggaggccgaggagggcagatgcttgagctcaggagttgragaccagcctgggcaacatagtgagaccccgtctgtactaaaaatacaaaaatcagccaggcgtggtggcacgtgcctatagtctcattgactggagaggctgagatgggaggatcgcttgagcctgggaggcagaggttgcagtaagctgagatcgtgctactgcactccagcctggatgacagagtgagatcctgtctcaaaaaaaaaaaaaaaaaaaaaaagtaacaatcaaaagggtctctatttccataacatgaggtctacgttttaataaagactaggttgtctgaggccggg

SEQ ID NO: 70838 - DNA, 601 bp, Human
tcccaaagtgctgagattacaggcgtgagcctccgtgcctggccaacattttccatacagaggctaacatacagatatacaatttgattggctactattgattacagtccaagggaattgcttaatattcttttgtaaagaggtaacatggctggccgcagtggctcacacccataagcccaacactttgggaggccgaggagggcagatgcttgagctcaggagttggagaccagcctgggcaacatagtgagaccccgtctgtactaaaaatacaaaaatcagccaggcgtggtggcaygtgcctatagtctcattgactggagaggctgagatgggaggatcgcttgagcctgggaggcagaggttgcagtaagctgagatcgtgctactgcactccagcctggatgacagagtgagatcctgtctcaaaaaaaaaaaaaaaaaaaaaaagtaacaatcaaaagggtctctatttccataacatgaggtctacgttttaataaagactaggttgtctgaggccgggcacggtggtgcaaggctataatcccagcactttgggaggccaaggcgggcagatcatgaggtcaggagttcg

SEQ ID NO: 70839 - DNA, 601 bp, Human
tacaggcgtgagcctccgtgcctggccaacattttccatacagaggctaacatacagatatacaatttgattggctactattgattacagtccaagggaattgcttaatattcttttgtaaagaggtaacatggctggccgcagtggctcacacccataagcccaacactttgggaggccgaggagggcagatgcttgagctcaggagttggagaccagcctgggcaacatagtgagaccccgtctgtactaaaaatacaaaaatcagccaggcgtggtggcacgtgcctatagtctcatygactggagaggctgagatgggaggatcgcttgagcctgggaggcagaggttgcagtaagctgagatcgtgctactgcactccagcctggatgacagagtgagatcctgtctcaaaaaaaaaaaaaaaaaaaaaaagtaacaatcaaaagggtctctatttccataacatgaggtctacgttttaataaagactaggttgtctgaggccgggcacggtggtgcaaggctataatcccagcactttgggaggccaaggcgggcagatcatgaggtcaggagttcgagaacagcctgaccaac

SEQ ID NO: 70840 - DNA, 601 bp, Human
cctatagtctcattgactggagaggctgagatgggaggatcgcttgagcctgggaggcagaggttgcagtaagctgagatcgtgctactgcactccagcctggatgacagagtgagatcctgtctcaaaaaaaaaaaaaaaaaaaaaaagtaacaatcaaaagggtctctatttccataacatgaggtctacgttttaataaagactaggttgtctgaggccgggcacggtggtgcaaggctataatcccagcactttgggaggccaaggcgggcagatcatgaggtcaggagttcgagamcagcctgaccaacatggtgaaaccccgcctctactaaaaatacaaaaattatccaggcatggtggtgcacgcctgtaatcccagctactcaggaggctgaggcaggagaatcacttgaacccgagaggcagaaattgcagtgagactagggagtctggttaacatgtaacccctcaccacacaggtcaaagagcaacagtcatgcacctgagaaaaaaaacagtcacgttacgtgagtcagttttcagggcttaactttgcctcttgacataacacatttggaagcttctaaaattttat

SEQ ID NO: 70841 - DNA, 601 bp, Human
gctgagatcgtgctactgcactccagcctggatgacagagtgagatcctgtctcaaaaaaaaaaaaaaaaaaaaaaagtaacaatcaaaagggtctctatttccataacatgaggtctacgttttaataaagactaggttgtctgaggccgggcacggtggtgcaaggctataatcccagcactttgggaggccaaggcgggcagatcatgaggtcaggagttcgagaacagcctgaccaacatggtgaaaccccgcctctactaaaaatacaaaaattatccaggcatggtggtgcacgyctgtaatcccagctactcaggaggctgaggcaggagaatcacttgaacccgagaggcagaaattgcagtgagactagggagtctggttaacatgtaacccctcaccacacaggtcaaagagcaacagtcatgcacctgagaaaaaaaacagtcacgttacgtgagtcagttttcagggcttaactttgcctcttgacataacacatttggaagcttctaaaattttattttctttttacagtgcctttttacaactttcaaaccacagttttccaaatctgtctggaacatgttcctggc

SEQ ID NO: 70842 - DNA, 601 bp, Human
gaggcaggagaatcacttgaacccgagaggcagaaattgcagtgagactagggagtctggttaacatgtaacccctcaccacacaggtcaaagagcaacagtcatgcacctgagaaaaaaaacagtcacgttacgtgagtcagttttcagggcttaactttgcctcttgacataacacatttggaagcttctaaaattttattttctttttacagtgcctttttacaactttcaaaccacagttttccaaatctgtctggaacatgttcctggcgtgagtgagctcagttctcacagattstgtttcagtttcccctcaagagggatcttgatagggttccatcagtttcactttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgaggtaaatagtccctgcttctctgataggaaacagaatttcttatgtacaacttcctgacttatgctatttcagtgtttgcttagagatgaaatatgcatttatcta

SEQ ID NO: 70843 - DNA, 601 bp, Human
tgagactagggagtctggttaacatgtaacccctcaccacacaggtcaaagagcaacagtcatgcacctgagaaaaaaaacagtcacgttacgtgagtcagttttcagggcttaactttgcctcttgacataacacatttggaagcttctaaaattttattttctttttacagtgcctttttacaactttcaaaccacagttttccaaatctgtctggaacatgttcctggcgtgagtgagctcagttctcacagattctgtttcagtttcccctcaagagggatcttgatagggttccawcagtttcactttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgaggtaaatagtccctgcttctctgataggaaacagaatttcttatgtacaacttcctgacttatgctatttcagtgtttgcttagagatgaaatatgcatttatctaattcaagcataaatctgccttaccaattcatgcatttttatt

SEQ ID NO: 70844 - DNA, 601 bp, Human
cagcttttcagaactgcagggaaacagccatcatgaggtaaatagtccctgcttctctgataggaaacagaatttcttatgtacaacttcctgacttatgctatttcagtgtttgcttagagatgaaatatgcatttatctaattcaagcataaatctgccttaccaattcatgcatttttatttctgtagctctttgtgatgtatagagttaggcagccaaaggacacagggaaatgggagctgggagctgggaagggacggggcatattgagagatcctagagagcccatgctcagatsctttcaggtaaaatcgggccagtgaaagctggggcctggagggaagttactggaggttctggttcgtcttttgtttcttatatttagaaagcctaagtcagaggtttgtggttttgttgtgactgtggttatttttaaaccatgcttgcttctcagcaaatgtgtcaataattaattcagcactgcaaaattccaatttatgttgaggtcacttttaccttgaaatgcactttttcataattgggggatatgtctacttgagttgtcctctagcaggtctagtgacctgctaagcctccc

SEQ ID NO: 70845 - DNA, 601 bp, Human
gataggaaacagaatttcttatgtacaacttcctgacttatgctatttcagtgtttgcttagagatgaaatatgcatttatctaattcaagcataaatctgccttaccaattcatgcatttttatttctgtagctctttgtgatgtatagagttaggcagccaaaggacacagggaaatgggagctgggagctgggaagggacggggcatattgagagatcctagagagcccatgctcagatgctttcaggtaaaatcgggccagtgaaagctggggcctggagggaagttactggaggtyctggttcgtcttttgtttcttatatttagaaagcctaagtcagaggtttgtggttttgttgtgactgtggttatttttaaaccatgcttgcttctcagcaaatgtgtcaataattaattcagcactgcaaaattccaatttatgttgaggtcacttttaccttgaaatgcactttttcataattgggggatatgtctacttgagttgtcctctagcaggtctagtgacctgctaagcctcccacgtgatcaatgaacagggagaaggtgttgcttgcagtctctcaaactgtgttctgcg

SEQ ID NO: 70846 - DNA, 601 bp, Human
gtatagagttaggcagccaaaggacacagggaaatgggagctgggagctgggaagggacggggcatattgagagatcctagagagcccatgctcagatgctttcaggtaaaatcgggccagtgaaagctggggcctggagggaagttactggaggttctggttcgtcttttgtttcttatatttagaaagcctaagtcagaggtttgtggttttgttgtgactgtggttatttttaaaccatgcttgcttctcagcaaatgtgtcaataattaattcagcactgcaaaattccaatttatrttgaggtcacttttaccttgaaatgcactttttcataattgggggatatgtctacttgagttgtcctctagcaggtctagtgacctgctaagcctcccacgtgatcaatgaacagggagaaggtgttgcttgcagtctctcaaactgtgttctgcgagtggcctgaatcatatcaacctgagtcttctaatagaatgcaaatttctaggtcctgcattctgaaatcctgattgagtaaaacagaaataaggtccagaaacaaacatatatttaaagaggaccacaagtacttcataggca

SEQ ID NO: 70847 - DNA, 601 bp, Human
aattgttccatgttatcattaaatgtctcagcctggccagctctcgcattggtaaagcattggtggggatggaatatccctgagagatccatattcagagctctttcacaagtccagaaatgttcagtgtgcttttctgcttgtccaacactttcttgagcaattgatatcttctgaagctgacacatgacagggtggaagtatgtttcatctcagagggagaatcttgagctataagtgcttaaaatttagtttggtaagatccctggtgcattgatatgtcaaagccttctgccctccaaaaaaaaaaaaaaaagagagagagatagtgtcatcagacttgcaaggtggtttccggtttcgttgaggcaaatacatccaacaatacatccaacatcacctgtcatcctgcaggtccactggatactctctattaattactagagtgttcagctatttttttcaggcacccatatgtacctacaaatctgcagatacattctattgatctgagactcacactttctccttttaaccttcctaattcacacatcagcaaagttaactcatgtttccatgactttattatgatttagtggca

SEQ ID NO: 70848 - DNA, 601 bp, Human
atcattaaatgtctcagcctggccagctctcgcattggtaaagcattggtggggatggaatatccctgagagatccatattcagagctctttcacaagtccagaaatgttcagtgtgcttttctgcttgtccaacactttcttgagcaattgatatcttctgaagctgacacatgacagggtggaagtatgtttcatctcagagggagaatcttgagctataagtgcttaaaatttagtttggtaagatccctggtgcattgatatgtcaaagccttctgccctccaaaaaaaaaaaaaaragagagagagatagtgtcatcagacttgcaaggtggtttccggtttcgttgaggcaaatacatccaacaatacatccaacatcacctgtcatcctgcaggtccactggatactctctattaattactagagtgttcagctatttttttcaggcacccatatgtacctacaaatctgcagatacattctattgatctgagactcacactttctccttttaaccttcctaattcacacatcagcaaagttaactcatgtttccatgactttattatgatttagtggcataacagatataagc

SEQ ID NO: 70849 - DNA, 601 bp, Human
ttcataactttttttctgaaattgtgcttgtctgtgaaatccaaaaataaggacacttggtttaatgatttctggaggttctttccaatcttatggtgccgtgactccactggtaagaaggaagaagcacaaactcaagagtgagggacatacagcccaagccccaggcaaatgtagataatgggaacacacttagagaactcttgcaatttatccagctaaataaggcaagtgatctcctttagtatcttccaactacaaaacaaaaatgagtccattttgtttgtttgttgcaacaaattcattctgtctgggaatctggcctgtgtggtggggagactacttcagtcagactcaagctgagcctccgtgggtctgtttgtaagtggtggaaaagatgaagggaaaaatacctaaatcacataacatgttggcagacatatctgggcttttatttctttacatgtctcctaacaaaactgaaagcacctggcgggcagagaaggttgggataatctctatttttcttagtatccataatatctaataaagtgacaaaaagaggtaccccaataaagagtcatgggatagctaaacaaac

SEQ ID NO: 70850 - DNA, 601 bp, Human
aatgagtccattttgtttgtttgttgcaacaaattcattctgtctgggaatctggcctgtgtggtggggagactacttcagtcagactcaagctgagcctccgtgggtctgtttgtaagtggtggaaaagatgaagggaaaaatacctaaatcacataacatgttggcagacatatctgggcttttatttctttacatgtctcctaacaaaactgaaagcacctggcgggcagagaaggttgggataatctctatttttcttagtatccataatatctaataaagtgacaaaaagaggtascccaataaagagtcatgggatagctaaacaaaccttacccagaatgtacaaggaatgagaactgacttggtattttttaatttttattcttacttttattttttttgaggcagggtcccactctatcaccctggctggagtgtaatggtgtgatctcagctcactacaacttttgcctcctgggctcaagtgatcctcctgtctcagcctcccgaatggcgaggactacaggcatgtactaccatccctggctaatttttgtatttttagtagaggcaggctttcgccatgttgcccagg

SEQ ID NO: 70851 - DNA, 601 bp, Human
acatgagatactcaacactttagtataaaataggctttgtgttaggtgactttgccccactgtaggctaatgtaagggttctgagcacatttaagctaggctaagctatggtaggttagatgtattaaatgcatctttttatttacaatgttttcaatttatgatgggtttatcaggatataaccccatcataagtcaaggaacatctatatataaagagatttattatgaggaattggctcacctgattatggagactggcaagtcccataatctgttgtctgcaagctggagaccaagraaagttgatggtgtagtcccagtccaagtctaaaagtctgagaaccaggtaagccaatggtgaaagttctagtccaagtctagtctaagggcagaaaaagaccaatgtcctagctcaagcagtcggtcagagggagaattctcccttcctctgcctttttgttctattaaggccctcaacagaatggataacgcccacccatactggggagagcaatctgctctactcagtccaccaattcacatgttcatgtcttccagaaacaacctcacatacatacccagaaataatgttggacca

SEQ ID NO: 70852 - DNA, 601 bp, Human
aagtcaaggaacatctatatataaagagatttattatgaggaattggctcacctgattatggagactggcaagtcccataatctgttgtctgcaagctggagaccaaggaaagttgatggtgtagtcccagtccaagtctaaaagtctgagaaccaggtaagccaatggtgaaagttctagtccaagtctagtctaagggcagaaaaagaccaatgtcctagctcaagcagtcggtcagagggagaattctcccttcctctgcctttttgttctattaaggccctcaacagaatggataaygcccacccatactggggagagcaatctgctctactcagtccaccaattcacatgttcatgtcttccagaaacaacctcacatacatacccagaaataatgttggaccaaatatctgggcatcctgtggcccagttcaattgacatataaaattaatgatcacagggtgcagtgcttggcagtgtacatcacagtgaccatgtttattttctccacagtgaggtcaccaagaattccctggagaaaatccttccacagctgaaatgccatttcacctggaacttattcaaggaagacagtg

SEQ ID NO: 70853 - DNA, 601 bp, Human; identical to SEQ ID NO: 22573

SEQ ID NO: 70854 - DNA, 601 bp, Human; identical to SEQ ID NO: 22574

SEQ ID NO: 70855 - DNA, 601 bp, Human
atttctcagctgatttaaaaaccattacttaggccgggcaagggggctcatgcttgtaatcccagcactttgggaggccaaggtgagcagatcgcctgaggtcaggagttggagcccatcctggccaacatggtgaaaccccatctctactaaaaatacaaaaatttgggcatggtggcacatgcctgtagtcccagctacttgggaggctgaggcaggagaatcacttgaacctgggaggcgtaagttgcagtgagctgagattgtaccactgcactccagcctgggcaacagagcgagwctccgtctcaaaaacaaacaaacaaacaaaaaatccattacttaatactgatttgtaaattttcccctcagtgctccagttggcaaaattttgaagaggtaaaaattccagaaaatgcacattacaggcctatgatgaaccctcctctgtaaacagatggagttggtactgataattaaaataataataatattaaatgttataaaggtagttatcacttcctgaattcgtattaagtgacagcctggcttctaaaagtgttatgtaaattattccatttaattctcaaaagatacttat

SEQ ID NO: 70856 - DNA, 601 bp, Human
atcacttgaacctgggaggcgtaagttgcagtgagctgagattgtaccactgcactccagcctgggcaacagagcgagactccgtctcaaaaacaaacaaacaaacaaaaaatccattacttaatactgatttgtaaattttcccctcagtgctccagttggcaaaattttgaagaggtaaaaattccagaaaatgcacattacaggcctatgatgaaccctcctctgtaaacagatggagttggtactgataattaaaataataataatattaaatgttataaaggtagttatcacttcytgaattcgtattaagtgacagcctggcttctaaaagtgttatgtaaattattccatttaattctcaaaagatacttataaggcaggtacttacacagtcatgcatcgtgtaacaatggggatacactctgagaaatgcagctgttaggcaatttcatcattatgcaaacatcaaacctagacggtatagcctactacacacctaggctataaacctgtgcagcatgttactgtactgaatactgtaggcaactgcaatacaatggcaagtatttgtttatctaaacatatttaaacatag

SEQ ID NO: 70857 - DNA, 601 bp, Human
aatttctaaggctgggcaatttctaaagaaaaaaggtttatttagctcacagttccgcagcccatacaagaagtatggtgctggcatcttctcagcttctggtgagggctttggtgctgtgtcaaaacacactggagaaggtcaaaggggaagcacatacaaagagggtctaaacccagggggcatcctcacattataacaacccattctcaaaggattaatccattcccccaagaaccaatccagtctcacaagaatgagaattcactcactactactagaatggcaccaggtcattcaygagagacctacctctatgatccaaacacatcccactagaccctacctccaaaattgtgacactagagatcaaatttccgtagatttggtggggacaatcaaactgtatccaaaccatagcacttgtcaatacttgttcacctattctccttttctaaaattattattgtagccaacttactgggtgagaagtgatagctcatggttttggttagcatttttctagtagctaatgatgttgagcatcttttcatgtgtttgctagtcctttgtgattcttctttggagaattgtctactca

SEQ ID NO: 70858 - DNA, 601 bp, Human
ttttgatctaattcatgtagtctagtggctacataatattctatggtatagatatacctttatttaaccgttccctattaatatttccagtttgttgctaatatatacagtgttggtaatgaatattcttgagtatacatccttatgtactggttatttttttctgggagatagattctgaggagtggaattactttgttgaaggaaatgtaattttaatgaccaccattaattttaattttgattttaaaattaaaattttaattttaattactatcaattttcatggctgtcatcagaytgatcttgaaggccataataatacatggcttcagaaattgtgtcctcatccatttaaactcttgccaatctgagtggaataaagttataaattattgcttctttaatttgcatttctctaatggctagaggcttagggcatcttttttctttttatagagacagggtcttactatgttgcccagactgatcttaaacttctggcctcaagcaaatctcctgccttggcctcccaaagtgctaagattataggcatgagtcattgtcttgatccagagcattttttttcatatttattggc

SEQ ID NO: 70859 - DNA, 601 bp, Human
agaacagctgaaggcagctgttctataactctgaggcagagggcaaggagtaggtacaagggagtgtgggggaatgtatcttaaacaggcttgtttatttatgttgaccaggaactgacctttgatcatccacatgcgtgatgttccctgaaaggggaacaataaatgttaattccctacaggttgtgttggctccaggttttcggcattgtgcctgcactgaataaaagtaagcagctccagcttctcggggatgttctctggccactagagccaggcagtcacctagctgctcttacaytgcatacctgtgtctgagtactcatttcatccatcagccagggtctgtgggacagacccggcaccctagtccctgttaatcactattttactttctgtctttatgaatgtgcctactctaggtagcttatataaattgaatcatacaatattgtccttttgtgactggcttatttcacttaacataataccttcaaagtttatccatgttgtaacatgtatcagaatgtcttttcttttttaaggctgaatattccattgtatgtatataccacattttgtttatccattcatccatcaa

SEQ ID NO: 70860 - DNA, 601 bp, Human
atattaatcccctatcaggtacaagatttgcaaatattttccttcattctgtgatttgtcttatcactctgttgatagtatccttccatgcataaaagtttttaattttggtggagtccagcttaattatttttactgttattgcctgtgattttggtatcatatctaatgaatcactgccaattgccaaatccaatgttacaaagctttttcctttcttctgagttttataattttagggcttacatttaggtctttcatccattttgagttaatttttgtatatggcataaagtaaggktccaactttaccctttttcatcatatatccagctttcccacaccatttgttgaaaagaccatcctttccccattagatggtcttgtcattcttattgaaaatcattccaccattgttatggaatgaattgtgcacttcccacccacccctgcccaaaattcttaagttgaagccttaaccctcttatgttgaactgttgtttggagatagagtctaaaaagaggtaataaaggttaaataaaatcgtaagagtgaggccttaatccaacagagctggtgtccttagacaccaaagctcac

SEQ ID NO: 70861 - DNA, 601 bp, Human
tcattctgtgatttgtcttatcactctgttgatagtatccttccatgcataaaagtttttaattttggtggagtccagcttaattatttttactgttattgcctgtgattttggtatcatatctaatgaatcactgccaattgccaaatccaatgttacaaagctttttcctttcttctgagttttataattttagggcttacatttaggtctttcatccattttgagttaatttttgtatatggcataaagtaagggtccaactttaccctttttcatcatatatccagctttcccacaccatttgttgaaaagaccatcctttccccattagatggtcttgtcattcttattgaaaatcattccaccattgttatggaatgaattgtgcacttcccacccacccctgcccaaaattcttaagttgaagccttaaccctcttatgttgaactgttgtttggagatagagtctaaaaagaggtaataaaggttaaataaaatcgtaagagtgaggccttaatccaacagagctggtgtccttagacaccaaagctcactctctctctctctgtgccactgaggaaaggccacttaaggatg

SEQ ID NO: 70862 - DNA, 601 bp, Human
caccaaagctcactctctctctctctgtgccactgaggaaaggccacttaaggatgcagcaagaaggagccatctgcaatccaggaagaaattccttgccaggaaccaaattggttgtcaccttcatctaggacttctagcctcgagaactgtaagaaaataaatttctgttgtttaagacacccactctgttatattgagttatgacattctgagctaactaatacagtcagataagtaagggtttttttcagggctttctattctatttcactggtctatacatctgtctttataccawtgttgtaatattgtgattactgtagctgtgtagtaagttttgaaatcagaatgtgtgagacatccaactttgttcttctttttcaagattgctttgactatttgagatcccttgacatttcatatgaattttaggttgaatttttctatttctgcaaaaaatgtcattgggatttttattaggattgcattgaatttgtagatcactttgggtagtattgacatcttaatattatgtcttctaatccacgaacaaaggatgtccttccatttatttattgcttctttaatttctttcagc

SEQ ID NO: 70863 - DNA, 601 bp, Human
agcatcttacctcattcctgatcgtggaggaaaagctttccctttttcaccattgaatatgatactagctataggtttttcatatatggctttaattgtgctgagatagttcccctgtattagtagtctatagtctgttttttttttcataaagggtgttgaattttgtcaaatgcttttcctgcatcaattgagatggtcatgtatttattcccttcattctgttaatgtggtatattacattgattaatttttgtatattgaactatccttttatatgaaagtctccatttagatgactttttttttttttttgagactgagtttctctctgttacctaggccagagtgcagtggcgcgatctcagctcactgcaacctctgcctctcagactcaagcgattctcctgcctcagcctcccaagtagctgggactacaggcatgcaccaccatgcccacctaattttttttttgtatttttagtagagacaggatttcaccatgttggtcagctggtctcaaactcctgacctcaaatgatccacctgcctcggcctcccaaagttctgggattacaggtgtgagccaccgcacccagcc

SEQ ID NO: 70864 - DNA, 601 bp, Human
tagactgtgaggaaggatgggccttgctgaagtgtggaggaaaaaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggt

SEQ ID NO: 70865 - DNA, 601 bp, Human
tttatctatggttttcatagataaacataaagcaataagttagttgctttaaaaaaatatatagctcaggtgtttctcttcattcaagtgtgaaaggcacagcagtcccgagtcttaggggcacccaccgcagccacatcaccgcgctgggacagatgcagtccgcagcgttcccagtattttgtcccagtgtgtaaagtacggagcgaagttgcagttaaagtgagagtgatgcaggtcgtggtgcaccacacccccgtaccacccgaagggcaccagtctgtgagtggaccaagggaarttgtagccggagtggtcctccacggaaagccagatgttgaccacgtggaaggtcagggtggtgagcgggtggcacccgagcagtgtgacgttcatcatgtcgaagaagcccaaagaaaacagttcccagacgctcatatactgcgttgccagcgcgaacgaggacgagttctggtggtgcaccttgtggaaggtgcggtacagccagggcaccttgtggtgcagcaggtgccacacgaagaactccatgtcgaagagtagcaggcagaacaggatgtggtgcagcagcaggagcagctcg

SEQ ID NO: 70866 - DNA, 601 bp, Human
gacagcagcccagcagcctgtgtgattttgataatgccccaaatattttgtcataataacagcttctccgtggcgagagcaacttgttagaagctgcaaatccaagaagccctctagaaaggcaggcagggctaggagcttccccacattcctgagaaatttgaggagatggacgtcagcctggaagaaagtaaaatacgaaataaatgagcaggactgtcgggcgggaaggcggttaatttgatcttagttctgccgcagaggggatcggactggtttgagggacccagccccctcaggyccttctccctcgccgcggcccagccccctcgcagcctgagtgggggctctgcaggctctgggtgtctgcagccagcgccgatgtttgccgtccacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtaccaccgcggcggccgggaggagggcgaggcaggccg

SEQ ID NO: 70867 - DNA, 601 bp, Human
tgtattacctcaatatgtagttgctttcctttgctagtgcataaaagtagtgaattactttgataattttagagtgtgaaatatattctttttccttgagtttgaaattactgtgtcctttatatggaatgcgctcttattataatttagaatactttttatggcccaatctcagaagttacacaggtttccctccagtgaacacagcttctgctcaaattcaaggggaggggactgagtcttcacttcttcatgagagcgtgggcaagattcttagaagagcacgtggaatgggagataytgttgtggccatctttggaaaagacaatctgccacagcccgttttgtgggaaagaatggtatcataaagaagtcgaatacaacttaatggttttgcaagagatgtgtattttgtggacttcaatttttttctcattgtttttctgttttgcacagtacttacatagcaatttcactgaacgcttagcgcttatttttcattattcatcttaggatctcaggtttcttatcagtcatttctccagggctactgttagtaacttactcttttatggtgcggattactctttatagtttcttg

SEQ ID NO: 70868 - DNA, 601 bp, Human
ggaaagaacagtactgcaaacatgcctatgcttgtcttttggagccactaaccgtgaacaccataccacaacttatccaccccttcttttcctctctccctctcgaggaagtaattggtttttacataatccacaaagatttcatttttcaggtacaaaggaaaatttggtagcttaattactttattcctttatcctaaggggtgtctttttcttgtaacatctttcctatgttttttggggggaagtagcatctatgacttgtcttggaatctgtaggacatctgaaagattttttttwaaaatgtaatggttttttttttttttttttttttgagacagagtctctctctgtcgcccaggctggagtgaagtagcacgatcttggctcactgcaatatccgcctcctgggttcaagtgattctcctgcctcagcctcccgagtagctgggactacagctgcacgccaccacacccagctaatttttgtatttttagtagagacggggtttcaccatgttggccaggatggtctcgatctcttgacatcatgatctgcctgcctcggcctcccaaagtgctgggattacaggcgtgcac

SEQ ID NO: 70869 - DNA, 601 bp, Human
caatatccgcctcctgggttcaagtgattctcctgcctcagcctcccgagtagctgggactacagctgcacgccaccacacccagctaatttttgtatttttagtagagacggggtttcaccatgttggccaggatggtctcgatctcttgacatcatgatctgcctgcctcggcctcccaaagtgctgggattacaggcgtgcaccactgcgcccaacctttattatatagtaaatttgggtgagaattatgaagattgttgaaggttcacttagatattttcatagtaatctctggctytcttttccctattcaagtttaaatgaagcgtatggcatgattgggaaactgattgtgtctatatttttgaatatccccactaagacttttggcattgtgagtgcaatttctgttttatttttgtattcctagcatctaaaatatatccaggcacaaagttcagtaaatacttattgaatgaatgtataattgaatgtcaccaatgatattcataatagagtttcccatgagttctaaaataggttgttggcgatgctttcaaacttgctgcttattttattttggtgactttgacttttt

SEQ ID NO: 70870 - DNA, 601 bp, Human
ttctgttattatatccaatctaataaaaagttgattatatggtatcgaaaactaattcattttgcttccagtttctttgaagtttgcagcctcctaagattcccctaaatcaacaatgtaatggaggactttattcccctaaatcaacaatgtgatggaggactgagaaaacctaataccttttctctgagacctctgagaaatgagttttttgcaatgttttgaaatttgtcttctagtcagttttacctgcagtgttgtacaaaaacaagcaaattagttgtgtgtgtgtgtgtgtgtgtttttttttttttttgagatggagtctcgctctgttgtccaggctggagtgcagtggtgcgatctcggctcactgcaacctctgccttttgggttcaagcgattctcctgcctcagcctcccaagtagctgggactacaggcgcacactgccacgcctggctaattttttgtattttagtagagacagggtttcaccgtgttgcccaggctggtctctaactcctgagctcaggcaatccacccgcctcagcctcccaaagtgcttggattacaggtgtgagccactgcacttggccaca

SEQ ID NO: 70871 - DNA, 601 bp, Human
tctgttattatatccaatctaataaaaagttgattatatggtatcgaaaactaattcattttgcttccagtttctttgaagtttgcagcctcctaagattcccctaaatcaacaatgtaatggaggactttattcccctaaatcaacaatgtgatggaggactgagaaaacctaataccttttctctgagacctctgagaaatgagttttttgcaatgttttgaaatttgtcttctagtcagttttacctgcagtgttgtacaaaaacaagcaaattagttgtgtgtgtgtgtgtgtgttkttttttttttttttgagatggagtctcgctctgttgtccaggctggagtgcagtggtgcgatctcggctcactgcaacctctgccttttgggttcaagcgattctcctgcctcagcctcccaagtagctgggactacaggcgcacactgccacgcctggctaattttttgtattttagtagagacagggtttcaccgtgttgcccaggctggtctctaactcctgagctcaggcaatccacccgcctcagcctcccaaagtgcttggattacaggtgtgagccactgcacttggccacaa

SEQ ID NO: 70872 - DNA, 601 bp, Human
tgttattatatccaatctaataaaaagttgattatatggtatcgaaaactaattcattttgcttccagtttctttgaagtttgcagcctcctaagattcccctaaatcaacaatgtaatggaggactttattcccctaaatcaacaatgtgatggaggactgagaaaacctaataccttttctctgagacctctgagaaatgagttttttgcaatgttttgaaatttgtcttctagtcagttttacctgcagtgttgtacaaaaacaagcaaattagttgtgtgtgtgtgtgtgtgttttgttttttttttttgagatggagtctcgctctgttgtccaggctggagtgcagtggtgcgatctcggctcactgcaacctctgccttttgggttcaagcgattctcctgcctcagcctcccaagtagctgggactacaggcgcacactgccacgcctggctaattttttgtattttagtagagacagggtttcaccgtgttgcccaggctggtctctaactcctgagctcaggcaatccacccgcctcagcctcccaaagtgcttggattacaggtgtgagccactgcacttggccacaaat

SEQ ID NO: 70873 - DNA, 601 bp, Human
accatcctttaaaaaaaaaaaaaaggaagaacggtcagactaacaaaacaaatagagcaatagggctgacatcattaaagaaaacacaaaacaagcaaatcagatagttgttttttatattactagatggaccatttgcaacttaaaggactggaagaatttggtttcagtattgtacattaaatacagacatttagtcttcagattaagaaactttattaaatataaaaggaattaaagcacaaaaataagcaaattggatagttatttctaatattagtagatggaccatttgcctctkaaaggatcggaagaattggctttaatgttgtacattaaatacaggtatttaatcttcagattaagaaactttattaaatgtaaaggaattaaattttatatgctgattatatcaatggatagaaggcaatatatgctcaattacttttaggcaagcaagtttgggttttttttttaattgttttttcttttcttttttttttgagatggagtctcactctcacccaggctgtagtgcagtgacataatttctgcccaccgtagcctctgcttcccaggttcaagcggttctcctgcttca

SEQ ID NO: 70874 - DNA, 601 bp, Human
agatcgtaggggcagaattaattttgtccttcactgtattccccatctagcacttgttcacactactggaagaccacttaggtaggctgttttatctttaactagttgaatttcgtaacaggccatgaggtccttaagggtagagagtaggtcttactcatttgctgtccccagcaaccagaccattgtctttgacattactaatactcaataaatgtttgttattttgtgttaaataattacatacctagatcagctttttagtttattttatttagccatggcatacagcctgggtgayatttttaaacataagtgaaaatgcctcccagttaataggccacacagatgttctcatatctcatctatacttagaagggtttttaatttacttttctttagttttcacttatttatattaagtaatttatgcacatgataaagggtaattaataaaaagtaagcatcccttttactctattctaagtcctctagtttctgtccctaaatgcaggcaccgttactgtttcttggctattcctccatacatagtctaagaagtatatgtgtgtatgtcacctattatttttcacatgagcca

SEQ ID NO: 70875 - DNA, 601 bp, Human
ttgggttttggaatatttgcatttatacctgctggttgggtatccctaatctgaaaattcgaaatgctccagtgactgtttcctttgagcgtgatgtcaaaaaatttcagcttttggagcattttggatttcagattttctggttagagatgttcaatgggaaaaactattatgtttgtatattaactccagacctttagcagtttcctagaacaaaaataaaccacagtacagacatccatagatagataacagattacatattgggtggaaatgcatacaatgtcatttcccaatcaayagacatttaataatgttaacatcaagcagatgtttgtaataaagctgcggtggcactcctcagcaacattgacatccagtgtttatccccttcactaacactcagtgtccttcacaaaatttgtacaactgattctgatgttttactcgttgtatttgaaaggtgatatgaacactttttcctcaaatctttttgataaaaatgttttattgagctttggagtaataaatatagttttcctttgttaacatgaatcaaaataatgttttgagaggtatgtatatactatgaagtttgaat

SEQ ID NO: 70876 - DNA, 601 bp, Human
gtaaaagggagagaatacttgaaaaagaagtgggtttttattagaggagaaagttgggtagacagccaactgtgacttctgcaggcttctaggaagtatggaacctgatggtacttcacgggatttctgagatatatgccttctagactttcatgttggtgaagggttcataaagttggtcctgaatttatcctaccatgaaaggcttctggagtgtggttcttggaaattccttgaattatcagagccactttgggtacttctccagggcatctttcatgagtttggtgtatggggcctyatttctcatttgatgctaggttgctatttgtatatactctggtattctctttgttcttaaaaatcctcaggtgagtgttcctagtaatttttaattaccagacggtaagaagtatagcttattgtagctttaatcagcagagctagcatatcttgatataatgcctatatagtttctgaaaatagtaagtgagaatgtgagtatatttttaatcccggagtaatggtaaaaattcaactctattttagttacattggtttttaaaaatatggcatggtgttattagttttaaaacatgga

SEQ ID NO: 70877 - DNA, 601 bp, Human
tgttcccttttcttgattctgtgctctgtgaaggcttgacccgtagactacttagaagtgatgctgtgccagtttccagcccaggccttgggaaactgccagcttccgcttcctgttctcatgggatgcttgtgcttacacaccagccagtatgctgtgaagaactgtgtagcttacataagatgtggccatctagttctcaaggcccaggaacaggatgtaagaagggaggaagaagaaaagccaaagggaatcctcttcctgtgtctttaggaagatcctggaaggtgctgaagctaawtacttggtgttgatctgaagttagacacttagctagggagacttgttagtatctttttcttaagaaaccatgtgctgagctagaactagtactgtagtactgtagtatggaggaaggggaaaaaggatacctgtggaacagtaagagtcttcaacacacatgtcttgcaattttctgtttccttgactgattatcaattccaattcaattaacactctgtttttagtaaaaacctactcaagtgttacctgggatagaaatctttcccagactgggaaccttgaatcataaaatgtgttt

SEQ ID NO: 70878 - DNA, 601 bp, Human
acgacactcttcagtccaattcaccattcaaaaaacacatatggcctacagagataaatagattagtacttgcctaggactggggtgggtgagtggggggattatgggctgatggctaaggggtggaataggacaggagagactgaggaaggcatacttatgcctgaaaacagtgtcaactcttcttccgttaggcccttgggggagggggtggggggggagggggtgttgagtcactgcaggcatgagctgggtcgagcttaagccttcctgcagtggttttctcacgtgcaccaagggrccgcttgtgggatttctgcatgcctgcttcatcctgagcttgagggcttgcctctgaccctgtgcttcatgggagccgtgtcttcatgcctgtgcctctttcccagagggagactcctgtgggccctggttagccctaccatgggtgcaggagggctgttttctgttcgctgtgccgtggcggtagaccgtccttgtgtccttgaactttgaggtgagttcagtagtggccctgctgctccccagccgtggggaagctgatgttctgggctccaggtggatttctgcctctttcctgatg

SEQ ID NO: 70879 - DNA, 601 bp, Human
atcatgtttttggttaaagtgaagactttattttgtcataatgagaaaaatagcttgtaatttgattctgaagacaatttgagacgactgcaaaatatttgtattctattctagaccaaagagatctgagattttttaattgaggtacttatcagtatttatggaattgacaaatgggcagtttgttattctgttcttgtgttatctttttttccatttgtttctggctcatttatctcaggttataagtttgttcaagtttgtaccatggttgtttctggtataaaacccgatagttgatttttttttttttttttaaacagagtctcactctgtcaccaggctggggtgcagtggcgtgatctcggcctgcaaacctccgcctcccgggttcaggcaattctcctgccttagcctccagagtagttgggactataggtgcgtgccactacgcccagctaatttttgtatttttagtagagacagggtttcaccacgttgaccaggatggtctcagtttcttgaccttgtgatccacctgcctgggcctaccaaagtgctggtattacaggcgtgagcctccgtgcccatcctgtagttg

SEQ ID NO: 70880 - DNA, 601 bp, Human
aattctcctgccttagcctccagagtagttgggactataggtgcgtgccactacgcccagctaatttttgtatttttagtagagacagggtttcaccacgttgaccaggatggtctcagtttcttgaccttgtgatccacctgcctgggcctaccaaagtgctggtattacaggcgtgagcctccgtgcccatcctgtagttgatatttttatcgaataattctatgcagttggtcaagactatctaagtacctatgttttgtgtattggatagcttgctaggaaattatgttctataccttcaaaaaattataaaaatatttcaagaaaaaaaatcaaattcacaaagattttgtcatattaccagatctaatatgacaaaaattgtgaatcattaactcataatgatatgaatcaatgctatagaatgtcatgtccatgttcggcctgaaattgccccacttctcaccggtggtctgggccccacactgtgagaaaatatttcactaatacctgcgcttagcaaacgtcccaaggtctctgactgattagagctcttgttcacgaacagagctctgatagtacctaatgctgttaagcg

SEQ ID NO: 70881 - DNA, 601 bp, Human
cctgcctgggcctaccaaagtgctggtattacaggcgtgagcctccgtgcccatcctgtagttgatatttttatcgaataattctatgcagttggtcaagactatctaagtacctatgttttgtgtattggatagcttgctaggaaattatgttctataccctcaaaaaattataaaaatatttcaagaaaaaaaatcaaattcacaaagattttgtcatattaccagatctaatatgacaaaaattgtgaatcattaactcataatgatatgaatcaatgctatagaatgtcatgtccaygttcggcctgaaattgccccacttctcaccggtggtctgggccccacactgtgagaaaatatttcactaatacctgcgcttagcaaacgtcccaaggtctctgactgattagagctcttgttcacgaacagagctctgatagtacctaatgctgttaagcgtgctattttaatagcattctatgatatttaacatcatactttgagacatttgtctcccatgtagtgtttaatcatatttttctctcttgtggtttacttccagtgactgtgatcctgtcagttaccagaataagttaat

SEQ ID NO: 70882 - DNA, 601 bp, Human
atatgttatctctaattagtgtttcagtttgaactagagggctataattttctttgttctttttttattttctttgaaatttcctgattgaactttcactttttccagcttcagaactgtgttttgtttttgtttttgtttttttttttttggtaacagaaatgcatcttcactttctacattttcttaagagtgaaatttgaaataacaatacagtttctccataaagagatgcaacactaagaaagtcaccgcgtttggtgcattaatagttggttccgttgactggttttgttctcartctggtcacagtttatgtaactgaattacctttgctatcttcacatatttttgctttattttttttaagtcactggttttctgttgcttaaagataaaatttaaatgcttttgcatcacaacacaagctttttttttttgtagccctgatttttcccccagagtcctgtttcttgccagtgccgatctctgtgtatgaattgcaagagactcctttctttttcctgaaggtgcctttcagtttgacttctttgtgccttgtatcatgccactcccattgcttggaatgttctctgttcac

SEQ ID NO: 70883 - DNA, 601 bp, Human
atctatgattcagaaacctttttatttttaataaaattttctttttaattgtcagcaaggcaagttatttctatagaagggtgtgcccttacagatggagcaatggtgagcacacactcggacaagggaggggaaggggttcttatccctcacgcacatggcccctgctgctgtgttgttcccctgttggctagggttagaccgcagaggctaaactaaatccaattggctaatttaaagagaatgacggggtgagtgctttggcgggagtcagggcagagcaggtagcaggtgatcagartgagttagggtggagtaggtaattgaaaaaggttgctttacgaggaacttaagtttaaaagtagaaggcaacgaattgaacatattgacatattaattctttgaaacgaaatttagaactcatatctaacaacccctccccttgtatttccttacagctttcttttcaaacttttttttaatgtgtcttggcttagttgttttgcttgattttccaaaagaagaagcttctctggataaggtggaggatagttaagggaggagaaaccttttttttttttttaatgtcttggcaggatta

SEQ ID NO: 70884 - DNA, 601 bp, Human
acaaagtctataggagttagaaaattcccaaatagagaggaataaaatcttaataagtaagtaattaaaaccccaaacatggtcagtcagctgtccatatctttgagaacagacaggtaaactgtcccacttttgttagacttagtcagttgcttatgttgattggtacagtgcaggaggaatctacttttaccatggaaggaaaggtacagtacaattgttgaaattctatgaaggctatacactctaatctcatcagggggaattctgcatcacagggaacctttatattccagaaagrttttagaaatttttttgtaacttgattttgccctttgccatttgtttaaaaattaagaattattgcaacctaaattctggtttataacaattaactataattgaacaaataccatattctaatttcagactagttttggattaaaaaaaaatttctagacctgccagatgaaaatattttggtcttttatggaattggagtgtttgatagaaagaatgaggagaaattattgggaaaaggatttctaactaattgtaaaatttcattcttgtcagaaggggcattttggatgtgagcaaa

SEQ ID NO: 70885 - DNA, 601 bp, Human
tccgttttcgtggtcactcttttttttttccatgtatacatagcatataaaaattttaaacaacttactagaatatgactggttctaaaaatcctatctcccatccccccaaaatgaagacttgacaccggttagtctattctaaacattctgatttcagctccaaagtgaatttttaaggacaagttccagaaatgaattggcagtggtgatattaaatgcatatttagttttccaagatgagctggaaaactaaatttttagtttttagtgctgttggactatttaggaatagccagtrctcactttgatgtatagttctgatgttattggcaaaaataaacaaatcaaaagcacaaaacaggcaactgacaatgtcatgtctctgaagagcacatctgtatataatcctacacaggtatacgcaccttcatccatctattctaagcacgaagaatgtatcagagaaaaggggagaaaaattggtttctaagccctgcagtccaactcttttttttgtttttttctgaggtagagtctcactctgtcacccaggctgtcactcttgaatataaccattgtttccaaggtgagtttatag

SEQ ID NO: 70886 - DNA, 601 bp, Human
ggggcttatttcccaacatgcttttcatccttgagtgctgtggatcaaaatctaataaccttagatctttattttgaaatcctgtattctcaggaggtagagcttcagaattttagtaggtacatgctagattctgttccgtgaacagaaagagcagaatctttctgaacagacagagcagaaccaaaaataatggcattgaccatcctttcaggctggaatagcaacaaactacaaagacagaggcctattatgccaaacacttatgaaactgaattttatgtaatgggacagtttcctyatatttcagtgggtaatcatactaaactactttgctaagttgaatccaacaagttctgcttacaaaagatagctttcgaaaaaacaagtctttgtaatacctgtcagtttagacaggatatattgaataaaaatgtcacttaaaattttgttaatttaaaagaacattattttgataacaaaaaatttcagcattctctcaccacaccatatcttgagagcaatctcctatgccttctctattaaatgacagtgatgtattgaagaagtttgtgcatgtgtggaaggattttgtaaattt

SEQ ID NO: 70887 - DNA, 601 bp, Human
tcctttcaggctggaatagcaacaaactacaaagacagaggcctattatgccaaacacttatgaaactgaattttatgtaatgggacagtttccttatatttcagtgggtaatcatactaaactactttgctaagttgaatccaacaagttctgcttacaaaagatagctttcgaaaaaacaagtctttgtaatacctgtcagtttagacaggatatattgaataaaaatgtcacttaaaattttgttaatttaaaagaacattattttgataacaaaaaatttcagcattctctcaccayaccatatcttgagagcaatctcctatgccttctctattaaatgacagtgatgtattgaagaagtttgtgcatgtgtggaaggattttgtaaatttcaaagtgccacactgatgttggttatacttaggtatggtgggccttacacttttaggggcagtttctgctttgactaagcaactgggccactacttaccagctgccaaataattagagctgcagatatagcactgttgaaggaattttaatacttctcatcagcctcctcctcataatggccaagttaacacacactgcgtcttt

SEQ ID NO: 70888 - DNA, 601 bp, Human
ctcccttgagaaatttgtctttgaggattcaggtattataacttggtagggcttactccttttttgtgagtgtgaatttttttttttttttttgggttcgggcttactcttgctcactaaatcccaagatttatatattcacatgctaatacgttaacaatgcaaaacagtgctgtctggtggatccctgatttgtgtgctttttagaaagagcacattgctgttgggtaggaaaaacatatgaagccaggttctcaaatatttgtgtggtaaggatggagtaacaataagggaattccaytttgtattttgaatgtttttgaggcattgtttccaaaagtgtgttccatggacttggcaactcataaaggtactttgcaaaaggaggaggaagtgctgcgcaaggcccttctctaggagagtcacaggacatatgggcatcctaatgacaagagtctttcctaaacaatctgttgaactgagattaacccggtgtttcccaaatagaagtgacacagaaaccttttccccccacataatagccctcaaaacagatgcatattagcatcagacttctgtagttacatttttcttctaagtg

SEQ ID NO: 70889 - DNA, 601 bp, Human
ggtaaatgttttttaaaatttctgttagtaaggattttacctttagcagcttgttattttagttatctgcttagttgcttctaatttgaattacttgtagctccctaatttagattgtaaaatgttatggctctgttatatgacttaagtttagaacacagtgggtccacttttggatcccattcaaagtggatctgatgtacttattttcctacacagttaaagatccctcttcaaaggtgaagcagagacacaataaatttggatcttgaaaccttcatagtaatatgctttttaaaagacatgtatacataattgtatagccattgcatatacttttatacatacatttctttcatatacattactgtcaggaagatcaggaagataatgtcatctctttagtgagataaattccaactccatcgtgaccacttaccatagatgtgactctgtatttgctgttcattcattcaatatgtatttatttgccttgtatatagtatgtacttatatgggcactggtcatagaaagaggaaactgaatggttcacttaacttttgaaattgtcttttcacctatcagggatgtgtgaatagt

SEQ ID NO: 70890 - DNA, 601 bp, Human
taaagatccctcttcaaaggtgaagcagagacacaataaatttggatcttgaaaccttcatagtaatatgctttttaaaagacatgtatacataattgtatagccattgcatatacttttatacatacatttctttcatatacattactgtcaggaagatcaggaagataatgtcatctctttagtgagataaattccaactccatcgtgaccacttaccatagatgtgactctgtatttgctgttcattcattcaatatgtatttatttgccttgtatatagtatgtacttatatgggcrctggtcatagaaagaggaaactgaatggttcacttaacttttgaaattgtcttttcacctatcagggatgtgtgaatagtattgatgtaaagcacttggcacgtggtaggttcacctcttttttttttcctgagatggaatatcgctctgtcgcccagactggagtacagtggtgcaatctcggctcactacagccttctcctgggttccagcaattctcatgcctcagcctcctgagtagctgggactacaggcatgtgccaccacacccggctaattgtttttatttttagtagagac

SEQ ID NO: 70891 - DNA, 601 bp, Human
tctgtcaagattaaaaataaatcagtgtctgtgtttaagaatactgagagctggtttgaaatatttttcaaggagttcaaaaatatgttttggcgtgactgtattgctcttgcttttttcatattttaagtagtattactttcattcttatgacactgaacctgtttattctgatgatctaagatatttacaaatgaagtgcatatctagtagcgtgcaaagttttttttttcaggtctttatttgaagaacccaaattctcaagttttaccatatgtgaactgttttgagaagtaagaamaacaaatatctttagtataccacatttgttgttctaaacttgagtatgttttgatgtagggcctaggttattttattttttgcccaaggcattctaagaagttttataaaatgttggaattttaccaatttcaataaagtatgaacaaggtcaggctaaattctgcttacagttctgtttgatttttaagtacattctaagttgtctagcgtaaaagacaataatattctgaaatctgtgatttggtaaataccatatgttgaaaatagacctataaatggttcttcattgtgtaaatat

SEQ ID NO: 70892 - DNA, 601 bp, Human
agtgcacactaagctttgtctatcattattgctgggagcaatcaaattgatgtcagcaggacagtagatgcgttgacagctgtaattatgtatctccatggtgatcacttttggcctgtcatggaggcccatgagtcccctcccttggaagcatttaatcagattgggctgtcacttgtcaggtagacatggcgggctgggagttgtgcttagggggagaggtgaattgagaatgaagggtgggagatgtctgatagtttcacagagtccactgtggtactgaagacagaaattttaattrtgctagaggtttctgagcagtggtttgagaatctcgtacagaggtgcttgggtgttttgttgtggttgttattgtttgtttttcttccttgtcttattaaaactagagcagtcagtttaccttagaaaacaatttttggctcttaccttttttggtcacaagaatgcatacttaagagttaacttatggtttgtacttttcacatgcttcattaagcctgagatttattaatatggcagaggtgaagatttccttttttatttttgatcatcatgttttgtaaatttgttattttcagac

SEQ ID NO: 70893 - DNA, 601 bp, Human
tccattaatttttttctagtttttgtcaacactgtgaatttcatagaacatcagtttatgtcctgaaatatgttttcagaaaatagaaagccaagtatatttcgtaagtgtgctgaatgatttttgtttataattaagatttttgtatatgaatgtgaatacgaatacagatatctatatttttgtttgtgcttgcaaatacagaaataaaagcccttcaggtatgttatagtgttccttttacaaccttacaaagagaataatagtagtgtgaattttaagaaaatgaaactatcgcttstcttctgatgtcaccgtataataaagccatcattataccctcatgtggatatcctagacaagaggttctacatgtggtcccttgataattgcctaaattaaaatattaaaggcctaacagccgctgtgttgacctttttctgccttgctgcagacagatgagctgctgtttattaggaaggcttcttcccacaggtggaaggctacgtgagcttccgctcttctcttcccacccctttacaatgttgggcatcaaagtcctgctgttccagcagctttgattcagttcctccatcctcaa

SEQ ID NO: 70894 - DNA, 601 bp, Human
ctccctttttatctctgcatttttattgtggtaattgaaatactagattttggttaatttaatttttactctaatgtgcttgagcagtaaatccatgaatttgagagtctgaataagaatattttgtcaaaactcatttctgttaaactgtgatataatacgacataggggcatggcatctgggcagtttgtcaaaatattagattagttttggtcccaactagaagttatttatctactccatctggcttctgaaaggagtactcttttgtatttacatgaataccatttcatgttttayacttaaatgaacattttcccactaatttgcttactctatatatgtatatataggttcaccagttactacagtttttaagtgactaaaatacaaagtaggcttgccattattctcctaactttatatgtgtcacatataaaaaataaattttgttgtataggtagatttttccaggcttagtctgaaattttgcctttgaattactgtgatgtagtagacagaaaccagacaaagctaggttcatagcccctgtcctgacgccatttaataattatgtgatttttggccaagcacggtggc

SEQ ID NO: 70895 - DNA, 601 bp, Human
ttagttgtcatcctttcttcctctttcctcacacttaataaaaccatatatttaagaatcaaggccaggcgtggtggctcacgcctgtaatcccagcactttgggaggctgaggagggcagatcacttgaggtcaggagctcaagaccagcctggccaacttggcagaaccccgtctctagtaaaaatacaaaaattagccaggcgtggtggtgggtgcccatagtcccagctactcaggaggctgaggcaggagaatcgcttgaacccaggaggtggaggttgcagtgagatgagatcgygccatcacactccagcctgggtgacagtgtaagactctgtctccaaaaaaataaaaataaaagccatgtgttataaatcacattatcaatccattagtcatatgaaatttactaaatcatagataaacaatattgaaagaccgttttatgtaatttctaatactgtgtgcggaggttatatgctttcattgcaccctgttcaaatacttctccagagaatttaccgtcactgtaaaattaaagtattaattgtgtaattaactgtgaaatgttgggttatcctataagattattaggcac

SEQ ID NO: 70896 - DNA, 601 bp, Human
tggggatgaaattataggtgcttgaggcagggtcttcttgctaccttcagttactgggtaagatcacagaactagttgagccagtttgctggtctggctgcatgactcctgagccttaatttctaatgttagttttacaaatgcagtctgttccccagacaaggagggggtttgttttgggaaggggctgttttcattgttttacagttaaagtataaattaaattcctcttatagttagcatggcctacacccaggaatgaacaggggcagcttggaggttaaaagcaagataaagttgrttaggtcggatttttctcagtgtcataatttttgcagtggccatttcattcctgcaaaaaagcacaataccatcattacacccaaggaaaattgacagcaacctaacagtttcatctcatgtattgtccatatttaagcttgtccctcggagtctttttttattgttttttaatcccatctgtggcccaaagttacacagtgtctttgattatgtctctttattatcttgccgtctttcatatttcatttcattaattttcaggagagtccacggtagttgatttgtagaatgtggcaca

SEQ ID NO: 70897 - DNA, 601 bp, Human
gaacgtctgttttctgatgtataccatcgaatctgcctgcttttctgaaccttaatcattcagacatcatctcacaggcatctcaaatttaacttgtccatgaatctgctattttcctctcaacctgtttcttctctgcaaatggcaacttctctcatgttgcagagccagaactttgggtgttgtgctcatctccccattctttgtaattgtggttgttgttttgagacagggtctcactctgtcacttaggctggagtgcagtgatgggcccagggctcattgcagtcttaacctccarggttcagctgatcctcccacctcaacctccctggtagctgggactacaggcacaagccagcacacccagctaattttttgtatttattgtagagatgggattttgccatgttgcctagactggtcttgaactcctgacctcaagtgacccacccacctcggtttcccaaaatgttgcaataacaggcatgagccactgcacctggccctcatctccccattcttgccatcagtccctgcctgcctcctgaatatccgtcaagtccagctgcttctcccatctgtattgtcagtgtcctag

SEQ ID NO: 70898 - DNA, 601 bp, Human
aacgtctgttttctgatgtataccatcgaatctgcctgcttttctgaaccttaatcattcagacatcatctcacaggcatctcaaatttaacttgtccatgaatctgctattttcctctcaacctgtttcttctctgcaaatggcaacttctctcatgttgcagagccagaactttgggtgttgtgctcatctccccattctttgtaattgtggttgttgttttgagacagggtctcactctgtcacttaggctggagtgcagtgatgggcccagggctcattgcagtcttaacctccagkgttcagctgatcctcccacctcaacctccctggtagctgggactacaggcacaagccagcacacccagctaattttttgtatttattgtagagatgggattttgccatgttgcctagactggtcttgaactcctgacctcaagtgacccacccacctcggtttcccaaaatgttgcaataacaggcatgagccactgcacctggccctcatctccccattcttgccatcagtccctgcctgcctcctgaatatccgtcaagtccagctgcttctcccatctgtattgtcagtgtcctagc

SEQ ID NO: 70899 - DNA, 601 bp, Human
ggtatacatgttaagctgttatcattggctagcttagagatggaaagtcatattgaaaaggtgtgccctgctcgctcaaacacatgcactagggtacagggtaacctgctgtaacaaagatttctaaatacagtgggataaataagagagacgtttatttacctctcatgtaactgtctggtccatgctgctaggaggcaagtcagcctcatgaggtcattcaaagatacacacacccatcctgatgtgccactccgtttgaattgccaaagctgagtttctgccatgtcaggaaacccayagtaagacgagaagaaaggaagctcaagcaagcaatgagagagtcggaagttgcgtacatcactttagcttaccttcctttgtctaggaattagtttgtcatgcctacctacaagctagatgggaaagtggagtctgtgtctgggtgtcttttgctcagctaaaattctattactgtggaaaaatgaaaagcaggttttaggagaaactagcagtctgtcacaataaactgtgtcttaaaaattgtttatatataattatatatatgtaactattgtgatatataatgtgctaatcatta

SEQ ID NO: 70900 - DNA, 601 bp, Human
tcaggaaacccacagtaagacgagaagaaaggaagctcaagcaagcaatgagagagtcggaagttgcgtacatcactttagcttaccttcctttgtctaggaattagtttgtcatgcctacctacaagctagatgggaaagtggagtctgtgtctgggtgtcttttgctcagctaaaattctattactgtggaaaaatgaaaagcaggttttaggagaaactagcagtctgtcacaataaactgtgtcttaaaaattgtttatatataattatatatatgtaactattgtgatatataatstgctaatcattaggtaaactattcagtctctctggattgcaattttcttttttttaattttttttttttcttttagagatagggtctctctctgtcacccagatttgggtacagtgatgcagccgtagctcactacaacttcgaactcctgggctcaagtgatcttcctgcctcagcctcccaagtacctgggactataggcacatgccaccattcccagctaattttctgtttttattttttgtagagacagggtcttgctacattgcccaggctgatcttgaactcctggtctcaagt

SEQ ID NO: 70901 - DNA, 601 bp, Human
tgaaatttatgaagcatttgctgcagctacaccagcaggtgtgaaaatcttgcacttttttgtgaaacacctttcatttcatattgaagatgcagcttttatgtgggtacaggattactataagaaaggcattcccatagactcgaatatgactgtctatgggaaaagtgaagttgttatatgacaacttaaagcaaaaggaaggtggaaggatataaagctggagaatgtattgccaaccaaggatggtttgataattttagaaagagatttggctttaaaatgtgaagacaaaatgtgmaggggaagctgtttctgccaactaagaggcagcattaagacaccattaagaaaatcattgaagagaaaggatatctgctgaacaggtttttaatgcagacgcaagtgccttattctgagggggaaaaaaaagccacaaggaacatttcttagtagggaaaagaagcaagcatgaggagttaagacagggaggaataggctaactctgtctgttgttctgtgcaaatgcaatcaggtttatgatctgcacttatctgtgaagctgctcatctcctagccttgaaggaaaatgataagcacc

SEQ ID NO: 70902 - DNA, 601 bp, Human
ttattctgaaaaatgaagttttcaataaagtaatgagtggaatgtgaaatttaacacagcaaagttatcagcaagcatttccaggtagtagaaaaattgctcatcaaatgggagatagagaaaaccctttagtgagcattcaaaacatagttaacataagatattgagagataaacaagatttagactgagacttaatagaaatgttactcaggtgaaagcctctacctacatttttaatgagctagtgaggtatgaaggttagatagtctgtcccatatttcaagtgttctttgtatccrttaaagtgttttaatgtaaaatgactcacattcatattaggagctatatatagattcaggtcaagttgatgtcgttgagttgttgggtgcatttataaagcagttttcagttcagaatttacaatacagagttttcataagactcaacagagataactgatttgaatattgttttaaaactttagtgttatagagttttatcattagtattaaggcaaatgaagaatggctctaagttgggatcttaaaacaaaaactaatgatttattaggttgtttttcataaacttttgaattttta

SEQ ID NO: 70903 - DNA, 601 bp, Human
atgatttattaggttgtttttcataaacttttgaatttttaaaaatacaaaataaaatacaactaggatagtagttttatacttttgtgactattcttttaatatttgttggtttaatgaggctaagaaccccttacgtcattgcttttcattttatccctagcacaaaacatagtaggtactaagtatttgttgaattaatgaaaaaaaaaaaaatcttagccataatattgatgagaaaggattactttggatttttttttttttttttttttttgagacagagttttgctcttttgcycaggctggagtgtagtggcacagtcttggcttactgcaactctgccttccggtttcaagcgattctcctgccgcagcgtcccaagtagttgggattacaggcatgtgccactacccccagctaatttttatatttttagtagaaacggggtttcaccatgttggccaggcttgaactcgaactcttgacctcgtgatctgcccgcctcggcctcccaaagcgctgggattacaggcgtgagctaccgtacctggccgctactttggatatttttaatcatttatacatgtatccagataa

SEQ ID NO: 70904 - DNA, 601 bp, Human
atgttggccaggcttgaactcgaactcttgacctcgtgatctgcccgcctcggcctcccaaagcgctgggattacaggcgtgagctaccgtacctggccgctactttggatatttttaatcatttatacatgtatccagataaccagttcattctattttgatcctaacatttagtttcttgtccttcctaaaattttaattaaaagttgtagtacgttttgaagtggacttaggacttccatgtttttatgtctgcctggcaattcagtgatggtgataagataggaaacagtgggcagraggagaaaacagggaaaaactacagagaacctttagaacaaacattatatgcatgtatgggtatttatatatatatacacacacacaaatacacatttatatataagtttgtctatatgtatgtatggtgaagtatcccagagaagaagaaaatggggcatttaaattttctaatcagagttgattagtatgtgctggacgtttagcaacaatagagaatatcccaaattctgtagagaagggatccccttcaaactcagaaatgtacttaaacctagatattgcagttttctgtgatgc

SEQ ID NO: 70905 - DNA, 601 bp, Human
ctcaaaggaataaatggaagtatctcaaaatatgcagcaaaaaggtaaagagaatgaaatcatgtggaaaatgatgagagatatggagggaagatccaaaagattttacacataagtgcatactaggagtttcatgaaaagaaaaatggaaatgaaggataactttgaaagaaataatagagatttttttctcactgttcttaagaaagccttaggtattcttggaaagactcactgagattcagactggattaatttaaaaagtaactccactaggcatataaaaaacaaatactttttwaaatcttctaaaagaaaagaaagaagatgcaaggaatgtacagtgagattatgttcatactctataaactggaagttagaaatcttagaatagtgtctgctacataggaaagaatttgactcaagagtactatacccagctaagatatcgtcatcaatataaacaaatttgttttcagttaaataaggattcagaactattttaccatatatactccttttgaggaaattgctaaagaaagtactttaaccagttttgaggtaagatgatagcttaaaaatatacatatttttcccccta

SEQ ID NO: 70906 - DNA, 601 bp, Human
tgtgaaccaccatgagaaatacattttacatcctgacatagtatgcacatataaacacacacaacattttcatgtaaaatactgtgtttaaagtgctatgataatttgtcttcctgcacatgacacattaaactggcttcatgaactactaaacagtttctttacacagtttgataaatatcagtccagaacagttgtattcaaagtgagatctgctgactggcagcatcggcatcaccctggagcttgttagaaatgcagattattaccccttgccctcataccttctaccagtcagtcygctggtgaagtgcacacagcatctttaatccaggtgattctgatgtttggtgaagtttgagaagcactggttctttttacactccagagagcttttgtgattatatatattgatatttaccacattataaattaaaactgaggaacttgaaaatatttattcattcattctgaaagtaatggtaataaatccattacgtgttgacatgcatgagagcagtgatgtcatcacacaatatgtgtcccttggatctgggaacctctgcagtatactcttgagaaaatgagagttaaaaaagca

SEQ ID NO: 70907 - DNA, 601 bp, Human
taatgtttaaattacttcatttcttccaaataagtttaggcaactagtttttttctttttttgaattgtacatttgtttcttggtatctgtgggtgattggttctaggaccctttcaggtacaaaaatccacagaagctcaattccccagtgtcgtatttacatataacttagacatatcctccctgcactttaaatcatctctaggttacttataatgcgtagtacaatgtaaatgctgtgtaaatcattgttatactgcattgctttgaggaaaatgacaagaaaaaaaagcctgtacmtgttcagtacagacaacaatacattttttttctcaaatattttcaacctgcagttgtttgaatccatggagggtcgactgtaaaagtagcaccttatggctgacgagccagcattcaagttgctcatactgtcccatttaatactctactatctgtatgtagtactctggtaaataaatagttttagatttgtggtgaagttacagagctgtcaagggatgtgttaacctatagaccctggagtatttgaatcctaccttgactcacaaccttcttgaagaattacgcaaattcttcaat

SEQ ID NO: 70908 - DNA, 601 bp, Human
tatttacatataacttagacatatcctccctgcactttaaatcatctctaggttacttataatgcgtagtacaatgtaaatgctgtgtaaatcattgttatactgcattgctttgaggaaaatgacaagaaaaaaaagcctgtacatgttcagtacagacaacaatacattttttttctcaaatattttcaacctgcagttgtttgaatccatggagggtcgactgtaaaagtagcaccttatggctgacgagccagcattcaagttgctcatactgtcccatttaatactctactatctrtatgtagtactctggtaaataaatagttttagatttgtggtgaagttacagagctgtcaagggatgtgttaacctatagaccctggagtatttgaatcctaccttgactcacaaccttcttgaagaattacgcaaattcttcaatcagtcactcaccccaggcctttgcggccagccgactatcccaggtccagctgtgtaatggtaggaagatactgtgagtgagaggaggagagagattggttggttgattgggattcatgcagagaagcagaagaatcacggcgtgatattctttgg

SEQ ID NO: 70909 - DNA, 601 bp, Human
atgcgtagtacaatgtaaatgctgtgtaaatcattgttatactgcattgctttgaggaaaatgacaagaaaaaaaagcctgtacatgttcagtacagacaacaatacattttttttctcaaatattttcaacctgcagttgtttgaatccatggagggtcgactgtaaaagtagcaccttatggctgacgagccagcattcaagttgctcatactgtcccatttaatactctactatctgtatgtagtactctggtaaataaatagttttagatttgtggtgaagttacagagctgtcaarggatgtgttaacctatagaccctggagtatttgaatcctaccttgactcacaaccttcttgaagaattacgcaaattcttcaatcagtcactcaccccaggcctttgcggccagccgactatcccaggtccagctgtgtaatggtaggaagatactgtgagtgagaggaggagagagattggttggttgattgggattcatgcagagaagcagaagaatcacggcgtgatattctttggatcttcgcaccagaaagcatggcctcatctgtgtccttgaccagccgctctccttttctcc

SEQ ID NO: 70910 - DNA, 601 bp, Human
tttcctttttactttttcacaagaggaagaacaaagtttaaaaaaaagaaaaaaaaagatggaaggtgatgaactagctttgaaaagcacaaatcagaaactgaaattacttctgaagaattaggtagaggagaaactaaattggatttaggctgtatcttagtggctaatgtggttttattcaggaaatctcagtgtagttggtactcttcacttgttctctttacctagaaagaataggaagcttacagtgtatctttttaaaagttatgatttggtagctaccagggagagatgagargatatagaatatcagtaaatgactgaatgactggacggaggaggaaaatggtcaatagaaccgtgaatctgcttgtgcatctgtttaatatcttctttcccaaattaaacttctttcccaatataaacttcctgtgagcaggattttgttgtcttatttgaatggtctttgctcccccgatgtctgtacacctcagtgcttgttgtttggttgtttcccccccacatagttgtgcggtctagtatgggaggcactagccatgtatggcaattaagattaaagtgaatggaagaatccttt

SEQ ID NO: 70911 - DNA, 601 bp, Human
tctttgctcccccgatgtctgtacacctcagtgcttgttgtttggttgtttcccccccacatagttgtgcggtctagtatgggaggcactagccatgtatggcaattaagattaaagtgaatggaagaatccttttcaaagttaccggaaacgtggctacatttcaactgttccatagccacgcgtggttagcagctcctgcactgggcaactctaagaggctttccaccacagcaggtgtgtttccatcaagttctgttggacagcatttgtctggagggatatgtgtgtaggagagaaygttgcttttgttttaaaacctgaatttcatattttttattcttttgataaatgcagtattcagatcctaattcctttaccttcagatgttatttggaccttgattatttcagaagttctgagtgtagctaaatatgactggtttgatttttaagaaatgtatgcaagttattttcagagagtgctgccttactgtgtggaagaatctgaaaagggcttaaaaagatggagaataaaaattacctgtaatcccataattattcaataattacttttaatgttttggtagaacccttcaaag

SEQ ID NO: 70912 - DNA, 601 bp, Human
atgtgaagagacagaaaccagataaagaagactatgtaatgtatgacttcatttatttgaaatttctagggaaggcaaaaagtataaagaacaaaagaaagatcagtggttgtctgggtctgggtatgggagcaagattgactgcacatgagttttattgttctaaaactggattggggtgatgggtgtacaactgtatgaatgtattacaatctcacttgatcttagccaaaaggccgagaagtgatataaatgtattacaatctcatcagactatacaattaagatgtatagatgttaytggccaggtgcagtggctcatgcctgtagtcccacactttgggaggccaaggcggactgatcacatgaggccaggagttcgcgaccaacctggccaacatggcgaaaccctgtctgtactaaaaatacaaaaattagccaggcttggtggcgcatgcctgtagtcccatctactcaggaggctgaggcacgagaattgcttgagcctgggaggcataggttgcagtgagccgagatcacgccactgcactccagcccgggtaacagagcgagaccctgtctcaaagtaataaaaagtaaa

SEQ ID NO: 70913 - DNA, 601 bp, Human
ggcagttgagtttgagatccttgacaggcataattgtagctcctaaagacttagcaatatgatatattcctatccctttgactgtttcttctttaataataatatatatgcccctttgagcccattaggaaatacttggggcatgcttttgtactcattagttccatgatttttttgtaataatcaaatgcacacagttttagacttcaacggtgttccttaatgtgtgctccatagagcgctagtttgggggagtattaaaatgcattacttaagaaaatgtttctgtgtttaaataaaygtggaaaatcccttgttaagttagaaacctcttagagactgtcatacaggcacacctcatttcattgtcctttgctttattgcacttctcagatattgcattttttacggattgaaggtttatggcaaccctgcattgagcaagtctttttgtgctgtttttccaacagcatgtgttcactgtctctgtgtcacattttggtaattctcattacatttcagacttcatcattattatcatatctgttttggtgatctgggattagtgacctttgatgttcccattgtaattgttttgggg

SEQ ID NO: 70914 - DNA, 601 bp, Human
aaagaagctgtctccataacataaaagtggaggggaagctgcaagtgctgatgtagaagcttgcagcaagttatccagaagatctcactagcatcatcgatgaaggtggctacactgaacagcagattttcaatgtagataagacagccttctattgaaagaagatgccatctcatactttcatagctagaggggaaaagtcaatacctggcttcagagcttcaaagaaccagctgactctcttggtaggggctaatgcaactgatgacttgaagtagaagccagtgctcatttaccattycataaaccctagggtctttaagaattatactaaatctattctccctgtgctctagaaatggaacaacaaagcctggatgacaaaatgtacatttacagcatcatttactgattattttgactccactgttgagacctacttctcaaaaaaaaaaaaatttttttttcaaatgattgctgctcattgacagtgcacctggtcacccaagagctctgatggagaagcacaaggagattaatgttgttttcacgcctgctaacacaacgttcattctgtagctcatggatcagggagtcattt

SEQ ID NO: 70915 - DNA, 601 bp, Human
aagaagatgccatctcatactttcatagctagaggggaaaagtcaatacctggcttcagagcttcaaagaaccagctgactctcttggtaggggctaatgcaactgatgacttgaagtagaagccagtgctcatttaccatttcataaaccctagggtctttaagaattatactaaatctattctccctgtgctctagaaatggaacaacaaagcctggatgacaaaatgtacatttacagcatcatttactgattattttgactccactgttgagacctacttctcaaaaaaaaaaaaawttttttttcaaatgattgctgctcattgacagtgcacctggtcacccaagagctctgatggagaagcacaaggagattaatgttgttttcacgcctgctaacacaacgttcattctgtagctcatggatcagggagtcattttgattttcaagtcttattatttaagaaatacatttcacaaggcgatagctgccataaatagtgattcctatgatggatctggacaaagcaaattgaaaactttctgggaaggattcaccattctagatccccttaagaacatttgtgcttcaatgggc

SEQ ID NO: 70916 - DNA, 601 bp, Human
ataaatagtgattcctatgatggatctggacaaagcaaattgaaaactttctgggaaggattcaccattctagatccccttaagaacatttgtgcttcaatgggcaaaataaaagatcaacattaacaggagtttggaagaactggctttgaggtgttcaagatgtcattgaaggaaatagctacagttggggtggaaatagcaagaaaactagaagtggaacctgaagatgtgactcagttgctgcaatctcgtgatagaacttgaatggatgagagttgcttcttatggatgagcaaakaaattttgcttaaaaagcaaagtttttaagatggactctgcttctggtgaagatgctgtgaacattgttgaaaaggattttagaatattacattaacttagttgataaagcagcggcaagttttgagaggattgactctaattttgaaagaagttctactgtgggaaaaatggtatcaaacagcatcacatgctacagggaaacctttcatgagaggaagaatcaattggtttagcaaactttattgttgtcttattttaagaaactgccgcagcctccccagccttcagcatccatcag

SEQ ID NO: 70917 - DNA, 601 bp, Human
caaacagcatcacatgctacagggaaacctttcatgagaggaagaatcaattggtttagcaaactttattgttgtcttattttaagaaactgccgcagcctccccagccttcagcatccatcagcctgatcagtcagcagctaccctctatcagcaaaaagattatgactcactaaaggctcagatgagggttagcatttttttagtaataaagtttttttttttggagatggagtctcgctctgtcgcccaggctggagggcagtggtgtgatcttggttcactgcaacctccgcctccygtgttcaagcagttctcctgcctcagcctcccaagtagctgggactacaggcacatgccaccacaccccactaatttttttgtattttttagtagagacggggtttcaccgtgttagccaggatggtcacgatctcctgaccttgtgatccgcctgcctcggccatccaaagtgctgggtttacaggtgttagccaccacgccagcctaaactactttttaattaaggtttgtacattgtttttaagagctatcgcacacttaatagactacaacacagtgtaaacgtaacttttataca

SEQ ID NO: 70918 - DNA, 601 bp, Human
gctacagggaaacctttcatgagaggaagaatcaattggtttagcaaactttattgttgtcttattttaagaaactgccgcagcctccccagccttcagcatccatcagcctgatcagtcagcagctaccctctatcagcaaaaagattatgactcactaaaggctcagatgagggttagcatttttttagtaataaagtttttttttttggagatggagtctcgctctgtcgcccaggctggagggcagtggtgtgatcttggttcactgcaacctccgcctcccgtgttcaagcagttytcctgcctcagcctcccaagtagctgggactacaggcacatgccaccacaccccactaatttttttgtattttttagtagagacggggtttcaccgtgttagccaggatggtcacgatctcctgaccttgtgatccgcctgcctcggccatccaaagtgctgggtttacaggtgttagccaccacgccagcctaaactactttttaattaaggtttgtacattgtttttaagagctatcgcacacttaatagactacaacacagtgtaaacgtaacttttatacacattggaaaagtaac

SEQ ID NO: 70919 - DNA, 601 bp, Human
tgggattacaggcatgcaccgccaggcccggctaatttttgtattttttgtttgtttgtttgttttgagacggagttttgctcttgttgcccaggctggagtgcgatggcgcaatctcagctcaccgcaacctccacctcccaggttcaagcagttctcctgcctcagcctcccaagtagctgggattacaggcatgcaccaccatgcctggctaattttttttgtagttttagcagagactgggtttctccatgttggtcaggctggtctcgaactcctgacctcagataatccacccasctcggcctcccaaagtgctgggattacaggcgtgagccaccgtgcctggcctaatttttgtatttttcgtagagactgggttttgccctgctggccaggctggtctcaaaatcccaacctcaggtcatccacctgctttggcctcccaaagtgctgggattacaggcatgagccaccacgcccggccactttctggtttctactttatcctcataatttccctcttggtatttgagcaggggttaaagactcagaaaaagaaacaacttcactatggcctataatattaatggaaatact

SEQ ID NO: 70920 - DNA, 601 bp, Human
gttctttgtatgtgcagtcattgtgtctgcatttgtattgtattatctttcctcatctggcttcctgataaaatggagaatcgattttttagtgatttctgcctagcagagacaattatctgtttatttttctttgcctttcctggtttcagatatagaatttattcacctgttattaaattttcaattagatgataaaagtttaaggtttttgaaatatgatcttaaccactgaaagatgagtggggtgagaaacatagaaaaaagtaaccgtgtgaaaataattcccaaggaaaagccrgtattgttgaacgggtacatactggctcttttactaagatgtcttctgaattaaaagagcatgtgaaattataacacatttatacgtcaatgaaaataaaacaacttatcataactcgtttcatactctcagataagccacttcactgtgacaatgaaggtgacgtgatacctaactatacaataaaaaaaaatagcactttaagtatatatttacaaacgtatgtatacactctttgtgtttggaaatagctacgttcatttgagcaaataaatcccctaaaagcaacaagatgggaga

SEQ ID NO: 70921 - DNA, 601 bp, Human
gataaaagtttaaggtttttgaaatatgatcttaaccactgaaagatgagtggggtgagaaacatagaaaaaagtaaccgtgtgaaaataattcccaaggaaaagccggtattgttgaacgggtacatactggctcttttactaagatgtcttctgaattaaaagagcatgtgaaattataacacatttatacgtcaatgaaaataaaacaacttatcataactcgtttcatactctcagataagccacttcactgtgacaatgaaggtgacgtgatacctaactatacaataaaaaaaaatagcactttaagtatatatttacaaacgtatgtatacactctttgtgtttggaaatagctacgttcatttgagcaaataaatcccctaaaagcaacaagatgggagaaaacattaactcaatcattatcacttaagcttgccttactttttactgtctctgttatgatattttcagttacttaatatgactgtgttgaagatggtttagaaatctatgtgagattaagtacaagatactaagtggataagaaagcacatttacatatttttgcttactattacattgtaaaatattttta

SEQ ID NO: 70922 - DNA, 601 bp, Human
tatatttacaaacgtatgtatacactctttgtgtttggaaatagctacgttcatttgagcaaataaatcccctaaaagcaacaagatgggagaaaacattaactcaatcattatcacttaagcttgccttactttttactgtctctgttatgatattttcagttacttaatatgactgtgttgaagatggtttagaaatctatgtgagattaagtacaagatactaagtggataagaaagcacatttacatatttttgcttactattacattgtaaaatatttttattttgatcctactakaagagctgagggaaaggcagaatagcctgattattgctggagaatttctctgttccctaccatgattccagaagctcttgcacacttcatcagtattattgtaattctttggctgcaggatatttggcagctgttgcaccccactggcaaatcctattcatacttctttcccattcaccattgccattggagaattgatttctctctcctctactctaacctttcccaattcattttggattgttcaatgtgaaacattttaatttcatatcatacagctattcagcttacaatcccttt

SEQ ID NO: 70923 - DNA, 601 bp, Human
tggtttagaaatctatgtgagattaagtacaagatactaagtggataagaaagcacatttacatatttttgcttactattacattgtaaaatatttttattttgatcctactataagagctgagggaaaggcagaatagcctgattattgctggagaatttctctgttccctaccatgattccagaagctcttgcacacttcatcagtattattgtaattctttggctgcaggatatttggcagctgttgcaccccactggcaaatcctattcatacttctttcccattcaccattgccaytggagaattgatttctctctcctctactctaacctttcccaattcattttggattgttcaatgtgaaacattttaatttcatatcatacagctattcagcttacaatcccttttttaacctgtcaccagggtaacagcatagcatgctttctttaggcaatcaagtttttatttcacatgcttaatgttgcattaaatgtttgcattttgtttaacccccttaaatagtttgaactctggatatgttttatagggtaatgaaatccttgatttttgaattgaaactaaatcaacaccatc

SEQ ID NO: 70924 - DNA, 601 bp, Human
catggtggcacgtgcctatagtccttgctacttgggaggctgaggttggggaattgtttgagcccgggaggcggaagttgcagtgagccaagatcgtactactgtactcctgcctgggtggcaaagtgagaccctatctcaaaataaaagaagaaataaagctgggtgtgggtttggtggctaacgcctgtaatcccaattctttgggagattgagactggaggatcacttcagcctagaagtttgagaccccatctctacaaataataataataataataataataataataataataataataataaaataattcgctgggtgtggtggcacacacttgtaatcccagctactaagaaggctgaggtgggaggatcggttgagcccaggaagtcagggctgtagcagtgagccaagatcatgccactgcactccagcctggctgacagagtgagaccctgttgaaagaaagaaggagagagagagagagagaaagaaagggagaaagaaagaaagagagggggcggtgggaggagggagggagggagggagggaaggaaggcagtcaggcaggcagggaagggagggagggagggagag

SEQ ID NO: 70925 - DNA, 601 bp, Human
ggcacgtgcctatagtccttgctacttgggaggctgaggttggggaattgtttgagcccgggaggcggaagttgcagtgagccaagatcgtactactgtactcctgcctgggtggcaaagtgagaccctatctcaaaataaaagaagaaataaagctgggtgtgggtttggtggctaacgcctgtaatcccaattctttgggagattgagactggaggatcacttcagcctagaagtttgagaccccatctctacaaataataataataataataataataataataataataataataaaaaaataattcgctgggtgtggtggcacacacttgtaatcccagctactaagaaggctgaggtgggaggatcggttgagcccaggaagtcagggctgtagcagtgagccaagatcatgccactgcactccagcctggctgacagagtgagaccctgttgaaagaaagaaggagagagagagagagagaaagaaagggagaaagaaagaaagagagggggcggtgggaggagggagggagggagggagggaaggaaggcagtcaggcaggcagggaagggagggagggagggagagaaggaa

SEQ ID NO: 70926 - DNA, 601 bp, Human
aaataagggcatctagattggagagaagtcaacttacctctttttgcagatgacatgattttagatgtagaaaatcttgaggaattgacaaacaaatctgttagaactaatgagtcctggaaggatacaggatacaagaatgatatgcaaatatcaatttttgtttttatacagtggcattgtacaagccaaaaatgaaattaacaaaacaactctatatagcaccaaaaaatatacaatacttaaatgtaaattttaaacaagaaatgcaatacttgaacactgaaaactataaaatgttgttgaaataaagatgacctaaatgaaaaacaccctatgttttgaatcagaagacctaatattgatcaccaaactgatctacagattcagcacaatccttactagaatcccagctgcattatttttggaaaaatagacatctgattccaaaattcatatgaaaatgcttttgcattgtaaaagaggaatgaagttcagaggctcctacttcccgatttcaaaacactacaaagctacaataatcaagacaaagtggtactggcgtaagcatagacatgttgatcaatggaatagaatcgag

SEQ ID NO: 70927 - DNA, 601 bp, Human
gaggtattgatattttctgcaacatggatgaattttgcaaaaatgctagatgaaataattcagtcaaagtagatcacaaattttcccagaataagcaaagctatagaaatcgaaagtacataacagttgcttagggctgaggaggggaatgtagagtaactgctctcgtatctaatgtttcccttatgaggcaatgaaaacgttttaaagttgcttgtggggatggttgcataactctgtgactatactaaaaaccattaacttgtacacttcagatgggttaaatgtatgatatgtgaayttcatctcaaactgtttaaatgtatatagtctgttacacattttatatttaagaatttgttttcctaatggtataatagatgttcaaattttaggaattaaatgaggcatttcttccttctagtttgatggagtctttgagaatatttcttttcaaattgtaaaatatgtttctatgtctgctctcaatttagtgcaagagtagctcttgggggtagcaatatcaagtgttcctgggctaccacctggaaggtggaagtagtagatgtatgtgaacccgcgttcttccatcttttctttc

SEQ ID NO: 70928 - DNA, 601 bp, Human
gactatactaaaaaccattaacttgtacacttcagatgggttaaatgtatgatatgtgaatttcatctcaaactgtttaaatgtatatagtctgttacacattttatatttaagaatttgttttcctaatggtataatagatgttcaaattttaggaattaaatgaggcatttcttccttctagtttgatggagtctttgagaatatttcttttcaaattgtaaaatatgtttctatgtctgctctcaatttagtgcaagagtagctcttgggggtagcaatatcaagtgttcctgggctrccacctggaaggtggaagtagtagatgtatgtgaacccgcgttcttccatcttttctttcctcttctgccttgaaatgcaagtgacataaaattaaaacaacacggaaaagtttcagttcctacaatggcagtgtagtgtattttcaatgaattcctttccagataaataattataaactctggacaaaatataaagcacaactatttgaaggctgtcgatgtacaaccaaatacgacccctaaaagaagaaaactacaccagtgagatgcacatttatgtggcttttcctctgaaagca

SEQ ID NO: 70929 - DNA, 601 bp, Human
tgcacgtgaatgcttacagcagttttattcataattgccaaaactgagaagcaatgtccttcagtaggcgagtggataaactggtatgtccgtacaatggaatattatttagcaataaaaagaaatgagctactaaggcatgaaaagacagtggaaacaaatacatattggtatggggaaaaagctaatctgaaaaggcagcattctgtatgattccagcgctaagtgacattctgaaaaaggcaaacctatggagatggtagagatcagtgattgccaagcattcgggggagggaggggraataaataggtggaacaggggacttgtaggcagtgaagctactctgtatcatactgtaattctggacacatttcattagatagttgtcaaaacccacagaatgtataacacagtgaaccttaatgtatggacttcagttaacagtaacgtattgatattggcttatcaattgtaacaaatacaccatacaaatgcaagatgttcataatagaggaattcatgtgggggaggatgtatgggaaattgaaattctgttgagtttttgtcaacctaaaactgctttaaaaaataatgtctttt

SEQ ID NO: 70930 - DNA, 601 bp, Human
gtatgtccgtacaatggaatattatttagcaataaaaagaaatgagctactaaggcatgaaaagacagtggaaacaaatacatattggtatggggaaaaagctaatctgaaaaggcagcattctgtatgattccagcgctaagtgacattctgaaaaaggcaaacctatggagatggtagagatcagtgattgccaagcattcgggggagggagggggaataaataggtggaacaggggacttgtaggcagtgaagctactctgtatcatactgtaattctggacacatttcattagatakttgtcaaaacccacagaatgtataacacagtgaaccttaatgtatggacttcagttaacagtaacgtattgatattggcttatcaattgtaacaaatacaccatacaaatgcaagatgttcataatagaggaattcatgtgggggaggatgtatgggaaattgaaattctgttgagtttttgtcaacctaaaactgctttaaaaaataatgtctttttttttttaaaaatctgctgaaggaaagacattgttaagaaaattcataagcaaaccacagaagagaatacttgcaatacataa

SEQ ID NO: 70931 - DNA, 601 bp, Human
aggtggaacaggggacttgtaggcagtgaagctactctgtatcatactgtaattctggacacatttcattagatagttgtcaaaacccacagaatgtataacacagtgaaccttaatgtatggacttcagttaacagtaacgtattgatattggcttatcaattgtaacaaatacaccatacaaatgcaagatgttcataatagaggaattcatgtgggggaggatgtatgggaaattgaaattctgttgagtttttgtcaacctaaaactgctttaaaaaataatgtctttttttttttwaaaatctgctgaaggaaagacattgttaagaaaattcataagcaaaccacagaagagaatacttgcaatacataaatctgacaaaggccttgtatccaaaataaagaactttcacaaatcaataaaaataaggccaatgacctaataaaaatgggcaaaaacttgaatataaatggccactgagcaccataaggtcctcagcattactagtcatgggggaaatatacatgaaactatgataagatgcggtttcccagcctctagcctggctagaattagaaagactgacaatgccaaatg

SEQ ID NO: 70932 - DNA, 601 bp, Human
ggtggaacaggggacttgtaggcagtgaagctactctgtatcatactgtaattctggacacatttcattagatagttgtcaaaacccacagaatgtataacacagtgaaccttaatgtatggacttcagttaacagtaacgtattgatattggcttatcaattgtaacaaatacaccatacaaatgcaagatgttcataatagaggaattcatgtgggggaggatgtatgggaaattgaaattctgttgagtttttgtcaacctaaaactgctttaaaaaataatgtctttttttttttawaaatctgctgaaggaaagacattgttaagaaaattcataagcaaaccacagaagagaatacttgcaatacataaatctgacaaaggccttgtatccaaaataaagaactttcacaaatcaataaaaataaggccaatgacctaataaaaatgggcaaaaacttgaatataaatggccactgagcaccataaggtcctcagcattactagtcatgggggaaatatacatgaaactatgataagatgcggtttcccagcctctagcctggctagaattagaaagactgacaatgccaaatgg

SEQ ID NO: 70933 - DNA, 601 bp, Human
atttagttatgtcgagcatattcatcctggctggctgatgataaagtggacagacctgggttagagctattattttatttgctttgtgagtcactgtttatgtgagttcttttttactggggtttttggtttttgtttgtttgttgaagaaataacttaattggtatcagctttgcaggtgactaataagttgcacagattaaatttttggtcagatgacagcatctttcactagaaatgtacttcgttaaaggaaactgtatcattactatggtgagttgaagttctaagaccttttccytattgtcagagagttgttcataaaaatcttctttgagactattttgaatttaatggatctgtgtaattcttttctaaacatttagcacataattgtaggtaattgttactatcataaatctgtctgtgctggttaaattaataagaatgtttcaaagtaagtattataaatgtattttcagtgattttgcagaaatagagcatgcattctttcaggtttgtattttttaaaatttatagcttatttctattgcagagcatatttatatctgccagttaactggcatatatgcccaaccca

SEQ ID NO: 70934 - DNA, 601 bp, Human
gtctgtgctggttaaattaataagaatgtttcaaagtaagtattataaatgtattttcagtgattttgcagaaatagagcatgcattctttcaggtttgtattttttaaaatttatagcttatttctattgcagagcatatttatatctgccagttaactggcatatatgcccaacccatccattttatttaaaaacccaaacaaaactagtttcaaacttatgtcaagccagaaggaatctttgcaaattttgtttgtagaagagtgaacttacaaatagatttcacagtttcgactctkttttggtatttagaggtcttgcacagtgaagcctttttcctatatcctgttaacatatcaccctgaaagaaattgttagaaaaaggctgggtactgtgactcacacctgtaatcccatactttgggaggacaaagcaggaggatcccttgaggccaggaattcaagaccagtctgggcgtcatagcgagatccaccccatctcttaaaaaaaaagccagacctggtggtggcgcacacctgtaatcccagccactcaggaggctgatgcagaaggatcatttgagcccaggagttccaga

SEQ ID NO: 70935 - DNA, 601 bp, Human
tatctcatcaccatctataaggtccctttctgtgggaaaatgggttctgggttggaacaggatgtcaggatcagcaatgttccaatgcctctggaagcagagacttgttacgtgatagaagaaattctcaatccctactccatcaggctgctacagtttgaaaaatattacagcatatgacatagattaaatggaagaaagatctcttgagtttatgctataattaaggaacaatttgtgagggaggcaatattttccttgaaggatctgttagtgtgagaagcagagagatgagatgagratccaaagtttctataaagaaagaggtttcagttataggggaaagtaagaatataggccgagagccgggacaactactcataataaaagctatagcatgtatacacctaatttaatcaacacctccctatcaatgcagatattgttacaatcttttatacatacataaggaaactgagacagacagtttgctccgggttttgtgtcagcttctgtgactcatcaaggcctgagttcaaaaccactgtcttgctctctgcctcatggtagcttggtttaagagtctgtcctaaccaaatag

SEQ ID NO: 70936 - DNA, 601 bp, Human
tggcagttttagcctgtgcattttatatcaaagggaaattagtttattgagaaataataatataaaattattaactctttttcttttcattctacttcagaatgcctgttattaaaccagacatagccaactgggagctctcagtaaaattgcatgataaagttcataccgtagtagcatcaaacaatgggtcagtgttctcggtgagttttctttctttattttcttggtaatcttgatgttatctatgaatatttaaagccatttttaacctgttcagtgactctcgtcttttgaattwgtagtacctctatgtatttttcatcttctttaggaagctgaatggaaatggaaatttttgttctcttatgcttattaggaaatacatttctagatttagccacatcctaaactcactttctgatacttgattcatttttcttttatgctgtgagaagtaatacttttgcctttgttacagagaagagcattttgaattacagttccaaatgtatgatagtggtggtaggtaaccatccttttaaaacaaataatctgaagcctcacataacattatctttaaatctcatgctgcaagaca

SEQ ID NO: 70937 - DNA, 601 bp, Human
gctcatgcctgtaatctcagcactttgggaggccaaggcaggtggatcacttgagctcaggagttcaagagcagcctgggcaacatggtgaaaccccatctctactaaaaatacaaacattagctgggcttggtggtgcatggcacacacctgtaatcccagctactcaggatgctgaggcaggagaagctcttcaactcagtgggcaaaggttgcagtaagctgagatcgtgccactgcactccattctaggtgacagagtgagaccctgtctcaaaaacaaaacaaaacaaaacaaaaaaaaaaaaccagtagataacataggggaaaagcttcaaggtattggatttggcaatggtttcttagacatgacaccaaaagcacaggcacaaaagataaattggactatgtgagagttaaacacttctatatatgaaaggagaatattttcccagaattttcatccctcctttaaaattttccattctaaacactataaatatataaatgtttcatgcaaatattttctcccattctgtgggttgccttcttactctgtttttttcccaaagtaaccactctgtcagagtacaatcaacag

SEQ ID NO: 70938 - DNA, 601 bp, Human
tatgaaaattctgggaaatgaatgcatggtaaaaatgaaagttaagtgaagtgttaatcgtaggagaagtgaagtattttatgtattttaggtctttattctgatttctgaatacagctgtctgaatgaatgacagaattaattaatagtataaaacctgctagacacaaagtagaaatattattcagcttgtcatggtgataagccgaaaagtacccaataacaaactgatttttattataattattttcatgattcccttctggattcccaggatgttttccatttctgtcttgctcartataacacaaaactggtcaaaatagtttttggccaggtacagtggtgcgcacctatagtccatccactcaggagaaaataagtttatgatgaattaaaatattaacacagttaatatcttaaagatggtgaaaaactaaattcatattgaatgtgattcacttgaaagaaagagttgaaagaagagtgtcagagtagtcctaatgtataagaaaattagttagaaatttggccttcctagcgatggaaaaaggagcactatacatgcactttttgaaaaattttgcctgatgtttcatgt

SEQ ID NO: 70939 - DNA, 601 bp, Human
gagattgtcctttgtacccactacatagctctactttaaaaagtcaggtaataacaagtgttggtaggccaggtgcggtggctcacgcctgtaatcccagcactttgggaggctgaggcaggtggatcacgaggtcaggagatggagactgtcttggctaacacagtgaaaccccgtctctactaaaaatacaaaaacaaaattagctggggcatggtgatgggcgcctgtagtcccagctccttgggaggctgaggcaggagaatggcatgaacccgggaggtggagcttgcagtgagcygagatcgccacactgcactccagcctgggcgatagagcgagactccgtctcaaaaaaaaaaaaaaaaaagtgttggcaaagaggtggagaaattgaaaccttcaaatgctattggtgggaacgtaaaagggtgcagctgctttggaaaacaggatggcatttcctcaaatggttaaatatctgggttattcagaaccttggctctgttgtatcaggagtatttaatcttgaatatttatataagtatttatgtatttctttattactatggtgaatatatcttacctttcaaataatatt

SEQ ID NO: 70940 - DNA, 601 bp, Human
gagacggggtttcaccctgttggccaggctgatctcgaactcctcacctcaggtgatctgcccgcttcagcctcccaaagttttgggattacaggcgtgaaccactgtgcctggccaaaaattcaattttaagtaaatctgtttaaatgtttttgtgtaacgttttcataaaaatgaaaaattcgatgaacttagaatatgccaagaatcttctgcacaaaataataactttgtgttctcaaatagtaatataaagaatctgtaatgtatcttcattaagaatttatacatgcattttacmtcataatctcttttattctatgaatagagcataatactaaattatgaagttactggaatttttataggaacatgataagaatcatgtggttcttttaaagagttaattttggaacatcttttgttcaaaaaatagaacattattatatgtattcttttgcctctattgtcagtttttaggataggcttttaatcttgaacatgaaaaggacatcagtaaacaaggtgagttaactattacatttatgcctattataggcttttagtttaaaaattacctatggcttaaatacagagaagg

SEQ ID NO: 70941 - DNA, 601 bp, Human
ggtatcaaactgcctgtcagactggaatagttaaataaatatgatacattcataacattgaaatactgtgcagcctttaaaaagttgagagtgtcttctatgtgctgctttctttttttttaagacggaatctcgctctgtagcccaggttggggtgctggggtgcagtggcgcgatctcagctcactgcaagctctgcctcccaggttcacaccattctcctgcctcagcctcctgagtagctgggactacagatgcctgccaccatgcctggctaattttttgtatttttagtacagaygtggtttcactgtgttagccaggatggtctccatctcctgacctcgtgatccacccgcctcggcttcccaaggtgctgggattacaggcgtgagccaccgcgcccagccctgtgtgctgctttatcaagtgacagaggcaaacgacattcattggcataaaaaagaatgtgtgtgtttgtgcttgtgatatccacagaatatctttggaaggagccacaagaaactgggacccatggttgcctgtgagttggggagctggagggctgactccataacaagtgagaaggatacatctctta

SEQ ID NO: 70942 - DNA, 601 bp, Human
ggcttcccaaggtgctgggattacaggcgtgagccaccgcgcccagccctgtgtgctgctttatcaagtgacagaggcaaacgacattcattggcataaaaaagaatgtgtgtgtttgtgcttgtgatatccacagaatatctttggaaggagccacaagaaactgggacccatggttgcctgtgagttggggagctggagggctgactccataacaagtgagaaggatacatctcttagatcatatctttttagtattttttgaattttgaaccctacatgtgtattacctatttttttwaaaaaacatttcaaaattgtgcagtggaagggtctgtaagatggagcagtgttgaaataatggagccttaattacctttcaagaaacttctgcagtgacttggccatccggggaagcaatcagaaaagcagctggctcattaaatggagagtgctggtcccacaggtgtaagtacacaaaacgcaatcactgaaattctttggctagcacttccaactcggagacagttgctggagatcacttaataggctctggttacaggttgatctaatctgaattaagaaattggaaaaagcaaag

SEQ ID NO: 70943 - DNA, 601 bp, Human
cttggttcaagcaagaacatccaaaagtaacctgatgtaccaatgtgactccttatcccaagctaaagaatatcctttcaaggcaaattcatccaaatcagcttgacatctgatgggagggggttggataaacaaggttgtagagaaatcaagtctgaagagtaaccttgcacagcttgatctgtttactttttaaatgcaggtttgttcagtgggtatcgcactctacttttgaaacataggactaaattttcacaaaaatgtgaagatcctgcccgtgtactctggaaaattgcttgtytaattgggtgcacagctgcacctgtaccctcttgaatgactcagtcatggtgtgctcaagggccaagtaacttgttatggtgctaagtgaagaacaaaaatatataaaattcagttactttggcaatgaaaaacactgaatggtattggttgttatattacagttggcaaatactgtaattaagacttcaagtgatttttagtattagccctggattcactttctgaagaattttatttagaataaaactttcagcgttgataccagatagtcacctttagttcagttcagtttcataaa

SEQ ID NO: 70944 - DNA, 601 bp, Human
aggcatggtggcacatgtctgtggtcccagctactcagggggctaaggtgggaggatcaagtgagcctgggaggtcaaggctgcagtgagctgtgatcgtgccactgcactttagcctgggcaacagagtgagaccccatctcaaaacaaacaaacaaaaaatgtaaaactcacaaatttaaaaaagttttaagaccaggcgcaatggctcacgcctgtaatcccagcactttgggaggccgaggtgggcagatcacctgagatcaggagttggagaccaacctggccaacatggtgaaayccagtctctactaaagatgcaaaaattagccaggtgtggtggtggtcacctgtagtcccagctacttgggaggctgaggcggagaatcgtttgaacctgggaggtagaagttgcagtgagccaagattgcaacattggactccagcctgggtgacaagagtgaaactccgtcttaaaaaataaaaataattaaaaagttttaaaattcactttggtatgatattttgacccctcaaagttgtttataaatagaatgaacagtggagccatctgttaaaatgccttggctgagtgactcag

SEQ ID NO: 70945 - DNA, 601 bp, Human
aagtgaatctcctgcctcagcctcccaagtagctgggactacaggcgcacgccaccacgcccagctaatttttgtatttttagtagagacggagtttcaccatgttggccaggatagtcttgatttcttgaccttatgaaccaccacacccagcctctgttccatttttatatgaaaggacaaaggagcgggtggagatgaagggagagttggtgacttattcacctgtgatggctgctgtgggggaagaggtgaggtgagactgggaggagttgattatggcattagaaattggaagtamgtggaatgttgttgaggctgggagcaagaattgacttaaacacaacagaagggctaggctaaccaagcttccatttgaagtcgtggagcaggagttgatggggtatcaatccatgtggtcagatagtgcaaggcagctctgcatgtccaggaggccaggacacagggaggctaggcggagaggtgccagtgagggaggtggagataggcagatcctgaagggcctttaaactatgggtttcgattttattgtgacattattcattatctagccagcttttataggagcagtttataaagt

SEQ ID NO: 70946 - DNA, 601 bp, Human
gaaaaagctctaaaaatcttggtagaaatatagaatctcagaaggcagaacatttggtaattatcttttatatcaatttgcaagacaacttgttagggagccctatttctagtagttgaagttaataagtaacaaatcacagcaatcacgttttttatcatgcagagtgggcagtcttataaaaaagaaacgtcagtctttttggatatagggacacaagcaatcatagttttcctctgttatctttagtttgtaaaaatcaacctatctaccatcagcatttacccacaaggtttagttyggagttacctaaggggatggtagagaaacaataatttaacgttatgctgaaaacaatagtctctgaagatagagaaacctctgtcacttaccagttgtgtaaagttggaaaagttacttagcctccctgaaccactgcagcagtggtgtttacctgaatgttggcatagaggaaaaccaagggtcacgaggcaggtggacttgagtttaaataccaatcctgaacctgctggctgtggaatccagcagaagttagttatcttttcttagccttagttttccttatctgtagaatagggat

SEQ ID NO: 70947 - DNA, 601 bp, Human
ttttttttatttttttttaattgtatcttgggaggccttcatgagtgaatgtagcttgctcattattttttgtaccattcccagtcattttctactcattcctttccttactagttttcagtttggccatgttctgtgtacaatttctggtaagtgctaccaaaaccaatatatattagacatgctgtttttcaagactcctgaaaaagtgccaatcttattctcctttcagtttgggagcacagtttcacaaataatagaatagtcttactttgtttgcagaattagaaggatttatctracaacttgaatagataattttttttttgtagacgtgaaagtgaaaccttagtattgggatagaattttaagtagcattttaaatttgtttcaaaatcttttcttattgcctgcctttcattaaatgagctatggtaagtatgctggggtgtatacgtgtgcgtggtgatgagatgtttacctctgtgtggatcccttgtagattttgtattgtaaaagtgcataatagagtcctttatatagctggaataactgtaatctgctattgtaagcatatatggatttttaaatacaaccatta

SEQ ID NO: 70948 - DNA, 601 bp, Human
ggtatgggtgggtggtattggtaggggcaggggggatgaggcagaaaatcaagagcaaactgaacaaaatgaatagaataggtgtcaggtcatggaagatggatggtagaattctgttaggctgaattggctagtccaaatttaaaaaatagtaggactaaagtttaggatatagtgcctgtgcacatttgctgaatgtaagagaaagtgggaagaaaaattgaaatgatagttagattgtgaccattagtacagaagacccagaggaccatgtggagaacttaattttttttttttttttaattaagcaaccagaagccaagaaggattttgaactgagaaaacttgtaagacacagtaaagccacatttgtaactggtctatcgaagtgaatacaactgtagcaggttggagatggggctttgggaaggttttcttgtttgatgggattgtcagtagtaaaagaaatgggaaggaaaagagttcacattcagcttagaagttgagaacaaaatttggggagatagatgagagagatgtcaggtaatagttgggggttgggaagggccaaacaaacaacactcagttattggcatgtgtg

SEQ ID NO: 70949 - DNA, 601 bp, Human
aattgaaatgatagttagattgtgaccattagtacagaagacccagaggaccatgtggagaacttaattttttttttttttttaattaagcaaccagaagccaagaaggattttgaactgagaaaacttgtaagacacagtaaagccacatttgtaactggtctatcgaagtgaatacaactgtagcaggttggagatggggctttgggaaggttttcttgtttgatgggattgtcagtagtaaaagaaatgggaaggaaaagagttcacattcagcttagaagttgagaacaaaatttgrggagatagatgagagagatgtcaggtaatagttgggggttgggaagggccaaacaaacaacactcagttattggcatgtgtgttaggccgtttctcacactgctgtaaagacatacctgagactgagtaatttataagaaaagaggttttagttggcacatggttctgcaggctgtgtaggaagcatagcagcatctgcttctggggaggtctcagggagcttccaatcacggtggaaggccaaagaggagcaggtgcatcacatggtgagaaccacagtgagcgggggtggggatgtgc

SEQ ID NO: 70950 - DNA, 601 bp, Human
gaagccaagaaggattttgaactgagaaaacttgtaagacacagtaaagccacatttgtaactggtctatcgaagtgaatacaactgtagcaggttggagatggggctttgggaaggttttcttgtttgatgggattgtcagtagtaaaagaaatgggaaggaaaagagttcacattcagcttagaagttgagaacaaaatttggggagatagatgagagagatgtcaggtaatagttgggggttgggaagggccaaacaaacaacactcagttattggcatgtgtgttaggccgtttctyacactgctgtaaagacatacctgagactgagtaatttataagaaaagaggttttagttggcacatggttctgcaggctgtgtaggaagcatagcagcatctgcttctggggaggtctcagggagcttccaatcacggtggaaggccaaagaggagcaggtgcatcacatggtgagaaccacagtgagcgggggtggggatgtgccacacacttttaaatgaccagatttcactaaggagatggcccaagtcattcatgaggaatccacccccattgttgcaggactttttcttggtttag

SEQ ID NO: 70951 - DNA, 601 bp, Human
acacaattacctatttgcaaagagagaactgaggaggagaaagaagaaaagaaggcgttttttttcaaaggagtcctgggggtcccggatgcattcaaaaggcgtacaaactgaagatgaatggctacctatctagaaagaggggagcaggtgtccctggttcccttctcttcctagcagatactcagggttagtgagggagagaagagagagcatcctctttcctttcttctatccttgcatccctgaatcccagcaaccttggtaggtgctgccatggctgtcaaatcaacttgcaccrgtgaagcagggggcctagggggtgagaatcatccactcttacccacgtaacgccctatctcccctgctgtcagtagctttgaattctgtatgccatggatactaatgtggcctttatccatgaaacaggaagccttggggttggcttaatcagcaggaatcagccactctcacctgtgctgtgccttttaaccttggtgttgtcatctgcctctggatcccttacatccagttttctttctagggctttgacccgaagcttggaattgagtcgggaacacaaatgtgtctcgaggggagt

SEQ ID NO: 70952 - DNA, 601 bp, Human
cacgtgaactgaaaggtatcacagtttttatcttccctttaaaaaatattagatccaagtgcttgtctttgtttaggccaaattaattagagctctttttacagataccacacacagtatatacacagacaggcaaaagaaaacccagtcactgggtggggccctttaagagacagggctaggaagacatgcagatatggaaccagagagggctcatcccctaaggcaggattgctaaacaaagccttgccactggagttagaagccatgccctcaggatgtaaaacaagatggaagcctratttcacaaccaacaccttgcagagaatacaaacagtgatagttccggggtgggggtctggcctagtaaagtgttttctaaaagagaaaaaacttaaaagttaactgttgacagggtaaagtaggaaaaaaacaacaacaaaacaacagcaggttaaaaaatgcctaggaaagaaccttttattctcatgcaagtggttctttcaccgaggagagaagcttaagcttaattactgtccgatggagttgaaacccttggctggggaaggggaaggctccagtggctcgtggcagaaaatgc

SEQ ID NO: 70953 - DNA, 601 bp, Human
aagagacagggctaggaagacatgcagatatggaaccagagagggctcatcccctaaggcaggattgctaaacaaagccttgccactggagttagaagccatgccctcaggatgtaaaacaagatggaagcctgatttcacaaccaacaccttgcagagaatacaaacagtgatagttccggggtgggggtctggcctagtaaagtgttttctaaaagagaaaaaacttaaaagttaactgttgacagggtaaagtaggaaaaaaacaacaacaaaacaacagcaggttaaaaaatgcctrggaaagaaccttttattctcatgcaagtggttctttcaccgaggagagaagcttaagcttaattactgtccgatggagttgaaacccttggctggggaaggggaaggctccagtggctcgtggcagaaaatgccagccagccaccccgggtgcccttggaccatgtgtccaagcctcagcagtggaggagggaggtagggagctgctgctctctggtccctcccaaaaaaggaagaaaagggctatggaaaggtcgggttggttctcaacccctgggagcagcaggcggtgggggcacag

SEQ ID NO: 70954 - DNA, 601 bp, Human
ataaaatgtattctttactgctcagaaatgttagcagctagggaatctgggtgaagggtgtaagggaactccgtgtactattgctataacttttatgtatatctgaaattgttttacaagaaacaaacaagatacaaagaaatacctccccaggatgtttattagaacaatagaggctaactataccatttttctatttcttattaggtgcaataaaaggacactggtaactgtaaatttaacagttaaaagtaaggtcatggcggtggcttacagctgatagtgccctgtatactctgtrcaagtgcatgctttattatgatcaacctaatggatagttagttttgtttttttttaaaccagggtcttccttgagatgtaatgggcacagagtaaacggctgattgttagcttattctgtggatgtatgtgatgagtgggtctggggcatcagtttctatatctcacctttacctatcaaagaaattggacaaaccatgatagcaaacaaatgaaaagaaaaaggagttttattgttcatgcttacaaaagaatcctgttaatcaatttgtaatccaccaattattttgggaataaaatt

SEQ ID NO: 70955 - DNA, 601 bp, Human
ggactactaggggaaattctgagtgtctaaggatagtactagaatgctaaacagtcacagataataatataaagtaggtaggattaacaagaaacagcacatcacagtcacaatgtgtgggaattaggcaaaggaaatacgtagccatttttatggacgtcttatagtccacttagacaatagatgtattctgtggtggtaaaccaccagcttaggtaatgggatttattggaggacatcagtggtagcaaaatacatatgaaaagcaaaagcatactaataggaatctgatgaaattaasagaataaataatggaggagatattagtgaagaacaagaaaaattgaagaacagtaaaagtaggcatgcttggaaaaggagaaaaatagatctctaataatcatttttggggaggagtatagagcgtcactaagttgaactaccaccaacagccagcattcattgagggcttattatgtactaggtgctgttctaagggcttgacttcattcctcacaaccactccttgaatatgcattttacatatgagaaaatggacacatgaacaattaggttacttgtggaactgaggttcaaacac

SEQ ID NO: 70956 - DNA, 601 bp, Human
cacatgtgaacttaagtgaaatactctaaggagtattgcaaggtaattgcccctataaattacataatttatatggctctttaacttttttagatgtaaaatgggaggaggagagcgttgagttggagtgtattatttctaggattctttctagcccacaagtcgaatcagaaaacagtggctcatgcctgtaatctcagcactttggaaggctcaggtgagaggattgcttgaggccaggagatcgagaccagcctgggcacatagtgagaccacacctctacaaaaaaaaaaaaaaaaattagccaggcatgatggcaaacatctgtaaccccagctactcaacccgctgatgtgggcaaattgcttgagcccagggggttgaggctgcagtgagctggatcccaccactgctttccagcctgggtgacagagtgagaccctgtctccaaaacaaaacaaagcaatcagaaatgtacagatctttttccacagtttgtgcagaacagtcacttctaagatatactatgaaagtctattacaggagcaggaactagttattcctttctgagaattagatataacttgaccaacaaatcgg

SEQ ID NO: 70957 - DNA, 601 bp, Human
ctcaacccgctgatgtgggcaaattgcttgagcccagggggttgaggctgcagtgagctggatcccaccactgctttccagcctgggtgacagagtgagaccctgtctccaaaacaaaacaaagcaatcagaaatgtacagatctttttccacagtttgtgcagaacagtcacttctaagatatactatgaaagtctattacaggagcaggaactagttattcctttctgagaattagatataacttgaccaacaaatcggttttttatccttcatatcatcttcagaagtagaagcaagrtatatgatcaaagtctttttaaaaatagcagaataccggggtttttattttatattttcactctgcacaatgctaatctccttaacatttgatgacaaagaaaaaacttggaatttgtgtatgacaaaaagaatgacttatgaggtgaatcgaaaacactttttacagcctctgtcttcctaaagtttattgtttttggaaatagttttttggcaaatattttgttttgtaagttttacatttctaaagttgaataaaattaaatgtttagcaggtgcttgttgtaatagaagctataat

SEQ ID NO: 70958 - DNA, 601 bp, Human
ggagtgcagtggcatgatctcagctcactgcaacctccacctcccaggttcaagcagttctcagcctcttgagtagctgggattacaggtgcccacgaccatgcccatctaatttttatatttttagtagagagaaagtttcaccatgttggccaggctagtctcgaactgttgacctcaagtactccgcccgcctcggcctcccaaaattctgggattagaggcgtgagccaccgtgcccagccaaatcatgtttttgaacttgttttaaatatctgtgtgtgtgtgtgtgtgtgtgtgtatgtatttttttttttatggagtcttgctctgttgcccagggtagagtgcaatggcacgatctcagctcactgcaacctccacctgccgggttccagtgacctcagccgcctgagtaactgggattacagacactcgccaccacgcccaactaatttttgtatttttagtagagacggggtttcaccatcttggccaggctggtctcaaactcctggccccataatctacccgccttggccttccaaagtgctgggattacaggtgcgtgagccaccgcgcccgaccagtattatgtata

SEQ ID NO: 70959 - DNA, 601 bp, Human
gagaaccagttggagatatggaagatgtatgtggggaggccagagtatcgtggcagtctgcctgagagatgcagtggccggggtttggtctaagatgttattggtggagacggagagaatttgcggtatttgagagccactccagcctccattatttctaattctatgtcctctacccttctctgtcatctctccactgcctcccagccccttccactgtgccccctgtattgcccactttcagaccaacagccttttgtatcagccttttctggaatgttccactaattacttaccctawctaaaaccttagggtagttttgttctcataccacacgcacctccaagacaggaggtgggattactttcctcctcgtgtcattcaggacgactgctccgctctttcttgtaagccctttcttttttgaaatcacatcatcagtcttcactacctcatcttcctcttggcaaccttcagctccccttccctgtatccctctccctgcacgtgaagaccagcagccagttcctggtctgtctgtctgtctccatacaatcattattccctgtattttctctccatccacagacaccactcctg

SEQ ID NO: 70960 - DNA, 601 bp, Human
tggccggggtttggtctaagatgttattggtggagacggagagaatttgcggtatttgagagccactccagcctccattatttctaattctatgtcctctacccttctctgtcatctctccactgcctcccagccccttccactgtgccccctgtattgcccactttcagaccaacagccttttgtatcagccttttctggaatgttccactaattacttaccctaactaaaaccttagggtagttttgttctcataccacacgcacctccaagacaggaggtgggattactttcctcctygtgtcattcaggacgactgctccgctctttcttgtaagccctttcttttttgaaatcacatcatcagtcttcactacctcatcttcctcttggcaaccttcagctccccttccctgtatccctctccctgcacgtgaagaccagcagccagttcctggtctgtctgtctgtctccatacaatcattattccctgtattttctctccatccacagacaccactcctgtttttacatcctttatccaatccctggcctggcattatagtcactcactcatgaatacccttaactgctcactc

SEQ ID NO: 70961 - DNA, 601 bp, Human
aaatcacatcatcagtcttcactacctcatcttcctcttggcaaccttcagctccccttccctgtatccctctccctgcacgtgaagaccagcagccagttcctggtctgtctgtctgtctccatacaatcattattccctgtattttctctccatccacagacaccactcctgtttttacatcctttatccaatccctggcctggcattatagtcactcactcatgaatacccttaactgctcactccttcattcttccatcagtctcaaacttagaggaactctgcctccaccttcccyatgcctgcgcatgagcaccttaccatggctggtgaacgtcccataccaagggcacagttaacatgcgtctgctggtcagggccagctgagcatcctacactgggcagaagggttgctgtttctctgataacttctcctcccttatcctcagtgattccttcctgtcttcaccactgtattcacatgtcccacgctcctgctgcagctgacactacttctgaatgtccctcttctctataccaccagggctctagatctgatcaccatgacttttagttttatttcctctaattcattgtc

SEQ ID NO: 70962 - DNA, 601 bp, Human
ccgtctctactaaaaatacaaaatattagccgggcatggtggtgtacacctgtaatcccaactactcgggaggctgaggtgggagaatcattggaacccaggcagtggaggttgtagtgagccaagatcatgccatcgtacttcagcctgggcaagagagtgagactccacctcaaaaaaaaaaaagaaaaaagaagaaaaaaaaggacagcagacaatggcactctgcaggtggaactgcttcatgtttcccactcctgtccctgttcttcaagagccggcctccccttctctctgctccatccacatgggtttcaaagaagcttagctctttctcaccccagggtttttttctttctttttttttttaaatatgatattccttctagaatattcccacacacccatcactagcatacttaattcctactcacccttccagtctttgctcaagatcacctcctcagagaggtccttcttcctgctgacaagtaaagaataatgagaattcagaagaggctatagaaattggctgggtgtgatggctcacgcctgtaatcccagcactttgggaggccgaggtgggtggatcacttgaggt

SEQ ID NO: 70963 - DNA, 601 bp, Human
cacagtgagaacctgtctctccaaaataaattaataaatatataaatctggaggtggtagctcgtgcctgtagtcccagctacacgggaggctgaggtgggaggattacttgagcctgggaggtcaaggctcagtgagccatgatcatgccactgcactccagcctgggtgatggagtgatgccctatctcaaaaaaacaaagacattaaccatctaaatacatctgaaataaaagggctttgtaaccacagaattatagatgtagcagagatatttgaccttgttagttcaggtctcttycagatgaggaagagagattatctgaaacacattgtaaaatttggtgttgtagttgaagtctgtaaatctacaaccagagaaatagaaattagtatccacctgttaactcaaatgcagtttaaaaaaaacagctacgatttattgtgtgcctactagtgaaaggtctgaagtggttgttgattgcatattgtaatgacagagaaaatgagcacacttcacttgaaaaaaaaactttagagtggatgtagtggctcatgcctgtaatcccagtactttgggaggccgtggcgggccaatcat

SEQ ID NO: 70964 - DNA, 601 bp, Human
gcccacctttctctggtattaacccgtggttcaaagagacattctctacttctcctttggcctatacttccatctagattccctccttggatgctagcatcattagaatcactgtacctcttattcgggattatgtatctgtgtattgctagaagcctgagaaggcctgtgatggctttccacacatcccttgccccgcttatactggcagataggtttcagtttatgatttggagtcatgatagcttccttgtttcagttgtgtagggaagttgcaaatttctactcatgactcattgtrtagatgatgaaatgtagtgtattttctatcacctatcatctttgtcagaggccctctacctttagtagtggatggtgggaagaaaaatttgtgagtaaacaggatcttggcctctgttggtttaaacagtctctttggggtaatgtgtttcagttttcttctatccccagcttctgctgaggtgaggtctgggagcagtgagagaggcctttgggaatgatgcttagatctgcctcgcggcgctggcatggggagaacgtagactcacacgcagtcttcctgaggctttgctacgagggc

SEQ ID NO: 70965 - DNA, 601 bp, Human
tattttttctcatttttttaattttctaactcctgtcttttctcatattttataacttaactcatattatataactttatataatattatatcagtataaattatgagttgaaatagtttaagactcttgaaaaaaatatcactacataatttcacattacttagatccatgtattattatgtctttaaaaactgtggtgtctgggcacggtggctcacgcctgtaatcccagcactttgggaggccaaggcaggcggatcacctgaggtgaagcgttccagaccagcctggccaaagacrgtgaaaccctgtctccactacaaatacaaaaattagccgggtgtggtggcgggcgcctgtattcctagctacttgggaggccagggcaggagaatcacttgaatctgggaagcagaggttgcagtgagccaggatcacgccattgcactgcagcctgggcaacagaacaagactctgtctccaaaacaaacaaacaaaacaaacaaacaaaaaactgtggttttgttatactggtttatgttcgatagactgtacagtgcatcgaatatgttatggctcaagtgtttgtcagagggacat

SEQ ID NO: 70966 - DNA, 601 bp, Human
ataataataataaataaaataaaatacagataccaggccgggtgtggtggcttaagcctgtaatcccagcactttgggaggccgaggcgggtggatcacctgaggtaaggcgtttgataccagaccagtctgacctgtaacatggtgaaaccctgtctttactgaaaatacaaaatattaaccggggatggtggtgcacacctgcagtcccagctgctcaagaggctggacccctgcactccagcctgggcaacaaagcaagactccatctcaaaaataaataaataaataaataaataatcaaacaaacagataactcgttatgccagcacaatttaatgatagtcgtgcttctcttcccttactaccttgccaccacctcacctttccaaccccgaaattctttaaaagcggtttctgtgattctcaattaattgtaaataaaaagatgatttttcgcttaatacgatcctcagtatatttgcttctgtgagctctcagtcagttgcactcttttattttttgttaatcttctggaaacccttagccaagggcatcagatgatatttgagatacaccttagaaaaacgtgtttgtgaat

SEQ ID NO: 70967 - DNA, 601 bp, Human
ttgtgtgaatatactacatgttgtttatccattcctctgtcaacggacatttgggttgtttctaccttttggctgctgtgaattatgcttccatgagcatgggtgtacaaatatctgtttgagtaccccattcttttgggcatatgcccagaagtggaattgctggatcacgtggtaattgtatgtttaattttttgaggaacctccatagttgctgcaccattttacattcccattagcagtgcacaataatttcagtttcgtgccatctttgttaacacttgttattttctgttttgtyttgttttttaataatagccatcctattgggggtgaagtggtatctcattgtggagcaggacttatctagatagtaactgaagaaaaagcattccgaatacttctaggatgtgtccttcctatattggtattactctgtaaccagttcactgcacaagtggcacttttttcagtccaagtagaagcaagtttcttagagctgtttttttttttaaaccctttatttcaacttctttccttcccatatataaaaccacataccattctaacagtctgtaatgttgctaccaggtaataaaca

SEQ ID NO: 70968 - DNA, 601 bp, Human
atgggacaagacccatctgggatgacggtcttatgacctgctactgttgtagagaagggtaggccagagaatttctttatgagcagctcttagaaaggcagggaggggttagagtcctgtttctggtttcatagttgtctttgcgggagaggaattctgatgtctgtgactcatctcaggagagaatgaggggtgagagacaggaaggcagaaggtcagagatcttagttctgaggttacttctgaggccttctctttggggtatcattttctgagcctcaacaatacccttttctacttsagagctgctatattgggtctctcagaatttgcagtatggggtaaagatgagaagagcatggcaggaagaaccaggttttctggggcagaggcaacctggcattcactctcttggggcatggcagatgtccaaagctggccggtagccctgggatactttcatgtggatttgggggaacttctcacctgcagaacacttaatgcctcctgtcttttccagttgcctttggtctcctgagcaactactgtgttgactctgaatgttctcactgggcatggtccctcataatgaccccgcctg

SEQ ID NO: 70969 - DNA, 601 bp, Human
ggcggccaggtgtggtggctcatgcctgtaatcccagcactttgggaggccgaggcaggtggatcacctaaggtcaggagtttgaaaccagtctggccaacatcgtgaaaccccgtctctactaaaaatacaaaattagcctagtgtggtggtgcatgcctgtaatcccatctacttgggaggcaaagacaggagaattgcttgaacccaggaggtggaggttgcagtgagctgagatcgagccattgcactccagcttaggcaacaagagcgaaactctgtctcaaataaaaaaaaaaagagagagagagaaagaaaatgaaactgtactccacagtgtgggagcgagcctgagcagtggctcaagggcccggataccgaatcttcttggttccaaatacctgctagaagttttccattgattactttatactcacctcatgtaaatgaagttgcagcctataaggttgcagaaagcagccaaccagaggctgaagtgaagttacaaaggtcacactcctgtgcaaacatgttgcaaagttatactcttatgcaaatgaagacttggctggcaatcagtctgattggttttggacagcaa

SEQ ID NO: 70970 - DNA, 601 bp, Human
ttgtcgttagcgttttacatactagattttcatcgtgcatagtcacgttgtttgaacatttgcaagcagagccgactaactgctgttggcctgtttctttgtatggcgtgatttcttctatccacctgctcacagcaggttgccttcaggcctgaggagtagctaaatacttttgaaaatatcttgagatcctgctaaggtctaacaatttctgcatttgtgtgatgtgaagctattcatgctgtacctttgaagacttttttctttctatttctcatattcttgctcaaatattttcaaragaagataaatttattataaataacagtgcagagctgattgtagcaccactgcattctatattgaataggtctttgatattcagctaagtggaactaattttctatgttaaagcagacaaatttggaatagtgtcacatgaatctcatgttatttactgaagaataccagattaaatggattagttgtgaaatgactagagtattaaattatatatatatatatatatatatatatatatatatatatatatatatatatataaaacgtgataacttaaaatgcccagtgggcctatgta

SEQ ID NO: 70971 - DNA, 601 bp, Human
taatgtagtcctagaagcttagcagttttctgggttttataatttggagttgcttttaaaatttaaccgaatgggaaaatgtctttctgaacttccccttcccacacccccacacatacaagcttttctcctcttctgttaactagaaaattatattttcgttgctgcctgaggaagagaattttgagtagtataaacactgattgtagtaaatgtggaaaataatacaaacagctgcactgcagaccgataagacaaatcccacagtaatggcctttaaaacatattaccaagttggaartcagtgaggggaaaaagaaaactattactatttcttcctcttactgttcagtgacattatttttaaaggtgaaattacctctggttttattatcctaggaaggtatttttggaacatttgatttattgttttgcaaatgtttttgcctttgtgtgaataactttgctaattttgtatgaatttgattctaacaaatgttgaagtcattttgttaacaaaatcttctaaagtattttttaaagaaataaaaaggaatatattatgtaaacattggagcagactatcaaaataagaaaagga

SEQ ID NO: 70972 - DNA, 601 bp, Human
aaatattttaataagcgtggatatgtttcatcaaatacaagtcttaatttttatgaagaattttgctattagcatatcaagtggtcagttcatatttgttttggcatgcattagactcatgataggcattgaatactttgttttttgtggattctaaaactgaattatcttaatcctaggctctaggaaaagtatatcttactgctagggaagattgaaataaattccagttctgagtgaaattttatttctgtttttctttacatcaatcttttctttttccttttttcttttttttttwttttttatttttgagacagagtcttgctctgtcactcaggctgtagtgcaatggcatgatctcagctcactgcaacctccgcctcccaggtttaagcgattctcctgccttagcctcctgagtggctgggattacaggcgcgtgccaccatgcccggccaatttttgtatttttagtagaggcaggatttcaccatgttggccaggctggcctcaaactcctgggctcaagtgatccgccttccttgacctcccaaagtgttgggattacaggcgtgagccaccacgcctggcctgtcct

SEQ ID NO: 70973 - DNA, 601 bp, Human
tgctgtcttttccttagtctcttggaaggtgggtcttaattcagccagcagtgcccaacacagttgagaggtagatggatgattagatggatgaccaacgtagaaatgccagtgtcaaaacctaggaatcaaccctccgttcttaactgagtctccctaagacacaggaaaggagtctattttattccattttgttttctgtctttttttgcctttattaagttcaacatgtgtgtataaaagaataggaaaaacagataagtgaaaacgagagtcaactaatatttttgcctagaaatamgttttatgtgcactaattctagaatttttctgtaacataattttttacaaggcttattctgaacatattgttttgttcttcttgcccttagaaataaactgtaagcgtttttcatatcttgaaactttttaaatggcaggctggatatataccacaatttacttagctagtgtctttccccgtcatttacatttcttgccattgttcagttctataaactacactgtgatatttgttcagctttatttttctgcctatccttacattttttcctcaggataaattcttagaagtaaaatg

SEQ ID NO: 70974 - DNA, 601 bp, Human
ttgtttaaaaaggtaccttatttggcttggtgcggcagctcacgcctgtaatcccagcactttgggaggctgaggcaggtggattccaaggtcaggagtttgagaccagcctgaccaacatggtgaaaccctgtctctgctaaaaatacaaaaattagccgggttgtggtggtgggcgcctataatcccagctactcaggaggctgagggaggctgaggcaggagaatcgcctgaactgaggaggtggaggttgcagtgagccacgattgtgccactgccctctagcttgtgtgacagagygagaccccgtctcaaaaaaaaaaaaagtaccttattttaattttcatttttctgtttattgctattgtatttgaatatttctccatgtattcattcaccagatatcatttctaatctgtgaaatgtctgttcatgtcctttgggtacctcattcaggatatggattcatattgggcatttcagataactctggagtttattaagaatatcagaggtattctgcaagaatatcaagaggtatttcaggcgagagagcttgcgtgaaaaagggttttgcagccattgagataggaaggatgt

SEQ ID NO: 70975 - DNA, 601 bp, Human
agatgtgtgcgtatgtgtagagagaaagagaaagatagatctaaggaattggctcaagcaattgtggaggcttggcaagactaaaatctgcagggtagatgagcaggctggagacccaggggagcgttgcagttcaagtccaaagacagtccactggctgaagccctccttgcttggggaggtctgtctttttctcttaaggcctttaacgggttggatgaggcccacccactgtggagggtgatctgctaaactctaagtctactgatttcagtgttcgtctcatctaaaaatatcttcratgatacatctcagtgtttgacctaacatctgggtaccatggcctcgtcaggttgacacataaaattaaccatcacagaagtatatatcctatccctagaggtttttaagttattagcaatagataattcttccagaaaattatgcatcttttcatgcaataatagatcttggacacctttctgtgtcagtccgtaagatggacctcagtcgccttaagggccacacagagctgcattacgtggatggagaggactgctttcactcctcagtgttcgtgctgggaagtccactcatgctg

SEQ ID NO: 70976 - DNA, 601 bp, Human
ttttgggactgtggagctgaactaagctgtcttccatggataaggaaactgtatcttagaaaaggtcacttgacttccccaaggtttcacgtctggctggtgtgtagagcactaaagggtatacagatttcctggctctcagttcagggcctgttccatcagcaggtgcccttcaatttcactcccttttatccacttcaggcacccaaaacatgctagcataaaaaaacacaagaaacaaaaacacaccacatgtacacacccctacttaaatggacaacaaaagtcaccggaaaaaaggaaaaaaagaatgtctttttgatttgttttgttttgtttttgtttttggagacagagtctcactcagttgcccaggctggagtgcagtggcgcgatctcgatatccgctcactgcaagctccgcctcctgggttcaggccattctcctgcctcagcctcctgagtagctgggactactggtgccggccactacacccggctaatttttttgtatttttagtagaggcagggtttcactgtgttagccaggatggtctcgatctcctgacctcatcatgatccacccgcctcagcttcccaa

SEQ ID NO: 70977 - DNA, 601 bp, Human
gtacaagcatctttgaaaaggtagttcagagcaaagaacaatcagtgtcttgctcacaagaagtggaaaaatgcaagagacctgggggtgaattgtctcctggtagtgatgtgtgtcacttttggtcagagatagctaagagcaagtgtgagccctctagtccctgccatgccccccttggaggttgtgtgtgacgctgatgctcctgtcagcatgagttccttctgaagagtggcagtgagcactgctacttgcaagctgtagtagactgggatctcagtgttgacttattgctaatgcrtagcccagcttatcctgatacatagtctgggaacatgaaggaccaccttctgtttatagaaccccatgtctgcttatagatttcagattttatagagattcattaggtttattctgtctactttcagtcctttcgcttataaactttcaatccaagcataaggtctttttcctgttacgctgtttgaactttgtttaaaaattgtggccaagcatggtggctcatgcctgtaatcccagctactcaggaggattgcttgagcccaggagttcaagaccagcctgggcaacagtgggaccc

SEQ ID NO: 70978 - DNA, 601 bp, Human
gatggcctgggtgtacatacaagtactcaggacaccacattctcacctttggtatctatccgttttattactctgccactcccaaacagtaatacataggattccgtgttagtttcctagggctgatgcaacagattagcacaaaccgggtggcttaaaataacagaaatgtgttccttcacagttctgggagccaggaatctaaaatcaaggtgtgggcagggttggcgcctccctagaggctcttagggagggtctgttctgtgcctctctcctggcttctagtagctcctggcagtcsttgccttccttggcttgtggctatgtaattccagggtcttctgctgctgtcacatggccttcttccctatgactgtgtgtgttcattcacataaatccagcaccaccagtcatcagatttaaggctcaccctaatccagtgaaacctcatttaactcattatgtctgcaaagaccctatttccaaataaggtcacattctgaggttctgagtagatatgaattttgggatgacactattcaacccagtatgctatatagatctgaaagcctacttgacacacatgtaaagctaaaaagtg

SEQ ID NO: 70979 - DNA, 601 bp, Human
tggcctgggtgtacatacaagtactcaggacaccacattctcacctttggtatctatccgttttattactctgccactcccaaacagtaatacataggattccgtgttagtttcctagggctgatgcaacagattagcacaaaccgggtggcttaaaataacagaaatgtgttccttcacagttctgggagccaggaatctaaaatcaaggtgtgggcagggttggcgcctccctagaggctcttagggagggtctgttctgtgcctctctcctggcttctagtagctcctggcagtcctygccttccttggcttgtggctatgtaattccagggtcttctgctgctgtcacatggccttcttccctatgactgtgtgtgttcattcacataaatccagcaccaccagtcatcagatttaaggctcaccctaatccagtgaaacctcatttaactcattatgtctgcaaagaccctatttccaaataaggtcacattctgaggttctgagtagatatgaattttgggatgacactattcaacccagtatgctatatagatctgaaagcctacttgacacacatgtaaagctaaaaagtgac

SEQ ID NO: 70980 - DNA, 601 bp, Human
aacagcagctacacagttgcaactgtagtctcttaattgattcgtttaattagcaagagctgaagcttgggctgtatcttgtcatctgatatcataggactcgaaatttgcatcattcatatttatagatatgtaaacatcatcaaaaaggtcttctgcttctgaaaattcacttacagatatcaaattttaatagagcagactcccatttgtttgaaatttaactaattaaaaaatgaaaagaattaagtttgttactgtttttctttatctgtactcttgagaaataagtgatgtcatrcatttttggttgtggatcatctcctaaacataaacttccagagaacttcttcagtcttccgtatctcataattccataagcagtccctcaactgacatgtctgacttaagttgatctctcctctctgtcccatccctttctctgtgtcagtgtgatttcaggaatgacatgatggcttactggggtttcttgcacacgtgtgctgtaactttccacctgtccctgcctgcctttgcagctgctccaagtcctgctagggtaggctgtctgcttgtgctgtggtttggtgggtcatctggc

SEQ ID NO: 70981 - DNA, 601 bp, Human
tgtagatctgttagctttattatttgtttcttttattgataaacagtacagtccatagggcgtaggtctctggttaagaatttgcattttatttgtcaagtacacctcaataaacacagggaaaagaagaactgtatttcatatcttattagacattactttttgaaaatgagcacaaaacctagcatttaatggtagtcatgagagtcagtcagtcatcttacactggtgacagacactgaattctggcaattcaaaggaaacaaatatccctgcagtcattgggcccattgtcacctarggatagagaaatgtaaatgactgattaccgtgataagaacgctaacagaggtgtatacgaagtagagggattctggggctgaggtgaagaaagtggagaaattgtgaacagtttttcagtgtttatagctcatgctgtgactttaaggatgaattgagtttgcaggagaaggcatttcagatagagggaacagtgagcctggagatagcaggttgtagaaactgcactctgtactgatgatggagaaagaggacggaatgaaattaataaaggcgcagaggtattaagatgtcccaagtg

SEQ ID NO: 70982 - DNA, 601 bp, Human
agaagaaaaatctgagtcagtggttctcaagttttatcatgcctgaggatgaccaggaaatcctggtgaaaatacagattcccagatctgttcctagaaaagctgaccccccatgtctgatgtcgaaatcggcttaaaatgcaccaggactagaatttgcaatatattttgaacattaatgtagaattactatctagtttggaaagtcaataccaaaagacacatgatattcctggccccatgagccaagcttaggagcagtgttctggatccttttcagaatgagaagataggacaaacrtttgattatttgtgctaattaacatgtactttcataatacatacttttttaaaatcagggagtgacatgataggatctaaagtataattaggtccatagtgtcatcaactgtatcttttaagtttacttatcatctgtataattctttagattcagtctgagttatttcaagtcttatagacagtgataatttttatttttgccctagagcagggcagtgttatctgtttgggcagtattaacattttggacaattctctgttgtgggagactgccctatgcgtaataggatgtttagca

SEQ ID NO: 70983 - DNA, 601 bp, Human
gaagaaggttttcaatttactttgcccagatccatcagaggaaacactgtggcagctgtagtcttccaaatgtatttctgaaataataagacttaaaagctgaaacgactgcttgatccatgggctgcggaatggatgtcgtgttagcaggcacaaaaaccacattcatctccttgtatatctccgtcagagctcccaggtaacaaggtgcattgtcaatgagtagtaatatttttaaggaaatatttttttctgagcagtaggtctccacagcaggttttaaatattcagtaaaccatgycctaaacagatgtgctgtcatccaggctttgtttttgcgtcctagagtacaggtagggtagacttagcatcattcctaagggccctgggattttcagaatggtaagtgagcactggcttcaactaaaagtcagcagttgcattagcccttagcaagagagttggcctgtcctttgaagccagaggtttacttctcctctctagttgtgaaagttagatgacatcttcttccaacagaaggctgttttgtctacactgaaaatctgtagtttagtgtggccaccttcatcggtgatcttaa

SEQ ID NO: 70984 - DNA, 601 bp, Human
caagagagttggcctgtcctttgaagccagaggtttacttctcctctctagttgtgaaagttagatgacatcttcttccaacagaaggctgttttgtctacactgaaaatctgtagtttagtgtggccaccttcatcggtgatcttaactagaccttctgcgtgacttactgcagcttcttcatcagcacttggtactttgccttgcacttttatattatggagatagtttctttaaacctcatgaatcaacttctgctagcttcacacttttcttttgcagcttcctcgcctctctcatyctgtgtagaattgaagagagctagggccttgctctggagtaggctttggcttaagtgaatgttgtggctggtttgattgtctatggagaccactaaaacttaggctgggcacagtggttcacacctataatcccagcactttgggaggccgagaggggcggatcacttgaggtcaggagttcgagaccagcctggccaacatggtgaaactccatctctactaaaaatacaaaaattgagctgcaacaatagaaagatggtggagcaagaacaaagaaacaatccctttgactgggcgcg

SEQ ID NO: 70985 - DNA, 601 bp, Human
gttcacttgtctctgcaaaaaaataaaaataaaaaataaaattaaattaaaaaataaaaatatgaaaactagctgggcatggtggcttacgcttgtagtcccagccactctactcgggaggctgaggcgggagaatcgcttgaacccgggaggcggaggttgcagtgagccaaggtcacaacactgcactccagcctgggcgacagagtgagactctgtctcaaaaaataaaaataaaaaaacttttcatatcagcaacaaggctatttcactttcctatcatccatgtgttcactggagyagcacttttaattttcttcaagacatttttcctttgcatttacaacttgagtaactgcacaagagacctagcttttggcctgtttcagctttccacatgctttctcagtaagcttaatcatttctagcttttgatttaaagtgagagacatgtgactcttcctttcacttgaacacttagaggccactgtagggttattaattggcttaatttcaatactgttgtgtcttggggaatagggaggcccaaggagagggagagagatgggggattggccagatagtggagcagtcagaacac

SEQ ID NO: 70986 - DNA, 601 bp, Human
ttaattttcttcaagacatttttcctttgcatttacaacttgagtaactgcacaagagacctagcttttggcctgtttcagctttccacatgctttctcagtaagcttaatcatttctagcttttgatttaaagtgagagacatgtgactcttcctttcacttgaacacttagaggccactgtagggttattaattggcttaatttcaatactgttgtgtcttggggaatagggaggcccaaggagagggagagagatgggggattggccagatagtggagcagtcagaacacacacaacrtttattatagtttaccatcgtacatgggcacagtttgtggttccccaaaacaatttcaatggtaacatcaaagatcagcgatgacagatcaccacaacagataacgacgaaaatgggtttcctaataatgcagaggtttgaaatactgcaagaattaccaaaatgagacacacagatgtgaagtaagcacatgctgttggaaaaaatggtggcaatagataaagggttgccacaaacctttaaattgtaaaaagtgcattatccttgaaacacaatagagtgaagcctaataaaatgagg

SEQ ID NO: 70987 - DNA, 601 bp, Human
ataaagggttgccacaaacctttaaattgtaaaaagtgcattatccttgaaacacaatagagtgaagcctaataaaatgaggtaggcctggattttttggatacttgatagtatctaagtttcttctcaaacacagcaaacatttcacagttcaaatttgcccatcggtagagttttctctgtggatcttctctgttaatgccacatctgtctagagtaaaagttcaattcaatattgtgctatcaacttagcaacttgttgaagatgaactaacataagtacatgctgtgtgtgtgttcygtgtgcagacacaacacaggtgagctttccgtaagcctggatcttcccaatggcggtgcttctcgtgtgcaggccaactagggagaaggggacactggggcccacccggagctctgtgggccttgtctcttgtgacaaggatattttgctccttagctcagcagagtccaggttcttgtctcaggactgggaagaagtaggcaggcggacacttggagagtgagtggagtagaatgcactaagggaaaggaaaacttaaaggaagggtcttgaaagcagattgtggttctcccttcacag

SEQ ID NO: 70988 - DNA, 601 bp, Human
tgtgcagacacaacacaggtgagctttccgtaagcctggatcttcccaatggcggtgcttctcgtgtgcaggccaactagggagaaggggacactggggcccacccggagctctgtgggccttgtctcttgtgacaaggatattttgctccttagctcagcagagtccaggttcttgtctcaggactgggaagaagtaggcaggcggacacttggagagtgagtggagtagaatgcactaagggaaaggaaaacttaaaggaagggtcttgaaagcagattgtggttctcccttcacagtkgaatacaagggcttttatatacctgctgatggggctgcgttccctatttctgtaagcgcgaattcctggcggctccacccgtccttccaatgcagacgtgggcccttagtctgagccactctacattgatttatttcccttactgcgcatgtgttaagggacagaacttttccaccgcaagcatgtttgggcaaggtccctgggcacgacgaccttggtgggtcagaggttctccggggaccctcccctgtctaccggggagagttctctgcttcctgcctccatctactccccagtctg

SEQ ID NO: 70989 - DNA, 601 bp, Human
cttagtctgagccactctacattgatttatttcccttactgcgcatgtgttaagggacagaacttttccaccgcaagcatgtttgggcaaggtccctgggcacgacgaccttggtgggtcagaggttctccggggaccctcccctgtctaccggggagagttctctgcttcctgcctccatctactccccagtctgcagtctggccctcggtggtcctgcagatctggtgttgattttgcagggtgtttggaaaggtacctgcgtattttcatttatggaagtgactgagtgccgacgagragaggttaatgcccttgagaggagaatttattacttcatcacctaagagaagggggcacacccctccatgcagggcacaggggaaccaccagtgtgggtcaggaggcagaaaggagccagagaaaagtgtgggtgggaaccttagtggggcttcctcgggaaaggcagtgcgtggctggtttgaataatgatggtgggctttggggtggtctctatttgcctggtatctggccctgggatgttttaaggcagggaaaatactggcttggtgtgtgttagagaaaatgggcagctggctta

SEQ ID NO: 70990 - DNA, 601 bp, Human
ccacagaaaggccccctgcagtcgattaggcttcagctacctaaacaataggcacagacccaaacgatgtcaaactacagttttctcctgcccttagggtggcactcaggccactttgattggaattttgagtgtccccaaactctggttgtactctttcacagatgggcaattacagtactgctctgtggagttttaccagtatagctctcagaaattcctaagaattttctatttcttaggttacactctctatagtacatacactcagacagaaaaatatatttcacgaagagagccytgaaaaatctcatctctagtcccagtgatgccttaaactggttgtgtgaccttcgtaaacctcagttttctttgttgtaaaatgaaaggtcggggtcggtgacctctagagtctatcccacccctagcctgctccgagagtgattgcatttggcacaatatgcagtttgcttcgcagcagtagcaaaatgacacatgcaacttattatcatcattgtctatcttttgatttccttgagttttccagtctcattaggggagacatctctggcttatcgcacaatgacatcgtgtcttgtaa

SEQ ID NO: 70991 - DNA, 601 bp, Human
accctgtgcagtcagaaatctacggataccttctgactctcccagaatgtaactgctagtagcctactgctgaccagaagtcctaccaataacatacagtcatttagcacgtatttggtatgttacatgattatatactgtattcctgcaataaagtaagctagagaaagtgttaggaaaatcataacgacaaaatatatttattattcattaagtggaagtggatcatcttaaagatcttgatcttcattgtcttcacgttgagttggctgaggaggagggggcttgatcttgctgtctyaagagcagcggagtcataagaaaatgcacatttaagtggccccatgcagttcaaatccatgttgctcaaggctcaactgtacaccgaactgaaaaatgattccatttttagtaggaaatggcctactctaagtcctactgcttccctttgcacttgatggcaagggtctttaactgtgtcagtggagctggtttggctccactgatagagactccctgaccatctgataggccacttttgttagaggagaaggtacccccttgcctacctgttcttttcttacttcatgggtcttgattc

SEQ ID NO: 70992 - DNA, 601 bp, Human
aagaaaatgcacatttaagtggccccatgcagttcaaatccatgttgctcaaggctcaactgtacaccgaactgaaaaatgattccatttttagtaggaaatggcctactctaagtcctactgcttccctttgcacttgatggcaagggtctttaactgtgtcagtggagctggtttggctccactgatagagactccctgaccatctgataggccacttttgttagaggagaaggtacccccttgcctacctgttcttttcttacttcatgggtcttgattcctgactcaggagcacccrttacagaaaagccctgggactagatctaattttatttaatgaaaaacctatggagcatttactcttgcttctaataaattaacaagtcagggctttcttctgaataggagggtctcttgactctttgatatttgacttttgaaccagactagatgaggcagagcttcagcacatattttaccagtgtcttcagcaaatgcctttctctttgcaaagctccatattactaccaaaaattaacccaactaaattgtaatttctactcacccacatttattgagtactgtgtttccttgaaag

SEQ ID NO: 70993 - DNA, 601 bp, Human
tccatataatgtttctggaccatggttgaccacaggtaaatgaaaccttggaaagctaaaaccttggataaggggggactactgtaatataaagtttacagttcctggggtgaaagctcaggcagaccctatctatgcattattacaacgtaccatcaattcaaaaccataaatttgcagaaacatcgttgctttaattcctaaaatattgaatatgaataataaaaataatatatgctttgtcttagaagcacctttttaatatgattgatgtgtattgatctgtttcttcattctaacrtgaacatttctgtaacagtcatttcccctgaaatatctaacctgtgggtacctgagacagcttgtcagttaggaagaacagtggtggcgatagccacgtagggctggtttggtcgtgagtgcaagtgtggttgcagcagctagagcagaggactgtgtggagaacatgggtcaggtcagaaggcagtagccaggagggatgcagagtcgagagagaatttgttgattggaatgactcaggttgactttcaggatgaagagaaggggccaatagagagggaagagaggacagttgatgagg

SEQ ID NO: 70994 - DNA, 601 bp, Human
ttgctttatgatctgaagaaataccatctaagtctttctattaggaacaaaagtgagcctttcagggaaaaaaaaaaaaggagctgggcttaatctgcattagccctttgatgtattcccagattttaaaaagcttcccactgttctcagccacgttgaaacagacccagccatgtgtccggcgctgtccttttctcctctcagcacacacttagccggagacaccttttggccaatgggccaggattcttccattgcatcttcagcatgtgaccgtttgtgctggctcattgggagttcygctgctcagtactccttccccaggcaaagactcttaagttaataattggttcagaagaataaactataccgccctcttggtcttcttttggacatttctttaagatgaggctcttactggtatatctggggtactttattgagaaatagaaagtgctagctgaaataaggcgtatcagtctagagttaggaagtgagaaatgcaatcggtaaattttgcttttaaataaaaatggaagccccattttaattgttgccatttctagtcattttatcatttttaacagcctggttttctatt

SEQ ID NO: 70995 - DNA, 601 bp, Human
ttgatgggacattattaccagaaggagtgctttgtgccagctggtttcatggatggaggaaaacaatctgggtttcagtttcacaaatagaaaaacaaaacctgagaggaaaaggaagtaattcgttagcagtggccactgtgcagagtaggataacctgccttcaaagatttttgtttcatgcactataatataatgtttaataaatactttacttcaaagaacctcactacaagaaaactggccgctttcctgctattcttgttctccggctcagtatgactataagtagctcatatccggtcctctgtggtctcaggtggtcgtttgtgtttatgatccttaagctgaaactgtaaggactgtgtccctattttaagtctttagcagatccaccgtgttctgcaggaattgacagaggctctcgtgaaacccttgacactttgacccatcttgaggaaaatgcttagatgctaaaagcagtgtgcatagggattacgtcctccaaaaatagaaaactctaaatttactaagcagggagtagagaaactcatcagactgcacctcaagtttttgatgtgttctggtcgcctctgcactc

SEQ ID NO: 70996 - DNA, 601 bp, Human
gaaaactggccgctttcctgctattcttgttctccggctcagtatgactataagtagctcatatccggtcctctgtggtctcaggtggtcgtttgtgtttatgatccttaagctgaaactgtaaggactgtgtccctattttaagtctttagcagatccaccgtgttctgcaggaattgacagaggctctcgtgaaacccttgacactttgacccatcttgaggaaaatgcttagatgctaaaagcagtgtgcatagggattacgtcctccaaaaatagaaaactctaaatttactaagcrgggagtagagaaactcatcagactgcacctcaagtttttgatgtgttctggtcgcctctgcactcccattctagacttctaaacaacacgttcaggatctctgagataaaagctggactgaagttacagaaagagcattagagatgtttgaatttttcttttttcccccctgtagatatatttggcatatgtagaatttgagagtccactattgataccagtttcttccagatattaacacatatcaaatagacagctagaactcagaagaaactaatggagctctgaaagaaaccattg

SEQ ID NO: 70997 - DNA, 601 bp, Human
gcactcccattctagacttctaaacaacacgttcaggatctctgagataaaagctggactgaagttacagaaagagcattagagatgtttgaatttttcttttttcccccctgtagatatatttggcatatgtagaatttgagagtccactattgataccagtttcttccagatattaacacatatcaaatagacagctagaactcagaagaaactaatggagctctgaaagaaaccattgttttttccactataaatcttaactcaacagcatttagggtctgggtggagccagtcaccygggcagctgcttcacacccattttgaattagctgcccagtgcttctggtgagcacctcggtaggagccactgctgtgaactcttttgcaagttctggtggtgactggtttggtttttattgctccctgtttgatgcactgataggacctagggctgttcttagaaatataggcctgagacgacttaaatttcacactggttttgtcttccgtttccacattcctctcactgactctccctcccttcctgccctctctctctctctcatatgaaatgagtttaaaatcagaggggaaggat

SEQ ID NO: 70998 - DNA, 601 bp, Human
tctacctgagctccccctaacacaggagttggcctctgcccactggggctttcattcccactaccacccacagtttctgcatatggcaggtcggagcccatcgtagtgtcatgagccattctctaaaccaccgtctgcctgaaaactgcctcattctctgtcattcctgaaggaaggactctggctggcccatctcatctttactcacctaggtgttcaatggatcactgggtaatctgagggttgatgttcttctttagtctatcaaccaatcccagagatgggaggcagggcttacatracactgtaaatactgccacctgggatgacttctgcgggagaagtactgagacccaagtccaccatgggaactaactggataagtttccgaagatttatgtcagtaacattcaccaccgtgtcctttgtattcacaaaataattagaaactacctgactgtccatcaataggagtttagttaaagaagttttgttgttccatatggcagaatattcatatgcagccattaaaatagtgatcaggtaaatgtttacaaacatggaaagatgcaatatgaactatattgtaacatgaaaaaat

SEQ ID NO: 70999 - DNA, 601 bp, Human
gcagccattaaaatagtgatcaggtaaatgtttacaaacatggaaagatgcaatatgaactatattgtaacatgaaaaaataaagttaaaatggcccgtgtaggatattgctttgttttacaaacacaaagttgaggctgggtgcagtggcttatgcctataatcccagcactttgggaggccaaggcaggatgatcacttgagcccaggagtttgcgactagactgggcaacctagtgagacctcatctctgcaaaaaattcaaaaagtacaataagccaggtgtgatgatacatgcccrtgaccccagctactcaagaggccgtggtggcaggatcgcttgagcccaggaagtcaaggctgcagtgagctgtgatcgtaccactgcactccagcttgggtgacagagcagagagactctgtttcaaaaacaaaaagcccccacaaacatgaaaggcttaatccaggactagtaatagttgccgaacttgagcggaattgtcttcatgctcttatgttagcatctgatattttataatgagcatatcccttatagattcagcaatatatttgaaaaatacaccaaggtaaaggagttgtg

SEQ ID NO: 71000 - DNA, 601 bp, Human
agaggttctgaactgaagcagtgttattactaaggtgcttgaaggggggaacccacatttctttaatagcaacactccaggtttctaacatctggaagtatcacaccatgaattttttttaacccagaaaaactgggaaaaacttcaaatcactgaatgacgtgttaaccaagtttctgactttaagactttaagattattgactctgaatttacatagaattctaagaatttcagttagttgattgtgtgtgtggtgtgatgtttaaaataagtttgggaaatgctgggttaaattaatrttttttatttcaggatgtctcaaaatctttactaagtggatgtctgttttgaatctccaagatggaatatagaatgcagcatttctcaaatggaatttgaccactgagtccttgttttctttgggcatgtactaagtagcctttcccagagctcattttgtgggataccataggaaatgctgcgatgggaccttttaattaatttattttttgagacagggtctccctctgtcacccaggctggagtgcagtggcaggatcatagctcactacagcctcaaaactcctgggctcaagcga

SEQ ID NO: 71001 - DNA, 601 bp, Human
gcatttctcaaatggaatttgaccactgagtccttgttttctttgggcatgtactaagtagcctttcccagagctcattttgtgggataccataggaaatgctgcgatgggaccttttaattaatttattttttgagacagggtctccctctgtcacccaggctggagtgcagtggcaggatcatagctcactacagcctcaaaactcctgggctcaagcgatcctcctatctcagttcactaagcagctgggactaccgaagcacaccaccacagcctgctaattaaaataaaaaaaaaatgtagaaacaaggtgccactatgttgcctgggctggtgttgaactcctaggctcaagtgatcctcctgcctctgtctcccaaagtgctgggattacaggtatggccactgtgcccagccatatatgtatatatatatattttttaatgaagccacaagcattctgcctctgtgctttttatttatttatttatttatttttgagacggaggttcgctctggttgcccaggcaggagtgcaatggcacaatctcggctcaccgcaacctctgccccccaggttcaagtgattctcatgtct

SEQ ID NO: 71002 - DNA, 601 bp, Human
attacaggtatggccactgtgcccagccatatatgtatatatatatattttttaatgaagccacaagcattctgcctctgtgctttttatttatttatttatttatttttgagacggaggttcgctctggttgcccaggcaggagtgcaatggcacaatctcggctcaccgcaacctctgccccccaggttcaagtgattctcatgtctcagcctcccgagtagctgggattacaggcatgcgccaccatgcacggctaattttgcatttttagtagagacagggtttctccatgttggtygggctggtcttgaagtcccgacctcaggtgatccacccgcctcggcttcccaaagtgctaggatttacaggtgtgagccggccgaccctatatattttttaaaagcttttaagaaacacagtaatctttgagttgagattttgaaaaaaattgcaaaaatattgcacattagcattttaaagttagtggaggctgggcatagtggctcacacctgtaatcccaataccttggaggctgaggctggagggtcgcatgagctcaggagtttgagaccagcctgggcaacaacatagtggtat

SEQ ID NO: 71003 - DNA, 601 bp, Human
tccacccgcctcggcttcccaaagtgctaggatttacaggtgtgagccggccgaccctatatattttttaaaagcttttaagaaacacagtaatctttgagttgagattttgaaaaaaattgcaaaaatattgcacattagcattttaaagttagtggaggctgggcatagtggctcacacctgtaatcccaataccttggaggctgaggctggagggtcgcatgagctcaggagtttgagaccagcctgggcaacaacatagtggtatcctgtatctacaagttttgtttttttgttttgttttttttttgttttttttttttaattagctggtgtggtggtgcatacctataatccagctactcaggaggctaaggcaggaggatcacttgagcccaggagtttgagcctgcagtgagctaggatcgcatcactgcactgcaatctgggcagcagagcgagaccctccctcacaaataaagttagtggaaagtgctatagtaaacttttcccagttttcccctaatctgttttaccatgggccactcccttacccccacttttattttttttcacattagctattaacatgccctgaaa

SEQ ID NO: 71004 - DNA, 601 bp, Human
gcctgtaatcccagcactttgggaggccgaggcaggcggatcaccaggtcaggagatcgagaccatcctggctaacatggtgaaaccccgtctctactaaaaatacaaaaaaaaattagccaggcgtggtggcgagcacctgtagtcccagctactcgggaggctgaggcaggagaatggcgtgaacccgggaggcggagcttgcagtgagccgagattgcaccactgcactccagcctgggcgacagagcgagactccgtctcaaaaaaaaaaaagttttatcggaacacagccatgctyattcctgtatgtactgtcagtggctgctttcacgtgactgaagcggaactgacagtgtaacatgcaaaacaggtaagaaaagattgaccatctagcccattgtagaagaaagtttgcccacctctgacctagatgattagtcataggtagttgcatttgcaaattgactaattttctttttacactccagcatgaatacatgcaattgaacagctaatataggtgtgtgtatgtgtgtgcacatatgtatactaaaatattgtaaaatgtcaagtgttgcaaataacattgttaactgaa

SEQ ID NO: 71005 - DNA, 601 bp, Human
gtcagtggctgctttcacgtgactgaagcggaactgacagtgtaacatgcaaaacaggtaagaaaagattgaccatctagcccattgtagaagaaagtttgcccacctctgacctagatgattagtcataggtagttgcatttgcaaattgactaattttctttttacactccagcatgaatacatgcaattgaacagctaatataggtgtgtgtatgtgtgtgcacatatgtatactaaaatattgtaaaatgtcaagtgttgcaaataacattgttaactgaaagtgacggaatggccrgccaaatttatatttattgtgtcaaaaacaaaatgtaccagacaattaagataattttacccaggccactgcagtaggggtaacgtttattaatgagaaatgtctcagagagaggaagaactagggttttataaatgcaggtgaacaagggaggggtccaagaattacggggttcatgaagaagagtggaagtctatggggaaggttgctttgcctccagccatttcctgggttaagaaagaggaggaagattctgtaactgtttctgtgttctaggagcacggggctcagggaaagttc

SEQ ID NO: 71006 - DNA, 601 bp, Human
acctagatgattagtcataggtagttgcatttgcaaattgactaattttctttttacactccagcatgaatacatgcaattgaacagctaatataggtgtgtgtatgtgtgtgcacatatgtatactaaaatattgtaaaatgtcaagtgttgcaaataacattgttaactgaaagtgacggaatggccggccaaatttatatttattgtgtcaaaaacaaaatgtaccagacaattaagataattttacccaggccactgcagtaggggtaacgtttattaatgagaaatgtctcagagagaggaagaactagggttttataaatgcaggtgaacaagggaggggtccaagaattacggggttcatgaagaagagtggaagtctatggggaaggttgctttgcctccagccatttcctgggttaagaaagaggaggaagattctgtaactgtttctgtgttctaggagcacggggctcagggaaagttcagcattgtcagttgtcaacaaaatcagtaagtgttattaaataccccatggtgtgtggttctggcactgaaatggggctgtttcctaaggctctgtccatggccacctctg

SEQ ID NO: 71007 - DNA, 601 bp, Human
gtgtgtgtatgtgtgtgcacatatgtatactaaaatattgtaaaatgtcaagtgttgcaaataacattgttaactgaaagtgacggaatggccggccaaatttatatttattgtgtcaaaaacaaaatgtaccagacaattaagataattttacccaggccactgcagtaggggtaacgtttattaatgagaaatgtctcagagagaggaagaactagggttttataaatgcaggtgaacaagggaggggtccaagaattacggggttcatgaagaagagtggaagtctatggggaaggtkgctttgcctccagccatttcctgggttaagaaagaggaggaagattctgtaactgtttctgtgttctaggagcacggggctcagggaaagttcagcattgtcagttgtcaacaaaatcagtaagtgttattaaataccccatggtgtgtggttctggcactgaaatggggctgtttcctaaggctctgtccatggccacctctgtctatttctgcattctgtcttgcattgcttctgttgcctatatcctggtcagcacagtttatggtgaatcattgcttattgaaatagagacggcaa

SEQ ID NO: 71008 - DNA, 601 bp, Human
gaagaactagggttttataaatgcaggtgaacaagggaggggtccaagaattacggggttcatgaagaagagtggaagtctatggggaaggttgctttgcctccagccatttcctgggttaagaaagaggaggaagattctgtaactgtttctgtgttctaggagcacggggctcagggaaagttcagcattgtcagttgtcaacaaaatcagtaagtgttattaaataccccatggtgtgtggttctggcactgaaatggggctgtttcctaaggctctgtccatggccacctctgtctrtttctgcattctgtcttgcattgcttctgttgcctatatcctggtcagcacagtttatggtgaatcattgcttattgaaatagagacggcaataatgaagccagctattataaattagagcaaatatacacatccaatacgttttaaacgcatgtgatctctggagtagtatcactaggtagcttccatttcagttcgcctttggtatattactgtactccaaagaatatcatttttccctctgtaaaattttcctcatgaaaatggtcaccataggtctgatttactttttggatcagt

SEQ ID NO: 71009 - DNA, 601 bp, Human
gtttgtgtgcttggtgtagactgtacgaggatttttcaaaagtaagtattgttcattctaaaggaaggaaatgtatgttatgagatagaattatataataaacagaaccattaaatgccatctgaaaagtggtgttttcaatggcaggaagtagcattgctgcgtattttgtgtgtgtgcgcaactcagctttgtgtcattgtgtaactttaatttgaaagaacatcacgtgactgctgttttcatttctgccttttaaaaagcagacagctattcagaacagcaagaagcagacccaaaytttgtttgtatgcccctagtcataggcaaaaatggaaagggtaatttaccaaaaaagaagaaaatagataaaaaggaaaagaatggaaagaaagtactgactcactgcaaacagctgcaaaatgttgcccttgggatagaggttaactcggttgtgaaataatggccaaagcggtgcactcttaataacttttttgtagccctggagaaagcttctggattgactgtgagaagcttggcagaaggtgctgcggcctggtggctggctcagcaggaggcctgggattgaaagctctcggtt

SEQ ID NO: 71010 - DNA, 601 bp, Human
tatgagatagaattatataataaacagaaccattaaatgccatctgaaaagtggtgttttcaatggcaggaagtagcattgctgcgtattttgtgtgtgtgcgcaactcagctttgtgtcattgtgtaactttaatttgaaagaacatcacgtgactgctgttttcatttctgccttttaaaaagcagacagctattcagaacagcaagaagcagacccaaactttgtttgtatgcccctagtcataggcaaaaatggaaagggtaatttaccaaaaaagaagaaaatagataaaaaggaraagaatggaaagaaagtactgactcactgcaaacagctgcaaaatgttgcccttgggatagaggttaactcggttgtgaaataatggccaaagcggtgcactcttaataacttttttgtagccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtccctttttttct

SEQ ID NO: 71011 - DNA, 601 bp, Human
actgcaaacagctgcaaaatgttgcccttgggatagaggttaactcggttgtgaaataatggccaaagcggtgcactcttaataacttttttgtagccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtccctttttttctctattttttaaaataaaaatattttmgtgaatatgagttaaatgagaatcaagtggcttctgggcctccctgaaagatcaagtggaagcactggatgactctaatgatgccgaattgtaatccataaagcacctgggcagagttcaatcagaggtcccatttcagaagttttttggaatgtagggaaagaattacttagaaaaggttcatctacttggagaggagatggttcaatatgacttttagaagaagccgcagtccctgccccacaggggctgcttagattgcttagatggattgtcatctctctctctttttttttttgg

SEQ ID NO: 71012 - DNA, 601 bp, Human
ctctattttttaaaataaaaatattttagtgaatatgagttaaatgagaatcaagtggcttctgggcctccctgaaagatcaagtggaagcactggatgactctaatgatgccgaattgtaatccataaagcacctgggcagagttcaatcagaggtcccatttcagaagttttttggaatgtagggaaagaattacttagaaaaggttcatctacttggagaggagatggttcaatatgacttttagaagaagccgcagtccctgccccacaggggctgcttagattgcttagatggatwgtcatctctctctctttttttttttgggacggagtctcgctttgtcgtccaggctggagtgcagtggcatgatctcggctcactgcaagctccacctcccaggttcacgccattctcctgcccctgcctcccgagtagctgggactacaggtgcccgccaccatgcctggctaattttttgtatttttagtagagacagggtttcactgtgttagccaggatggtttcgatctcctgaccttgtgatccacctgcctcagcctcccaaagtgctaggattacaggcgtgagccgccgagc

SEQ ID NO: 71013 - DNA, 601 bp, Human
gaatcaagtggcttctgggcctccctgaaagatcaagtggaagcactggatgactctaatgatgccgaattgtaatccataaagcacctgggcagagttcaatcagaggtcccatttcagaagttttttggaatgtagggaaagaattacttagaaaaggttcatctacttggagaggagatggttcaatatgacttttagaagaagccgcagtccctgccccacaggggctgcttagattgcttagatggattgtcatctctctctctttttttttttgggacggagtctcgctttgtcrtccaggctggagtgcagtggcatgatctcggctcactgcaagctccacctcccaggttcacgccattctcctgcccctgcctcccgagtagctgggactacaggtgcccgccaccatgcctggctaattttttgtatttttagtagagacagggtttcactgtgttagccaggatggtttcgatctcctgaccttgtgatccacctgcctcagcctcccaaagtgctaggattacaggcgtgagccgccgagcccggtggactgtcttctctctaagcagtaagagacagtgggaactgc

SEQ ID NO: 71014 - DNA, 601 bp, Human
cctgggcagagttcaatcagaggtcccatttcagaagttttttggaatgtagggaaagaattacttagaaaaggttcatctacttggagaggagatggttcaatatgacttttagaagaagccgcagtccctgccccacaggggctgcttagattgcttagatggattgtcatctctctctctttttttttttgggacggagtctcgctttgtcgtccaggctggagtgcagtggcatgatctcggctcactgcaagctccacctcccaggttcacgccattctcctgcccctgcctcccragtagctgggactacaggtgcccgccaccatgcctggctaattttttgtatttttagtagagacagggtttcactgtgttagccaggatggtttcgatctcctgaccttgtgatccacctgcctcagcctcccaaagtgctaggattacaggcgtgagccgccgagcccggtggactgtcttctctctaagcagtaagagacagtgggaactgcagaagggtgtttgcagcctcatgcagttgactgaatgaattggccccagagtcacccctagcaccatcttgatatggacaggaggc

SEQ ID NO: 71015 - DNA, 601 bp, Human
tctctctctctttttttttttgggacggagtctcgctttgtcgtccaggctggagtgcagtggcatgatctcggctcactgcaagctccacctcccaggttcacgccattctcctgcccctgcctcccgagtagctgggactacaggtgcccgccaccatgcctggctaattttttgtatttttagtagagacagggtttcactgtgttagccaggatggtttcgatctcctgaccttgtgatccacctgcctcagcctcccaaagtgctaggattacaggcgtgagccgccgagcccggyggactgtcttctctctaagcagtaagagacagtgggaactgcagaagggtgtttgcagcctcatgcagttgactgaatgaattggccccagagtcacccctagcaccatcttgatatggacaggaggcagggaaatactgggtagaagagggtggttccccagcaaaggccccaccctcaagcctggaaatccggagccctaaatgggaacaggcattcccgtttttgtgcccaaatgttgccttttggctcaccacgcccccctctcctgtatccatataaaccccaaaccccaggctc

SEQ ID NO: 71016 - DNA, 601 bp, Human
gagctgttttaacacgtagccatccgcagatggcagcttctaaaagagcattaattgtaacagacccccagacactaccatggggccagagcccaaaagtgctcaccccagctcctacacctgcccctgcccatctgcgtgctctccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggrggtgtgcgctgccccaccaagctgatgcctgatcaggggaggccactagaatagtctcttgtacagcaacagagcctcttactacagtgagcttctcctggggctttcagagtacgtccgagctccacaccaagaagagagccaacccacgtggatgcagctcggttcttagggctgacttgaaacttgataagactgcctcaagcatgtgccacaaccccagttcttgcaaacccccacagagtcttgagaaatccctcttgtggtccaaattggggaaatatagaattagtcaaaaga

SEQ ID NO: 71017 - DNA, 601 bp, Human
taacacgtagccatccgcagatggcagcttctaaaagagcattaattgtaacagacccccagacactaccatggggccagagcccaaaagtgctcaccccagctcctacacctgcccctgcccatctgcgtgctctccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggaggtgtgcgytgccccaccaagctgatgcctgatcaggggaggccactagaatagtctcttgtacagcaacagagcctcttactacagtgagcttctcctggggctttcagagtacgtccgagctccacaccaagaagagagccaacccacgtggatgcagctcggttcttagggctgacttgaaacttgataagactgcctcaagcatgtgccacaaccccagttcttgcaaacccccacagagtcttgagaaatccctcttgtggtccaaattggggaaatatagaattagtcaaaagaaaaggctga

SEQ ID NO: 71018 - DNA, 601 bp, Human
agacactaccatggggccagagcccaaaagtgctcaccccagctcctacacctgcccctgcccatctgcgtgctctccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggaggtgtgcgctgccccaccaagctgatgcctgatcaggggaggccactagaatagtctcttgtacagcawcagagcctcttactacagtgagcttctcctggggctttcagagtacgtccgagctccacaccaagaagagagccaacccacgtggatgcagctcggttcttagggctgacttgaaacttgataagactgcctcaagcatgtgccacaaccccagttcttgcaaacccccacagagtcttgagaaatccctcttgtggtccaaattggggaaatatagaattagtcaaaagaaaaggctgaagtcttggtcatctacatgcttgcaaattccagccttcctggcctgtgagtgttgcatga

SEQ ID NO: 71019 - DNA, 601 bp, Human
ccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggaggtgtgcgctgccccaccaagctgatgcctgatcaggggaggccactagaatagtctcttgtacagcaacagagcctcttactacagtgagcttctcctggggctttcagagtacgtccgagctccacaccaagaagagagccarcccacgtggatgcagctcggttcttagggctgacttgaaacttgataagactgcctcaagcatgtgccacaaccccagttcttgcaaacccccacagagtcttgagaaatccctcttgtggtccaaattggggaaatatagaattagtcaaaagaaaaggctgaagtcttggtcatctacatgcttgcaaattccagccttcctggcctgtgagtgttgcatgaatatagcaggaagtcagcactctccatctttcacaaaacgtgatgtgtttcagtccgtgcccggtgaacactattc

SEQ ID NO: 71020 - DNA, 601 bp, Human
caaaaaataaataaataaataaataaataaagggcaaacttttaccaagttctcatctcttaagccattgtttgtttaatggagtagtagatgatgtgggttgttatctaacaagaacattgtcccttgtgggactgcacttagcattcaccttcggatgccatggctaggtcaggatgccagcctaagcagtcttgactttagatttgaaattccggccgggtacggtggctcacgcctgtaatcccagcactttgggaggccgaggcaggtggatcacctgaggtcgggagtttgagamcagcctgaccaacatggagaaaccctgcctctactgaaaatacaaaattagccaggcgtggtggtgcacgcctgtaatcccagctactcgggaggctgaggcaggagaatgggtttaacccgggaggcggagtttgcggtgagccgagatcgcgctattgcactctagcctgggcaacaagagcaaaactcaaaaaaaaaaaaaaattttgtaattccttcaacacattataacatgacaagtgcttcttgccttatctactagtgaagactctgcccggcccgctggcttcctaacagt

SEQ ID NO: 71021 - DNA, 601 bp, Human
ttgaaattccggccgggtacggtggctcacgcctgtaatcccagcactttgggaggccgaggcaggtggatcacctgaggtcgggagtttgagaccagcctgaccaacatggagaaaccctgcctctactgaaaatacaaaattagccaggcgtggtggtgcacgcctgtaatcccagctactcgggaggctgaggcaggagaatgggtttaacccgggaggcggagtttgcggtgagccgagatcgcgctattgcactctagcctgggcaacaagagcaaaactcaaaaaaaaaaaaaaattttgtaattccttcaacacattataacatgacaagtgcttcttgccttatctactagtgaagactctgcccggcccgctggcttcctaacagtcctgtggcggtctgttctttcctgtgtacactccttaaattgtgacatccctacttctggaaagctcaccatttcctatacccctatttgatttattttatcccaagacttatctcaaatcctccctgctcccaaaatcctcctctcactgccttagttctccctctgaaattccatagcatttcattttctcaacacagactcag

SEQ ID NO: 71022 - DNA, 601 bp, Human
cctgaggtcgggagtttgagaccagcctgaccaacatggagaaaccctgcctctactgaaaatacaaaattagccaggcgtggtggtgcacgcctgtaatcccagctactcgggaggctgaggcaggagaatgggtttaacccgggaggcggagtttgcggtgagccgagatcgcgctattgcactctagcctgggcaacaagagcaaaactcaaaaaaaaaaaaaaattttgtaattccttcaacacattataacatgacaagtgcttcttgccttatctactagtgaagactctgcccrgcccgctggcttcctaacagtcctgtggcggtctgttctttcctgtgtacactccttaaattgtgacatccctacttctggaaagctcaccatttcctatacccctatttgatttattttatcccaagacttatctcaaatcctccctgctcccaaaatcctcctctcactgccttagttctccctctgaaattccatagcatttcattttctcaacacagactcagagaaatttgctggtaggagggaccttagaggtgcgattctcaaccggggcagtattgcccccgggcatattcg

SEQ ID NO: 71023 - DNA, 601 bp, Human
gacaagtgcttcttgccttatctactagtgaagactctgcccggcccgctggcttcctaacagtcctgtggcggtctgttctttcctgtgtacactccttaaattgtgacatccctacttctggaaagctcaccatttcctatacccctatttgatttattttatcccaagacttatctcaaatcctccctgctcccaaaatcctcctctcactgccttagttctccctctgaaattccatagcatttcattttctcaacacagactcagagaaatttgctggtaggagggaccttagagstgcgattctcaaccggggcagtattgcccccgggcatattcggcaatgtctggagacatacttggttgtcacagctgggagggagtgctatggcatctagtgtgtggaagcccgagaccccgctaaccgtcccacccaacacaggacaactccaaaacaaagattaatccaggctttcggctgctgttgggaaacttgtccacattaccaccacatacctggttccacaatttacctctacatgtgcatgttcctgagtaattgcacactttgtaatgtctcgtagcccctatagctagt

SEQ ID NO: 71024 - DNA, 601 bp, Human
aaaattttttttaagtttataaagcttgtgagaaaaatccttatttgtaaagaagctcagtattattttgaatgttcttgcttctcatttatgactactcaataaagaaaataccttttcctgctctgctgtccagtttgttgggttaatttgggagatagtgtcagcaccctggaattgtgccaacttccaattatcactctgtgtaaccactgacttcaatttcaaagtaattactgcagatttttctcactaccctgaacatagcctacacgcttttaatcctacacttatttttttycccatctaaaaggaaaacttattttgattttgatactttttaattttttaaaacttattttgaaataacttagacttgggaaaagttgcaaaacaataatacaaagaatgtccagataatttcacccagagtccgcaaatgttaacattttatcagggttgatttattgtgtattcctctctttctctctctctctcttcccacctccaccatctatatatgtaaataattggtatcttctgaaccatttcagcaaattgctaacagttcttaagtgtgtatttcatcgacacaggacaa

SEQ ID NO: 71025 - DNA, 601 bp, Human
agtttgttgggttaatttgggagatagtgtcagcaccctggaattgtgccaacttccaattatcactctgtgtaaccactgacttcaatttcaaagtaattactgcagatttttctcactaccctgaacatagcctacacgcttttaatcctacacttatttttttccccatctaaaaggaaaacttattttgattttgatactttttaattttttaaaacttattttgaaataacttagacttgggaaaagttgcaaaacaataatacaaagaatgtccagataatttcacccagagtcygcaaatgttaacattttatcagggttgatttattgtgtattcctctctttctctctctctctcttcccacctccaccatctatatatgtaaataattggtatcttctgaaccatttcagcaaattgctaacagttcttaagtgtgtatttcatcgacacaggacaacattcccttatggaactgcaatgcagtactgttaccacaattaggaaactgacattgaaacagcaccattgtcttatctacaaacctttcaaattttgccagttttcctactctttaaaatgttttcaaattgt

SEQ ID NO: 71026 - DNA, 601 bp, Human
actctgtgtaaccactgacttcaatttcaaagtaattactgcagatttttctcactaccctgaacatagcctacacgcttttaatcctacacttatttttttccccatctaaaaggaaaacttattttgattttgatactttttaattttttaaaacttattttgaaataacttagacttgggaaaagttgcaaaacaataatacaaagaatgtccagataatttcacccagagtccgcaaatgttaacattttatcagggttgatttattgtgtattcctctctttctctctctctctcctcccacctccaccatctatatatgtaaataattggtatcttctgaaccatttcagcaaattgctaacagttcttaagtgtgtatttcatcgacacaggacaacattcccttatggaactgcaatgcagtactgttaccacaattaggaaactgacattgaaacagcaccattgtcttatctacaaacctttcaaattttgccagttttcctactctttaaaatgttttcaaattgttgccagtttactcactacaaaaaatactgtctttaaagcaaaagaaaaagaagtgttattttct

SEQ ID NO: 71027 - DNA, 601 bp, Human
cctacacgcttttaatcctacacttatttttttccccatctaaaaggaaaacttattttgattttgatactttttaattttttaaaacttattttgaaataacttagacttgggaaaagttgcaaaacaataatacaaagaatgtccagataatttcacccagagtccgcaaatgttaacattttatcagggttgatttattgtgtattcctctctttctctctctctctcttcccacctccaccatctatatatgtaaataattggtatcttctgaaccatttcagcaaattgctaacarttcttaagtgtgtatttcatcgacacaggacaacattcccttatggaactgcaatgcagtactgttaccacaattaggaaactgacattgaaacagcaccattgtcttatctacaaacctttcaaattttgccagttttcctactctttaaaatgttttcaaattgttgccagtttactcactacaaaaaatactgtctttaaagcaaaagaaaaagaagtgttattttctggcccaggatccgctcagagtcacaccttgcattgacttttcctgtcctgttggtctcctgaatctcga

SEQ ID NO: 71028 - DNA, 601 bp, Human
ttgccagtttactcactacaaaaaatactgtctttaaagcaaaagaaaaagaagtgttattttctggcccaggatccgctcagagtcacaccttgcattgacttttcctgtcctgttggtctcctgaatctcgaatcgttcctccgttgttctttggcttccgtgatcttgacatttttgaagacaggccatttattttgtcaaatggctctcaatttggattcatttggtgtttcctcacagtcaggttgttactcatttttggcaggaacgtaacggtggtgctgctgcgttgtcctcrttgtcccctctcgggaggcgcatgttcacgtttctctttgtcccactgttaatggcatcactttgatcatttggttcaggtggtgtttgtccctttctccactctgaagttactactttcctttttccatttatctggtaaaggaaatagacagttaagctggtaatttcagcataatatggtgagtgttaaacagacagccagggtgccttgggagccagtaagtagatgtcacccaacctggtagctcagggaaggcttctggagttgatgacacctcaactgtgacttaaggtaatg

SEQ ID NO: 71029 - DNA, 601 bp, Human
cctcgttgtcccctctcgggaggcgcatgttcacgtttctctttgtcccactgttaatggcatcactttgatcatttggttcaggtggtgtttgtccctttctccactctgaagttactactttcctttttccatttatctggtaaaggaaatagacagttaagctggtaatttcagcataatatggtgagtgttaaacagacagccagggtgccttgggagccagtaagtagatgtcacccaacctggtagctcagggaaggcttctggagttgatgacacctcaactgtgacttaaggkaatgattatgagtcagccaagccaaggaaaatggggaggatactgtagaaggacatgataccatgaacacagccatggagccacgaaacttcatggtgtgttcaggtcgctacagtggctggcagcttgagttctaggatggagttcggaagatgtcacggaatcccagtatggcagtacaagtgcacttgttctcacgggaggctggaagcaaaggctgtgctccttgttcctcaaaagctctagggtctcttttgtctcttaattccatagttctctctcccctaattaacacagagc

SEQ ID NO: 71030 - DNA, 601 bp, Human
acctcccccagcaacccctagcctactgtttgcgtgtgacttcttccactcagtataacacttctgaggttcatccacactggagcatgtgtctggtctttgtaggtttattccactaccaaccatgttctttatgcttaaaataactcctccctattgaactgttttggagtgatatttcctggggtggaggtagtttaatgattcatctctgtcttgttagcatgcttgtttatggtagagagaaattttgtattctgccaccataccttgtcaaaaccttttaacaaggcattgattyggttctctggttctgagaacttggcagtggaagacaagacttccacccgcattgcaagcaaaatcattgatgtcaattcacgttattgtggaaaaccgtgagttgtgacaagtgaaagcttttcaccaagccacaaaactatgggcgtgtgcagtcaacacacggaacacaaggggtttgcttccgtggctcagcatagcactctctcactagttctaaaatattcatagcctttgctgttcccaaaagacgtttgaaaaataagacttctcctttgtcagcatccgcgctcacataact

SEQ ID NO: 71031 - DNA, 601 bp, Human
aggatgcctcaagacagacttttatgttgggacaagtagtgtcttattaaggcggttccagcctttcatatcctgcctccttgggataaagagtgtttgtttacagagcttctgggatagactgctgcatgctgcatccgtacctctgttgcagaagcacatctgtcccattatgtctagtgacaaaaataagaccaacgcctcagtgaactttgcatacatctgaatgtaagcaagacaagtatatttgacattttaaaaaggttttttctttcacagttttcaaaataacataggagamgcaaaggaaaaaatatttcttgtgtttctaattcacaggttgcttgagactttttttggaggtgctagcattttattggccacagttttgaaggaaaatacaattaaatcatgcttctgtcgtttggggaaaaggaataacagattcattttttctttttttaaagatgagagagatagtatttggaatctatctttagattattctacctctgaatctaattgaagtaagaaattgggcaagaatggaatcttacttaccacccaggaaaaaagctaaacaattgtggctcagtccatt

SEQ ID NO: 71032 - DNA, 601 bp, Human
atcctgcctccttgggataaagagtgtttgtttacagagcttctgggatagactgctgcatgctgcatccgtacctctgttgcagaagcacatctgtcccattatgtctagtgacaaaaataagaccaacgcctcagtgaactttgcatacatctgaatgtaagcaagacaagtatatttgacattttaaaaaggttttttctttcacagttttcaaaataacataggagaagcaaaggaaaaaatatttcttgtgtttctaattcacaggttgcttgagactttttttggaggtgctagyattttattggccacagttttgaaggaaaatacaattaaatcatgcttctgtcgtttggggaaaaggaataacagattcattttttctttttttaaagatgagagagatagtatttggaatctatctttagattattctacctctgaatctaattgaagtaagaaattgggcaagaatggaatcttacttaccacccaggaaaaaagctaaacaattgtggctcagtccattttcccctgagactgtcttcagattgaggcgatcagtgttaaaatggatggaatcaccaggctctccaca

SEQ ID NO: 71033 - DNA, 601 bp, Human
ataaagagtgtttgtttacagagcttctgggatagactgctgcatgctgcatccgtacctctgttgcagaagcacatctgtcccattatgtctagtgacaaaaataagaccaacgcctcagtgaactttgcatacatctgaatgtaagcaagacaagtatatttgacattttaaaaaggttttttctttcacagttttcaaaataacataggagaagcaaaggaaaaaatatttcttgtgtttctaattcacaggttgcttgagactttttttggaggtgctagcattttattggccacagttttgaaggaaaatacaattaaatcatgcttctgtcgtttggggaaaaggaataacagattcattttttctttttttaaagatgagagagatagtatttggaatctatctttagattattctacctctgaatctaattgaagtaagaaattgggcaagaatggaatcttacttaccacccaggaaaaaagctaaacaattgtggctcagtccattttcccctgagactgtcttcagattgaggcgatcagtgttaaaatggatggaatcaccaggctctccacattctagtaagattgta

SEQ ID NO: 71034 - DNA, 601 bp, Human
tgctgcatgctgcatccgtacctctgttgcagaagcacatctgtcccattatgtctagtgacaaaaataagaccaacgcctcagtgaactttgcatacatctgaatgtaagcaagacaagtatatttgacattttaaaaaggttttttctttcacagttttcaaaataacataggagaagcaaaggaaaaaatatttcttgtgtttctaattcacaggttgcttgagactttttttggaggtgctagcattttattggccacagttttgaaggaaaatacaattaaatcatgcttctgtcrtttggggaaaaggaataacagattcattttttctttttttaaagatgagagagatagtatttggaatctatctttagattattctacctctgaatctaattgaagtaagaaattgggcaagaatggaatcttacttaccacccaggaaaaaagctaaacaattgtggctcagtccattttcccctgagactgtcttcagattgaggcgatcagtgttaaaatggatggaatcaccaggctctccacattctagtaagattgtagtacggttgaaagtcaaatgaaagtccagctcttcag

SEQ ID NO: 71035 - DNA, 601 bp, Human
ctcagtgaactttgcatacatctgaatgtaagcaagacaagtatatttgacattttaaaaaggttttttctttcacagttttcaaaataacataggagaagcaaaggaaaaaatatttcttgtgtttctaattcacaggttgcttgagactttttttggaggtgctagcattttattggccacagttttgaaggaaaatacaattaaatcatgcttctgtcgtttggggaaaaggaataacagattcattttttctttttttaaagatgagagagatagtatttggaatctatctttagaytattctacctctgaatctaattgaagtaagaaattgggcaagaatggaatcttacttaccacccaggaaaaaagctaaacaattgtggctcagtccattttcccctgagactgtcttcagattgaggcgatcagtgttaaaatggatggaatcaccaggctctccacattctagtaagattgtagtacggttgaaagtcaaatgaaagtccagctcttcagtgtgtcatttcctcttgcagacaccagaccaagggcagtggtggtctggcgcttatattttgttattatttgttgagac

SEQ ID NO: 71036 - DNA, 601 bp, Human
aaaaaatgtgtcactcagagatttttctacctagaacaagagtcacacatactttttgaaattattttatctatgtaaacttacgaggtacaagtgtaaatttgtgacatgcatagattgaatagagaggaagtcaaggcttttagatattcatcacctgactaatgtacatggtacccattaagtaatttctcatcatccaccctcctcccaccccgtcacccttctgagtctccattgtctactatcagaaaagccttctccagcagcgcattgtcagctgagtctaggagaagaaagscttctcatggacatgagctaaattccctgggaaaggccattccataatggagaaggccttctgttcacccacagtgtggtcctcagaccagcagcttcagcgtctcctgggaactcactagaaatgcagaccccaggcccagtgtggcagctcacgcctgtaatcccagcactttgggaggccgaggcgggtggctcacgaggtcaggagtttgaggccagcctggccaacatagtgaaaccccgtctctactaaaaatacaaaaaaaattagccgggcatggtggcgcatacctgtaat

SEQ ID NO: 71037 - DNA, 601 bp, Human
cgcattgtcagctgagtctaggagaagaaagccttctcatggacatgagctaaattccctgggaaaggccattccataatggagaaggccttctgttcacccacagtgtggtcctcagaccagcagcttcagcgtctcctgggaactcactagaaatgcagaccccaggcccagtgtggcagctcacgcctgtaatcccagcactttgggaggccgaggcgggtggctcacgaggtcaggagtttgaggccagcctggccaacatagtgaaaccccgtctctactaaaaatacaaaaaaaattagccgggcatggtggcgcatacctgtaatcccagctacttgggaggctgaggcaggaaaatcacttgaacccgggtggcggaggttgggctgagctgagatcgtgccgctgcactccagcctgggcaacagagggacactccttctaaataaataaataaataaataaataaataaataaataaataaaatgcacccaaacctgaattggaaactcaggtggggggcctagcggtctgtggttttactagccctccaggcaagttttgatgctttggtgattgagaactgctgcttat

SEQ ID NO: 71038 - DNA, 601 bp, Human
ctagaaatgcagaccccaggcccagtgtggcagctcacgcctgtaatcccagcactttgggaggccgaggcgggtggctcacgaggtcaggagtttgaggccagcctggccaacatagtgaaaccccgtctctactaaaaatacaaaaaaaattagccgggcatggtggcgcatacctgtaatcccagctacttgggaggctgaggcaggaaaatcacttgaacccgggtggcggaggttgggctgagctgagatcgtgccgctgcactccagcctgggcaacagagggacactccttctmaataaataaataaataaataaataaataaataaataaataaaatgcacccaaacctgaattggaaactcaggtggggggcctagcggtctgtggttttactagccctccaggcaagttttgatgctttggtgattgagaactgctgcttatgctgtcttggtggagagcacttcagccagtgcctcttctgctgattctgtatttatcaaagaaccactgactataatttagtgctcacactacagttaggaggtgtgtgagttccctttacaaacctatttctgattgtaaattcctaa

SEQ ID NO: 71039 - DNA, 601 bp, Human
cagctcacgcctgtaatcccagcactttgggaggccgaggcgggtggctcacgaggtcaggagtttgaggccagcctggccaacatagtgaaaccccgtctctactaaaaatacaaaaaaaattagccgggcatggtggcgcatacctgtaatcccagctacttgggaggctgaggcaggaaaatcacttgaacccgggtggcggaggttgggctgagctgagatcgtgccgctgcactccagcctgggcaacagagggacactccttctaaataaataaataaataaataaataaataaataaataaataaaatgcacccaaacctgaattggaaactcaggtggggggcctagcggtctgtggttttactagccctccaggcaagttttgatgctttggtgattgagaactgctgcttatgctgtcttggtggagagcacttcagccagtgcctcttctgctgattctgtatttatcaaagaaccactgactataatttagtgctcacactacagttaggaggtgtgtgagttccctttacaaacctatttctgattgtaaattcctaagatgttttacacatcagtatcttgtgagct

SEQ ID NO: 71040 - DNA, 601 bp, Human
ttgaggccagcctggccaacatagtgaaaccccgtctctactaaaaatacaaaaaaaattagccgggcatggtggcgcatacctgtaatcccagctacttgggaggctgaggcaggaaaatcacttgaacccgggtggcggaggttgggctgagctgagatcgtgccgctgcactccagcctgggcaacagagggacactccttctaaataaataaataaataaataaataaataaataaataaataaaatgcacccaaacctgaattggaaactcaggtggggggcctagcggtctgtgkttttactagccctccaggcaagttttgatgctttggtgattgagaactgctgcttatgctgtcttggtggagagcacttcagccagtgcctcttctgctgattctgtatttatcaaagaaccactgactataatttagtgctcacactacagttaggaggtgtgtgagttccctttacaaacctatttctgattgtaaattcctaagatgttttacacatcagtatcttgtgagcttgataaaagtgaatccatctcgttcagagtgatgcattatgagtgtatagtggaagtctagctt

SEQ ID NO: 71041 - DNA, 601 bp, Human
tttctcatttttgattagacagctatcatttacaaattagaccacagggaatcgaccttaacttctgtgactaaagcttttggcagttacttttggcatttctggccctctagacttgaaaatgactgagtggttacaatttacaaagttaagagagctttctgttgattggtgtgaatggtaggatatgagacagactcttaggagtaaaggacagggatttagggaaaatcctagtggagtcactgcagccaggcagagttgtctgttacatgcagataacaagtcacgctgttggggwtaattagaaaaagaggaaacaaagttgagaaaagaagagggaggcagagcagacggcagaggacaggaattttcagtgcagcgttgggaaaggttgtggaagctgaggctgacgcagacctagggcgttaaagctgtatttacagctggaccttctgattcctggggaggaggggaggctggatcgtgggtaagagagactggcagggccagtggaggatactctcccactggagttgtccagtgggagttgtctggagttgtcctgggcagaggctgcctgttgacagaggctcagcac

SEQ ID NO: 71042 - DNA, 601 bp, Human
taatcccaacactttgggaggctgaggggcatggatcgcttgagcctagtagttcgagaccagcctgggcaacatggcaaaactctgtctttacaaaaaatttaaaaaaaaattagccgggcatggtggcatgtgcctatggtctcagctacttgggagactgaggtgggaggatcacatgggctgaggaggttgaggctgcagtgagctgtgatcacactactgcactccagcctgagtgacagagtgagatcctcaataataagcagtcttcagtgtttcattttacccaggctaaatrtatttgtagtatacatatatgtttatattttgatagattcatgtgagtaaaagatatacaataaaaattgacattaccgaaggggagtgggattagatgtgagagggtggattagtaaattgttttacacacctctttaccattggacttgttacaataagcctataactatttttaactccataaaatacattgttttataagagctgtcaaatttcacttgctcagtcccctgattctcattttcttataaaatctcaggttcctcaaatatgaattcttctgccatgagaaattagc

SEQ ID NO: 71043 - DNA, 601 bp, Human
tggacttgttacaataagcctataactatttttaactccataaaatacattgttttataagagctgtcaaatttcacttgctcagtcccctgattctcattttcttataaaatctcaggttcctcaaatatgaattcttctgccatgagaaattagcaacatagtcttaaagtctggggaaagattatagtcagatccacatagataggacaacgttccaagtcgggagaatgttcatatgagaattgaatagaaggccaaatttttaggctaagaatatgatcagaggacacttccagtrgagagagtcagcgtgaagagttgaggtgcatggctgttgtgcatctgagagcgtgtacgcgggcgtgagagcgatttagatccctgtgtgttgaattcgagacccacccagacagcctccagtgtcttctcagtgactgtgcccaagatttctgtccatctgtggacatgttttaatgacagcaattagtggtaatgatggctattaaatacttaatgacatttctgtgttctgaggcttcttcatacaagaattcacttactggccgggcaccgtggctcacacctgtaatcccagcac

SEQ ID NO: 71044 - DNA, 601 bp, Human
agagattgagatcaccctggctaacatggtgaaaccccatctctactaaaaatacaaaatagctgggtgtggtggaacgtgcctgtagtcccaactactcgggaggctgaggcaggagaatcacttgaacctgggaggcggaggctgcagtgagccaagatcatgccactgcactccagcctgggtgacacagagagagactctgtctcaaaaaaaaaagaattcacttactttccacagaagcaggcactgttatgatccacagttcataaagaaggaatctgagacatggaaagtcgamctttcccaagcttgtaagtggaacagtattctgactccagatcctaaatggtaaaccactactctctgctgcctcgcagcctggagattttctgtaagagaggggctaaaataaaaaagcccacctcatattgatcacattcttagtaatccttgaatacgtttatattgtgtcattcatgaatgtcttttccctctggccagattatggtatttaggtcaggagccattttttcttgtttattttgtattcttacattgcccagatatgctcgataaatggtttttgaatgaattaacc

SEQ ID NO: 71045 - DNA, 601 bp, Human
gccgtaggcttcaattctgtgtattgtcactgttgtgtcttggagatttgtggtggtggtggtgtagctcagatatcaggcgattgggccctgtgcagaagtagagggaaattattttgtatggctcctaaccttgctctgcttttcctcaagtgataattgtgtaccctacaaagaatttaggagagtagaacgtggttgaatttcaagtctcattccactgaactgttttaactcatatctagtttttctctgcttttcagccacgccagtgtttttaaagatgcatcatttttgcatktcgcgctttccatcactttaaaaacactgacactgtttctccagctctgagttaggacagtagacctttaggggaatatttgagtgttgctctcactgccacgctgcggaaatgaagacagagcttaatgttggagacctttggggccagaaggtgtaaaaccttgactaggaagagagcctaatctttgaagaagtgtctgcctccttacttagtgaggggtgcatggacagtatttggccagtgcttcaagatagctgatgcacagtgatttacagtcaaagatagcacctgcccttg

SEQ ID NO: 71046 - DNA, 601 bp, Human
atttcatttaaactcatttatggtttggttttgtttttcccttaagtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtaagggctgtgtgtgtctctctgcaggacatgctggtctccaacttccccttccaaagcgacggctaacggcacagcacgattcggctctttgcagttcttacttaaccgacsccccctaaacagcaaaatcgattgcgtgtgttgtcgacctgtttcacgtttgcattacgttggtgccaggaccctcagcgcttcccctcccaaatgatctgggagtggagcagaaagaaggccagatgcattccatcattttgcaaatgcagtgttttgggaagtactttccttaaaagtgctgcttactctctagtatgctgtgctcaaagcatccattgaagtcatgccagggaataatactccgatgaggaactttttgcatgattcctggaacaaatgtctaattgggaagaagag

SEQ ID NO: 71047 - DNA, 601 bp, Human
ctgcttagtgtaattaaaacacaagaagcttccttggaccagaggcacgtcacttacttgaggccattgtgaggaaacactacctgtcacgttgaaattttgcggttttaagtgattttaacaccgcggggcgtgttgtgttttcctccgcactaacaatagccgggcgaggttccccttttatgggtgggaagataatggagtcagtctccttggtgtattttcaaggaaaataaggaccctaaaacaactaagggccttacaagtattctgtttttctttgaaatgttactttttatcrtttaaattccagtaatctatcatgtttctgtttagcttagctgaagtaaaacttgaccaatcgtagaatggtgggcctggcaataagttctaaaaaaagtgtcacataaatcgtaatgaacaaatctgttttgtgaagtaaacaatttgaacacagtttaaaaacctcaggaagaagagatgtggggtggccgttgagaagtagtgaatccgctcggggcgcttggtgtggcagggccttgtgcactgattcatttgaaacactcagcctgccctaaacacagaagctgtgttttatttg

SEQ ID NO: 71048 - DNA, 601 bp, Human
aatgtgtccctgtcttagcatgttttctgagagggggcatgtgcgggagaaggttctctgtcttttaatctttgtggaaggagtgaagagaacttggtagaaggatattgggggctttaatcagaaataagaagtggtttaaatcattagcacaacaaagcatactataagcttgaagataaaagtctctggggaaagagtcctctgaaaataaatggaacttgatagatttccatatcatttataacttcccttaattacacttggaagacttgccagtaaaactggaaaattggcagcytatatccattagagtcattttgccgaccatggcaagcagctggctttacgggatttgattcccatcactcacaattcatcatcagctggaggtgtctgcagctcttcagcacagagcaatgctgggtgacactcgggcccccacgacatgcgaaaatctgctgagtaaatgggccgaggtttctctcaagccttgtttggggcaaggccgactcttgcttaatgagtgccgctctgataatcggatgcgaacgtgaaccttgacctcgtgtcaaaggagaggacgcaataagctggatga

SEQ ID NO: 71049 - DNA, 601 bp, Human
caaagcatactataagcttgaagataaaagtctctggggaaagagtcctctgaaaataaatggaacttgatagatttccatatcatttataacttcccttaattacacttggaagacttgccagtaaaactggaaaattggcagcctatatccattagagtcattttgccgaccatggcaagcagctggctttacgggatttgattcccatcactcacaattcatcatcagctggaggtgtctgcagctcttcagcacagagcaatgctgggtgacactcgggcccccacgacatgcgaamatctgctgagtaaatgggccgaggtttctctcaagccttgtttggggcaaggccgactcttgcttaatgagtgccgctctgataatcggatgcgaacgtgaaccttgacctcgtgtcaaaggagaggacgcaataagctggatgaaagatacaggattcaggccttcaaactttacaccaattagacagggagcggggagatacatcaggcccactaggttcatcaaaaagacttgtgaggcttgtgaccattttgtaagcccaacattggagacatcctgtcacaatcattaagtcttt

SEQ ID NO: 71050 - DNA, 601 bp, Human
tggaacttgatagatttccatatcatttataacttcccttaattacacttggaagacttgccagtaaaactggaaaattggcagcctatatccattagagtcattttgccgaccatggcaagcagctggctttacgggatttgattcccatcactcacaattcatcatcagctggaggtgtctgcagctcttcagcacagagcaatgctgggtgacactcgggcccccacgacatgcgaaaatctgctgagtaaatgggccgaggtttctctcaagccttgtttggggcaaggccgactcytgcttaatgagtgccgctctgataatcggatgcgaacgtgaaccttgacctcgtgtcaaaggagaggacgcaataagctggatgaaagatacaggattcaggccttcaaactttacaccaattagacagggagcggggagatacatcaggcccactaggttcatcaaaaagacttgtgaggcttgtgaccattttgtaagcccaacattggagacatcctgtcacaatcattaagtctttatcagatgattcacaaaagtgttggagaaacgtgcgcacacatcctgcaggaacgggccc

SEQ ID NO: 71051 - DNA, 601 bp, Human
taagcccaacattggagacatcctgtcacaatcattaagtctttatcagatgattcacaaaagtgttggagaaacgtgcgcacacatcctgcaggaacgggccccgcacatgggggcgtctgatggagacggaatggtggagggccctctctgcgcacccaattaatgcttggcctcccagccaccctgggcaatccggaaggtgttgcttccattgggcccactgcccagctccctggtgtaccctacatgtactctacggtgtgcgacacattctgcaggagtcagcgctgctgggagyaaggctccaaagtcctaaggtgagagcccctgctcccgagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgtgtgttggggt

SEQ ID NO: 71052 - DNA, 601 bp, Human
gtctttatcagatgattcacaaaagtgttggagaaacgtgcgcacacatcctgcaggaacgggccccgcacatgggggcgtctgatggagacggaatggtggagggccctctctgcgcacccaattaatgcttggcctcccagccaccctgggcaatccggaaggtgttgcttccattgggcccactgcccagctccctggtgtaccctacatgtactctacggtgtgcgacacattctgcaggagtcagcgctgctgggagtaaggctccaaagtcctaaggtgagagcccctgctcccragggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgtgtgttggggtagaacatgtttctgttgagcaagatgtatctcactatt

SEQ ID NO: 71053 - DNA, 601 bp, Human
tgggagtaaggctccaaagtcctaaggtgagagcccctgctcccgagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgtgtggtggggtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtaataccctatctgtactaaa

SEQ ID NO: 71054 - DNA, 601 bp, Human
gggagtaaggctccaaagtcctaaggtgagagcccctgctcccgagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgtgtgttggggtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtaataccctatctgtactaaaa

SEQ ID NO: 71055 - DNA, 601 bp, Human
ggagtaaggctccaaagtcctaaggtgagagcccctgctcccgagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgtgtgtttgggtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtaataccctatctgtactaaaaa

SEQ ID NO: 71056 - DNA, 601 bp, Human
gagtaaggctccaaagtcctaaggtgagagcccctgctcccgagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgtgtgttgtggtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtaataccctatctgtactaaaaat

SEQ ID NO: 71057 - DNA, 601 bp, Human
agtaaggctccaaagtcctaaggtgagagcccctgctcccgagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgtgtgttggtgtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtaataccctatctgtactaaaaata

SEQ ID NO: 71058 - DNA, 601 bp, Human
gtgtgtgtgtgtgtgtgtgttggggtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtrataccctatctgtactaaaaatacaaaaattagctgggcgtggtggtgcacacctgtattcccagctactcaggaggctgaggcagaagaatcgcttgaacttgggaggtagaggttgcagtgagctgagattgtgccgctgcactccagcctgggcaacagaccgagattctgtctctaagatagatagatagattagatagattagattagattacataagatagatagatagataaaatagattagataggatagataggatagaccgagattctgtctctgatggagatggataga

SEQ ID NO: 71059 - DNA, 601 bp, Human
atgccacgtgaaaatgaatcaaaaagggcagcgcgggcagcgcttccaggcccagctcctcagcgcggtgtctctcctccgtgccagcgccaaagccttggcatcgtctctcttcctatatttctatgccaggaagaagcagcccaccacctgaacagcagaggaaaagagtacatcggctcaggcgctccagagtgccagcaagacagcttgcgccacacgggggggccagagggggacttggagatcatctggggatttcaggaaagaacattctctaggcgcttctgaggcattggaygaatatggccacagtggtgtgaggggccaggagccccatgccaggacacccacccacaccacatagccattgccctaggaacctggacttgcccgtttcaaagactgggaggccaaagaaaaacctggccggctcaggacgctgacccatcggggcagagcgaagtgagcgcgcagcatggttttcagctgcagctcactcctgcagggaagcctcgcgcttaacgccagtgggcttaacccagctcagcctggctgcccctcaggatgaaaggcaagttctgaacgcagtctgagcaaa

SEQ ID NO: 71060 - DNA, 601 bp, Human
gtacatcggctcaggcgctccagagtgccagcaagacagcttgcgccacacgggggggccagagggggacttggagatcatctggggatttcaggaaagaacattctctaggcgcttctgaggcattggatgaatatggccacagtggtgtgaggggccaggagccccatgccaggacacccacccacaccacatagccattgccctaggaacctggacttgcccgtttcaaagactgggaggccaaagaaaaacctggccggctcaggacgctgacccatcggggcagagcgaagtgagygcgcagcatggttttcagctgcagctcactcctgcagggaagcctcgcgcttaacgccagtgggcttaacccagctcagcctggctgcccctcaggatgaaaggcaagttctgaacgcagtctgagcaaaggcccgtgggcgctcccagtctcctagcatggaatgcatgtagctctggaagtcattcctgtgtctggagggttttccggaagctgccttgtgccttgttgtgggtactcgctgtgtcttgcagaggatgggacagtggtcctcgtggcgccagggccgagctgttccca

SEQ ID NO: 71061 - DNA, 601 bp, Human
acacgggggggccagagggggacttggagatcatctggggatttcaggaaagaacattctctaggcgcttctgaggcattggatgaatatggccacagtggtgtgaggggccaggagccccatgccaggacacccacccacaccacatagccattgccctaggaacctggacttgcccgtttcaaagactgggaggccaaagaaaaacctggccggctcaggacgctgacccatcggggcagagcgaagtgagcgcgcagcatggttttcagctgcagctcactcctgcagggaagcctcrcgcttaacgccagtgggcttaacccagctcagcctggctgcccctcaggatgaaaggcaagttctgaacgcagtctgagcaaaggcccgtgggcgctcccagtctcctagcatggaatgcatgtagctctggaagtcattcctgtgtctggagggttttccggaagctgccttgtgccttgttgtgggtactcgctgtgtcttgcagaggatgggacagtggtcctcgtggcgccagggccgagctgttcccagttccccgggactatagacagaaatatgtatatttggtggtggtttt

SEQ ID NO: 71062 - DNA, 601 bp, Human
ttttaaaacttctgcccatttttgttttccaggtagcagaaggtcaagaaatttgtgtgattgaagccatgaaaatgcagaatagtatgacagctgggaaaactggcacggtgagtccctaagtccccatcagcccaggccggccctgtgatggaggaacgcccacctttgaatcgtgggtggtttggctggaaagggccacagaggcgccctctccccctcgcttctacagaggaggacgttaggattgggagcttttgccattctgccctgatgcatccctgcctcgtagagagcgtgscttccaaaaagtctgtgctttatgttcaggtagtcaaagaacaattgttcttcaccttaatgtctttctttcaaattaaggggtctttaatttttaatgtttacatctgtcttgaaggcagttagttatctgagacttaggtgacacagcagcaaatggttttacaaattgcaaaaattaatgtaactcttcaagacaatttctctacaaagggaacaattcagttgcagatcaagagaagccaaaaccccatgtacatgtgggacttaattatttagggagaaaaaaatattagtactg

SEQ ID NO: 71063 - DNA, 601 bp, Human
cgcacggccgtgtccttggccaagagctgcccgccagtccctgggagaaaggggtctctctggacgtctcccaatccccttgtttttcaggatgtgtctaagagacaggaggtggacacggcaggccctggctgcttgtgccctccccgtggtccctagaatatgaagagcccatcctttcagaagcacctaccgaaaaaggccaggacatgagaaaggaggtcagaggaagaggtgaggacctgcccagggtggggcagggagaccccctgcaggcagttcaagaccagagcccttcctrggggcatctgggcccaggtccttgataagcatctgtggccaacctctttcccaccatccccactggggaaaagttggcgccaacaagtttaattccacagctttaagtctccccacagaattggctgagcacactccgcacacagaggctgccctggcgaagtcccctgaggctgaggattctggccaacatgggacaagggctaccttcgctgtccacccacttgagggtgagcgggtgctgctggtgcagacgacacatgtctctcacttcctcacagagctcctcgaaggtcgtggc

SEQ ID NO: 71064 - DNA, 601 bp, Human
cgggaggctgaggcaggagaatggcatgaacccgggaggcggagcttgcagtgagctgagattgtgccactgcactccagcctgggcaacagagcaagactccgtctcaaaaaaaaaaaaaaaaagtcaaagaaaaaaacccaaatggcattatattagacatccctaaattctctggcatcataggattttaaaccattttaaatcccccagctagtcggcagacacccacagccaggaacagccccccagagctgcccaccacagaccccgccactaaccatgaatgatgaggccttcrtccctgcactgacgggccaggcggaaagcctcttccagctccatctgggaggacaccgtgcaagggtcacctgggtggggcaggagacggtgctgacgtcgccgaaggcccgaggcaaagggggctgtgacgagcccgctcagcacaccagacaagggtctggtggggggcaaagtcccgatgctcagactggccacctcctggcagggtcgggaggtccaaggacggccgtccacactagggagtcacctggcccccggtgcagcgtcagagccaccccggaagggaagtcagtacacc

SEQ ID NO: 71065 - DNA, 601 bp, Human
atacaaaaaattagccgggcgtggtggcgggcgcctgtagtcccagctactcgggaggctgaggcaggagaatggcatgaacccgggaggcggagcttgcagtgagctgagattgtgccactgcactccagcctgggcaacagagcaagactccgtctcaaaaaaaaaaaaaaaaagtcaaagaaaaaaacccaaatggcattatattagacatccctaaattctctggcatcataggattttaaaccattttaaatcccccagctagtcggcagacacccacagccaggaacagcccccsagagctgcccaccacagaccccgccactaaccatgaatgatgaggccttcgtccctgcactgacgggccaggcggaaagcctcttccagctccatctgggaggacaccgtgcaagggtcacctgggtggggcaggagacggtgctgacgtcgccgaaggcccgaggcaaagggggctgtgacgagcccgctcagcacaccagacaagggtctggtggggggcaaagtcccgatgctcagactggccacctcctggcagggtcgggaggtccaaggacggccgtccacactagggagtcac

SEQ ID NO: 71066 - DNA, 601 bp, Human
gcgggccctacgctggccactggagcctctgagtggtttacgggttctttgttaagagcagttttcatttgggttaataaaatgtcaaagaaaaggccgggcgcggtggctcacatctgtaatcccagcactttgggaggctgaggcaggcagatcacgaggtcaggagactgagaccatcctggctaacacggtgaaaccccgtctctacaaaaaatacaaaaaattagccgggcgtggtggcgggcgcctgtagtcccagctactcgggaggctgaggcaggagaatggcatgaacccrggaggcggagcttgcagtgagctgagattgtgccactgcactccagcctgggcaacagagcaagactccgtctcaaaaaaaaaaaaaaaaagtcaaagaaaaaaacccaaatggcattatattagacatccctaaattctctggcatcataggattttaaaccattttaaatcccccagctagtcggcagacacccacagccaggaacagccccccagagctgcccaccacagaccccgccactaaccatgaatgatgaggccttcgtccctgcactgacgggccaggcggaaagcctct

SEQ ID NO: 71067 - DNA, 601 bp, Human
ctggtggggctgtcccctctgtccacatgcgccgcgggccctacgctggccactggagcctctgagtggtttacgggttctttgttaagagcagttttcatttgggttaataaaatgtcaaagaaaaggccgggcgcggtggctcacatctgtaatcccagcactttgggaggctgaggcaggcagatcacgaggtcaggagactgagaccatcctggctaacacggtgaaaccccgtctctacaaaaaatacaaaaaattagccgggcgtggtggcgggcgcctgtagtcccagctactsgggaggctgaggcaggagaatggcatgaacccgggaggcggagcttgcagtgagctgagattgtgccactgcactccagcctgggcaacagagcaagactccgtctcaaaaaaaaaaaaaaaaagtcaaagaaaaaaacccaaatggcattatattagacatccctaaattctctggcatcataggattttaaaccattttaaatcccccagctagtcggcagacacccacagccaggaacagccccccagagctgcccaccacagaccccgccactaaccatgaatgatgaggccttcg

SEQ ID NO: 71068 - DNA, 601 bp, Human
gcaccgggcaggtgaggtggctggtggggctgtcccctctgtccacatgcgccgcgggccctacgctggccactggagcctctgagtggtttacgggttctttgttaagagcagttttcatttgggttaataaaatgtcaaagaaaaggccgggcgcggtggctcacatctgtaatcccagcactttgggaggctgaggcaggcagatcacgaggtcaggagactgagaccatcctggctaacacggtgaaaccccgtctctacaaaaaatacaaaaaattagccgggcgtggtggcgggsgcctgtagtcccagctactcgggaggctgaggcaggagaatggcatgaacccgggaggcggagcttgcagtgagctgagattgtgccactgcactccagcctgggcaacagagcaagactccgtctcaaaaaaaaaaaaaaaaagtcaaagaaaaaaacccaaatggcattatattagacatccctaaattctctggcatcataggattttaaaccattttaaatcccccagctagtcggcagacacccacagccaggaacagccccccagagctgcccaccacagaccccgccactaac

SEQ ID NO: 71069 - DNA, 601 bp, Human
ggggctttgaacttaaagctgaggacagctgtgagcctggagccgggcctagggagcaccgggcaggtgaggtggctggtggggctgtcccctctgtccacatgcgccgcgggccctacgctggccactggagcctctgagtggtttacgggttctttgttaagagcagttttcatttgggttaataaaatgtcaaagaaaaggccgggcgcggtggctcacatctgtaatcccagcactttgggaggctgaggcaggcagatcacgaggtcaggagactgagaccatcctggctaacacsgtgaaaccccgtctctacaaaaaatacaaaaaattagccgggcgtggtggcgggcgcctgtagtcccagctactcgggaggctgaggcaggagaatggcatgaacccgggaggcggagcttgcagtgagctgagattgtgccactgcactccagcctgggcaacagagcaagactccgtctcaaaaaaaaaaaaaaaaagtcaaagaaaaaaacccaaatggcattatattagacatccctaaattctctggcatcataggattttaaaccattttaaatcccccagctagtcggcagac

SEQ ID NO: 71070 - DNA, 601 bp, Human
agaagaattgcttgaacccgggaggcggaggttgcattgagctgagatcgcgtcactgcactccagcctgggcgacagagcgagactccaactaaaaaaaaaaaaaaattagccaagtgtggtggcacatgcctgtagtcccagctactcgggaggctgaggcaggacaatcgcttatatctgggaggtggaggttgcagtgaacagagatagtgccactgcactccagcctggggacagagccagactctgtctcaaaaaaataaaacaagttttggagaggggggggtctcactatgtkgcccaggttggtcttgaactcctaggctgaagcgatcctcccaccttgacctcccaaagtgctgggattacagttgtgagccaccgcacccggcctagtctttaaatttagagcctcattgatataaagggcgaagaaaattaagtgttgtaaccaggtagcccggtgtccaggagaatgatggatctgtcagaaatccatgggtggtttcgagctttggtcccatcttggactcaatcgtccatggccagacgcctggcaaggagcccaagctacgccagaagtggacacagagacaaa

SEQ ID NO: 71071 - DNA, 601 bp, Human
gtcaccaagtcaaaaaatcacccaggtggcaaataaacacggcccgtgggtcccctcctataaagcagcagcatgaggctgcagggcgctgtggaggggacaaccatcgtctcacccacagggagtatctgtcctatttatgtgtttatgtatctataaaaacgcagtgaaccgtgccctcccagggtgcgtgctccagggtccgtgaggcgtgggcacccagagggagggtcccgggaaaggtcaccaccagggcagctgcgtaggtgatcagggccctgacgcccaccgtctggccacmtgcctccaaagcctccccgccccctgcctcctcacactcgccctgcgctgccaaaaccacctggtggtgtccgcctgccacggacataccccatctcctcctgccggcaggtccagccccagaccacccgctccattcctgccagggcccacctccggatggctcctcggccttgccggccacggtgcagggaccccggttggctgagggcctggaaccgggatgccacgccgccctctccccgggcagatcatggaaatcccatggctcctggggcctcccctacgctaagcgctgcca

SEQ ID NO: 71072 - DNA, 601 bp, Human
cacggtgactcggctgccacccccatgacacactccccttcagagctcaggcctctggacatcctgtgaccccccaacctccccttcctccactgcagtggccgagcaaatgcgggcctcccttccctacgcaaggccggcaggttgtccacacgggcagagaggcaatgccgaggtcgtagacagaaagagcagaccccaggcccccaggcagggttgagacaagaggcagacatgtcggagaaatacggtgggcttcccccgcgcccaggggctacactggccgcatgtggatacctcygggagtgcacagtctcagcacacatgggacagaggagcacagtcctgtcaccaagtcaaaaaatcacccaggtggcaaataaacacggcccgtgggtcccctcctataaagcagcagcatgaggctgcagggcgctgtggaggggacaaccatcgtctcacccacagggagtatctgtcctatttatgtgtttatgtatctataaaaacgcagtgaaccgtgccctcccagggtgcgtgctccagggtccgtgaggcgtgggcacccagagggagggtcccgggaaaggtcaccaccagg

SEQ ID NO: 71073 - DNA, 601 bp, Human
aggcccacggtacagccgcagtcctgccctcgtctgcctctggcgtgctccatccactgtacacacctcccagtccgacccttctcactgaccctcagcctgggcagtgctgcctgaggtcaaaaacacctgtgaacacccccacaggcgctaaaaccacagagccccaggcggcggccactggcaaccagagcagggtgtcctgtctgagatgagcaccacagtcagagtgaaagaaagcacaggacatcagggagagcgccagccccctaagccctggtggcctgggaccccgagtggkcagtgtgttctcacacactcctgacactagcgccatgaaacccaacccacgtccgggtggacatcagcacacagggcagggcagggctccccacccccagcacccgcctctgacctcctcggcaaaggctgccccagaggctctggcggaatgtccccaaccaggctgagtggtccccgaagccgtggagccacccctggtaaacatctcaaggacctactcacgtgtcccaggaggtccttcctcggggcttggccacattctccgcattccccacggtgactcggctgccacccccat

SEQ ID NO: 71074 - DNA, 601 bp, Human
ctgaactccagcctaagcgacagagcgagacgctatctcaaaaataaatgaataaaaatagaatgatcaatgatccagcaatctcacttccgggtctacacccagaactgaaggcagggtctccagaggtcactgtgcacccgtgctcacagcagcatcattcacgacagctaaactgtggaagtcacccgtgtgtccactgacagaaatgggtaaacaaaatacatccatacagcagcctgcggttcagtcttgagaaggaaggagactgtgacacaggctacgcatggctgcgccttgrggacatggtgctgagtgaaataagctgtcacaaaaggacagatcctgtgcgattccactcacaggaggcccctagagtcaccaaagtcacagaaacagaaagcggcgggtgggtgatgggggctgggggaggcagaatggggagtgagtgtttcatggagacagaggctgagtctgggaagatgaagagagttctggagatgggcggtgatgatgactggacagcaatgcgaatatcgaataccagtgaattgaacctttaaattttaatggctaagatggggacaggctcggtggctca

SEQ ID NO: 71075 - DNA, 601 bp, Human
aaaacaacccacaaagcaggagaagatatttgctaatcatatatctgctacgggattaacatccaggacagagaactagtaacactcaccaacaaaaaaaccaaacaacccattcaaaaatggacacaggacgcgaaaagacatttcaccaaagaagacacagaaatggccaacaaagccgggcacggcagctcacgcctataatcccagcattttgggaggccgaggtgggtggatcacttgaggtcgggagttcaagactaacctggccaagatggtgaaacccccaactctactaaamatacaaaaactagctggacatggtggcgggtgcctgtaatcccagctactcaggaggctgagacaggagaatcatttgaatctgggaggcggagattgcagtgagccatgatcgtgccactgcactccaacctgggcaacagaccaagactccaactcaaaaaaaaaaaaaaaaaagaaatggccaacaggcacatgaaaaaatgctcaacatcacttatcaccagggaaatgagaaccaaaaccacaatgatatgccacctcacgcccataagatactgtcaaaaaacagaaaacgaca

SEQ ID NO: 71076 - DNA, 601 bp, Human
aaaaacccacagcagacatcacactcagtgatgaaaacctgaaagcttttctttgacaatcaggacaaaggcagggatgattgaccacaccacttttttttttttttttttttttttgagacagagtctggctctgttgcccaggcaggagtgcagtggcacgatctccgctcactgcaagctctgcctcccgggttcaggctattctcctggctcagcctcccgagtagctgggactacaggcgcctgcaaccacgcccggataattttttgtatttttagtagagaacggggtttcacygtgttaaccaggacgatctcgatctcctgacctcgtgatccacccgcctgggcctcccaaagtgctgggattacaggcgtgagccaccgcgcccggccgatcacaccacttttattcaacagagtagtggaattctagccagaacaattaggcaagaaaaagaaatacaaggcatccaaattaggaaggaaaaagtaaaattatctctgtatacagatgatatgatcttacatgtaagaaagccctaaagtttccacagaaagttgttagaactgataaattcagcaaaacagcaggcaa

SEQ ID NO: 71077 - DNA, 601 bp, Human
gggatccccactcgaccggggcgtgaccagccctcacctcccccaaaaaaccaggcgctcctgatctcatcacacgctcagccccgaacgacccagcccccaccagtgtccatcagcagaggaacggacagacagggtgaatcgcatcacagaattcatccagccataaaaaggaatgaaaaagcaactagggagaacacgtaaagaaacagagaacttgaacaacacagtaacccgcatagctctgacagacacagcagagcgctgtacccacagcggctgcacaccctcaacgcacacrggacgttttccagaacagaacacaagtgagccacagactcagccgcggtagatttcaaaaaacagacattatccaaagtatattctccaaccacatcaagatgaacttagaaatcagttaacagaaagaaaacagaagaattcgcaaatatatggaaataacactacacactcaaccaatggatagaagatgaaaccacaaagaaaatcagaaaaatgctgagagatgaatgaaaacagaaacacaacatatcaacatttcagggatgcagggaaagcaatgctaaggagaaaatttata

SEQ ID NO: 71078 - DNA, 601 bp, Human
ctcccaccagatcagaggcagaccttgatgtagtcaactgtggtgcgttgaggatgggcctccaaaaagacaagtccatgtcctactccagaagctgtgagcgtgaccctcctttggaaaagggttcctgcacgtgtgattaaggccaggtctcaaggtgaatgtcctggactgccctggtgggccccaaagccgaccaccggtgttccagtgagaaaagacacagacatgggggaggttcagggtgacaggccagaggctggagtgatgtctacaaatcaagagttgacagcagccccaragctgggtggccaggaagcaggatgctcaaagcctcccaagaaagccagccctggccacaccttggcctgggtctgcagcctcccagctccagcttcccctctggggtgggggtggcaaggaaggcggggggtctctgagagtggccctcccacatggccgcatcgaagccgggccgccccacccctccctagcgatgctctcccgttaccagggccgggctgtggcttgcagctggggtctgccccggaggagctgctcggaggtctttggatccagccttgctctcgctgctgcccca

SEQ ID NO: 71079 - DNA, 601 bp, Human
gcacggatgcaggggagggctctcccgggcggggctgacggaggttccgggggtcgcattggttggggtgttgctggaacactaaggacaagcgactgcagaacggacgccgttcaagatgtggctggcggggtggtgaccagcaggaaccaggccacgtgtccccgtggcagccggcagggtggtgactggcgggaactgggccacgtttccccaactctgaggggaggctgcccacccaggcctcccttcttagaggggtccgaaaggggcgtcagtctcagttccgctgagcaccggytgggcctgtcccagccagaagaacctacagaagagccacctgctgtctgtcctgccaggcgccggcccagcacatggtcccaatgaccagcgccactggcagcacgaacctctcacggggcgggggcctgggcagagagcatttcctggggacagagcccacccacaaagtgctggtggagacagaccacccagcactcccaccagatcagaggcagaccttgatgtagtcaactgtggtgcgttgaggatgggcctccaaaaagacaagtccatgtcctactccagaagctgtgagcgt

SEQ ID NO: 71080 - DNA, 601 bp, Human
ggggcctgcagctggggctgggtccggagaggccaaaggctagaggatctcagtttcaacaagcacagcacggatgcaggggagggctctcccgggcggggctgacggaggttccgggggtcgcattggttggggtgttgctggaacactaaggacaagcgactgcagaacggacgccgttcaagatgtggctggcggggtggtgaccagcaggaaccaggccacgtgtccccgtggcagccggcagggtggtgactggcgggaactgggccacgtttccccaactctgaggggaggctgyccacccaggcctcccttcttagaggggtccgaaaggggcgtcagtctcagttccgctgagcaccggctgggcctgtcccagccagaagaacctacagaagagccacctgctgtctgtcctgccaggcgccggcccagcacatggtcccaatgaccagcgccactggcagcacgaacctctcacggggcgggggcctgggcagagagcatttcctggggacagagcccacccacaaagtgctggtggagacagaccacccagcactcccaccagatcagaggcagaccttgatgtagtcaa

SEQ ID NO: 71081 - DNA, 601 bp, Human
ggactctaaggacctcggaggcctggtccagctgaccatccagcgctgccctcagcagggtctgggtgcaaagccaggctacccccggcacctcctccacagggcgggcaccctgagtctttaccacacaccacagggaggccaatggggcctgactggggaccaccctgtcccatggacgctgcccaggcctgaggctacccactgaggagccccagagcctctggactgcagcagcagcagaaataaccccacccaaaggaagactggggctgctgcctatagcatccacccctccctscacatgatgggcccggccatctagaaacaggaagcccctggagccaacacggaggagccagggtgtcgggaggtccctcgcttactgccagggttcaggggaccgcccaccacccaccaggggaagtggcagaaagggccctggctgtcgtcttgacatctccctccctgccacgtccacctactgtcctttgagacaggtatcaacactcgctccaatgggggtctggtcctaagcacttttacacacgattttatttacaatcaccccgttttacaggtaaagaaaaggcaccactaa

SEQ ID NO: 71082 - DNA, 601 bp, Human
ccccggggacaccaccagctgctaagtggggtctgcggctgcccagcccagcggactttgtatttcctccatggactctaaggacctcggaggcctggtccagctgaccatccagcgctgccctcagcagggtctgggtgcaaagccaggctacccccggcacctcctccacagggcgggcaccctgagtctttaccacacaccacagggaggccaatggggcctgactggggaccaccctgtcccatggacgctgcccaggcctgaggctacccactgaggagccccagagcctctggaytgcagcagcagcagaaataaccccacccaaaggaagactggggctgctgcctatagcatccacccctccctccacatgatgggcccggccatctagaaacaggaagcccctggagccaacacggaggagccagggtgtcgggaggtccctcgcttactgccagggttcaggggaccgcccaccacccaccaggggaagtggcagaaagggccctggctgtcgtcttgacatctccctccctgccacgtccacctactgtcctttgagacaggtatcaacactcgctccaatgggggtctg

SEQ ID NO: 71083 - DNA, 601 bp, Human
cagccagcactggctctgatgaccccggggacaccaccagctgctaagtggggtctgcggctgcccagcccagcggactttgtatttcctccatggactctaaggacctcggaggcctggtccagctgaccatccagcgctgccctcagcagggtctgggtgcaaagccaggctacccccggcacctcctccacagggcgggcaccctgagtctttaccacacaccacagggaggccaatggggcctgactggggaccaccctgtcccatggacgctgcccaggcctgaggctacccactkaggagccccagagcctctggactgcagcagcagcagaaataaccccacccaaaggaagactggggctgctgcctatagcatccacccctccctccacatgatgggcccggccatctagaaacaggaagcccctggagccaacacggaggagccagggtgtcgggaggtccctcgcttactgccagggttcaggggaccgcccaccacccaccaggggaagtggcagaaagggccctggctgtcgtcttgacatctccctccctgccacgtccacctactgtcctttgagacaggtatcaa

SEQ ID NO: 71084 - DNA, 601 bp, Human
gggcagaatgtggaatgtaggacacctttccccagggtgcaggctggagcagggtcccgctgcccgggtatgccatctgtgctgtggacaggcaggaaccaacaacatgaaatgcacagggcagccagcactggctctgatgaccccggggacaccaccagctgctaagtggggtctgcggctgcccagcccagcggactttgtatttcctccatggactctaaggacctcggaggcctggtccagctgaccatccagcgctgccctcagcagggtctgggtgcaaagccaggctacccccggcacctcctccacagggcgggcaccctgagtctttaccacacaccacagggaggccaatggggcctgactggggaccaccctgtcccatggacgctgcccaggcctgaggctacccactgaggagccccagagcctctggactgcagcagcagcagaaataaccccacccaaaggaagactggggctgctgcctatagcatccacccctccctccacatgatgggcccggccatctagaaacaggaagcccctggagccaacacggaggagccagggtgtcgggaggtccctcgcttac

SEQ ID NO: 71085 - DNA, 601 bp, Human
gcctggggcctgacccaagcgttccaggctccagaagccactaccgggaccaccctaagtgacaagatgggctacagtggggtggggctgcctgctacgggcagaatgtggaatgtaggacacctttccccagggtgcaggctggagcagggtcccgctgcccgggtatgccatctgtgctgtggacaggcaggaaccaacaacatgaaatgcacagggcagccagcactggctctgatgaccccggggacaccaccagctgctaagtggggtctgcggctgcccagcccagcggactttktatttcctccatggactctaaggacctcggaggcctggtccagctgaccatccagcgctgccctcagcagggtctgggtgcaaagccaggctacccccggcacctcctccacagggcgggcaccctgagtctttaccacacaccacagggaggccaatggggcctgactggggaccaccctgtcccatggacgctgcccaggcctgaggctacccactgaggagccccagagcctctggactgcagcagcagcagaaataaccccacccaaaggaagactggggctgctgcctatagcat

SEQ ID NO: 71086 - DNA, 601 bp, Human
aaaccccaggggccccaccagacccaaggggtgaggctcgggagggtcccagctgcctggggcctgacccaagcgttccaggctccagaagccactaccgggaccaccctaagtgacaagatgggctacagtggggtggggctgcctgctacgggcagaatgtggaatgtaggacacctttccccagggtgcaggctggagcagggtcccgctgcccgggtatgccatctgtgctgtggacaggcaggaaccaacaacatgaaatgcacagggcagccagcactggctctgatgaccccgrggacaccaccagctgctaagtggggtctgcggctgcccagcccagcggactttgtatttcctccatggactctaaggacctcggaggcctggtccagctgaccatccagcgctgccctcagcagggtctgggtgcaaagccaggctacccccggcacctcctccacagggcgggcaccctgagtctttaccacacaccacagggaggccaatggggcctgactggggaccaccctgtcccatggacgctgcccaggcctgaggctacccactgaggagccccagagcctctggactgcag

SEQ ID NO: 71087 - DNA, 601 bp, Human
ggtcaggaagggcccctccacggcccccatggctccacccacatggctgcagccccttcccctgctatctgccccaggaccaccggcccgggagagcccaggttcctccacttcccctacacaggccaaggcgactttgccacccttgcatccagagacctgctattaacatccctggccatgaaaacctcccgcttgccaagtagaaatggccttggagctgggttcaggggctgagcagggaatatacccagaggcaaaggcagtagtcacggtgtcctcccggccaaaccccaggggycccaccagacccaaggggtgaggctcgggagggtcccagctgcctggggcctgacccaagcgttccaggctccagaagccactaccgggaccaccctaagtgacaagatgggctacagtggggtggggctgcctgctacgggcagaatgtggaatgtaggacacctttccccagggtgcaggctggagcagggtcccgctgcccgggtatgccatctgtgctgtggacaggcaggaaccaacaacatgaaatgcacagggcagccagcactggctctgatgaccccggggacaccaccag

SEQ ID NO: 71088 - DNA, 601 bp, Human
gtcacacgcccaggtcacacgcccaggtgtactggctgctcccagcaggcgactccatggtagccccgggcccagcaccctccacgtccctgtggggatggtgtcccggccaaggacccctctctgccctaggctacagggctatgagggcgggaggcagacgggccaggggatggatctggggatcccgccattgctccaagtgagacactacagccagaaggccccggagcctcaagagccccttccccttcctggcccaccccggcccccgcagccgaggactgtcccccgccagccycaccccagcccctgcagctgaggactgtcccccgccagccccaccctggcccccactgtggggtcaggaagggcccctccacggcccccatggctccacccacatggctgcagccccttcccctgctatctgccccaggaccaccggcccgggagagcccaggttcctccacttcccctacacaggccaaggcgactttgccacccttgcatccagagacctgctattaacatccctggccatgaaaacctcccgcttgccaagtagaaatggccttggagctgggttcaggggctgagc

SEQ ID NO: 71089 - DNA, 601 bp, Human
acatggggggtcgcggggtgctcagctgggaattctgcccacttccccaaacgcactcggcactcgtgctgagcctacatgggccgcttcgcactgggggtgcagagggacagaggggagtgtcctgcagacctctggctctgaccagtcacaccacacgctccctgcattcatacgtgctgtgccctcgatgctccagcacctatggccctgctgaccctggagggacggccccgagaggccaaccgattcctagagacagcaaaggacttgtcccacagcgaacctttcaaatgcaaayccaccaacccagaactctcacctgggcccacctcctacacgggcccccagtcgccccaggggcctccccaggtcacagggacagcccctgcaccccagagcctgctgaagttactccacctggccgacccaatgcctgctccccacacctttcccatggaaaccacagtaaaggccccacccacacatccccctgcctccaacccacccggcgcttgcccgcatggccccgcgaggcaagaggaggtctcctctcagaagctgagtaataaacgaccttctcaacggcatcatctcctga

SEQ ID NO: 71090 - DNA, 601 bp, Human
tacctccaaccatttcagaatagaaaacaggacgccgcagccccgctcctcgccaccatccgaggaccccgatggagtgagccgtgcacattaaccctggccgtgccacccagactccaacccaacactgtcaatgcaaaacgggggctcagacaggcgggagggcaggctcgagacggaaagaccgcaggcctggaacaggtgctggctgttaccactaccagccctggcacctggggtctccagacttcacccgtggtctcatcaatctgcccacctgcagcaatgcagaatggagacraagcggccatccgtcctggccccgacagacccacagacccacaaccaaaaagcatcggccacagtgaaactcccaacagccagcaactccctggggccaggcaggcagacgagcccaagacgatttccccaagccccccggcccccagccctccacagccaccgccacgcatccaccaggcctgggccacacaccatccgtcctcggggtgagcatgtccctccagcagcccctgcctcgctcagaaggtccctccacagccttatttttctaaaaatctgtcacccgcaaaacaacagc

SEQ ID NO: 71091 - DNA, 601 bp, Human
gtattcacaccgcgagggatcgtgccagctgtgcatggccagcgtgggctcacacgaaagcagaggccaagccgtcccaggcaccgaggaaactatgacacagcacgtttctcctcgcaggcaggcgcacgtgtgaaaaccaccccagctccgtctctctcccactcaccccatcaacacagaatcttcatcactcaaggacccctgcggcccaagctggctgtgcggagcagccctgcgtctgctgaggtcccttcgcacctgggggaggggcgcgctgccagcctccccagcagccagyaccccccgagagggaaagccgcctcccccagcagcccagtccccaccttcagcagcccagtctccccaggcccacggctccccacaagcctgactggggaggctggttgttgttttggttttttgttgtttttttttttaaaaaaaacaccttgcaaaatggtcgtcagaaaagcacccacattcccacatccctgccaaacaccatgcagcccccagacccctccgagtctacctccaaccatttcagaatagaaaacaggacgccgcagccccgctcctcgccaccatccgaggaccc

SEQ ID NO: 71092 - DNA, 601 bp, Human
accagtggctctgaagtctaggaagacggtcggagaagggcccccactgatggctgatgcagctgggacaggaacgcggaagatgtgtgccgatctggccgagacacagacacaggtaccacagccggccccggcagcatcaacacgaaacagcttctggggggcagccggtggcccctccaatctgtccccatcccagctctgactcacccaccgagggccatcagaccaaaagccagtaaccgctcgaatcctgaccctggccacggcgctcccaccccagcagtgtattcacaccgcragggatcgtgccagctgtgcatggccagcgtgggctcacacgaaagcagaggccaagccgtcccaggcaccgaggaaactatgacacagcacgtttctcctcgcaggcaggcgcacgtgtgaaaaccaccccagctccgtctctctcccactcaccccatcaacacagaatcttcatcactcaaggacccctgcggcccaagctggctgtgcggagcagccctgcgtctgctgaggtcccttcgcacctgggggaggggcgcgctgccagcctccccagcagccagcaccccccgagagg

SEQ ID NO: 71093 - DNA, 601 bp, Human
ccagcacagcaagggacctgctcctggtttttcagatgtcatcacactttcccacaggcttcccctcgatggcactgggcaccccctcagccccggccccaaacagcccattcaggggcctggccctgtgacagctccctgcccagctcctgggaaaagctccacgccagcacaagaaaggatggctaccccacattttgggatcctcagcagaggttggtgcctgaccccatggatggtcctcccgccccccaacagttcaacctccatgtgcccggctgagtcctcggcgatcagaaaygtgtggcagatgagacgcagcccccgctgctacacacacgagagcaggtcacaagcacgggaacttctcaggatgctcagtgggcctctccactggggccattgacagccctggcaggtccccaccagaccccgtggaaggtctggggcacccagtgtggatgggctgggctctcaggcaccctgtggacactgggctgacagatctgattaactgggagcctcggaaacatcgcagcagagcccggagcccagaggtgagtctgggaggtgggaccaagctcggagttgggcagaggaa

SEQ ID NO: 71094 - DNA, 601 bp, Human
taacatcaagtcagggccccttccacccaccagagcgcgtgtaaactctcctgtgtgcccgatacgtgagcgtggacgaaacgaagccccagcaccctcacacccgtcagacgtgctcacagcaccgccagaacaaccggcagcagggatctgttcgtgtcaacttggtgtctcgcctctcctgactctgatcctctctcagggggaacaacagacctgtgggcccaccaaggctgccccacgacggtggaatcactggttctgcctggaggcctcacagagaagcagccagtcccgagcrtggtgggtgccctccttcgcgtgttcaggagaatcctagaaatgagctgccgggccccgatgcgtggaggggctctgccacagcgtctcctgtatgagtgacaagtgccaccactttatgaccaaaaacaagctgaacactggacgaccgactggttcaggtggcttcttttgaataaagcttttcctttttttttttttttcaagatggagtctcgctctgttgcccaggctggagtgcggtggcgcaatcttgactcactgtgacctctgcctcccggattcaagcgattctcctgcc

SEQ ID NO: 71095 - DNA, 601 bp, Human
gacgttaaaaaagaaaacttcagaaagaccagacacactcaaaccccctatttcaaaataacatcaagtcagggccccttccacccaccagagcgcgtgtaaactctcctgtgtgcccgatacgtgagcgtggacgaaacgaagccccagcaccctcacacccgtcagacgtgctcacagcaccgccagaacaaccggcagcagggatctgttcgtgtcaacttggtgtctcgcctctcctgactctgatcctctctcagggggaacaacagacctgtgggcccaccaaggctgccccacracggtggaatcactggttctgcctggaggcctcacagagaagcagccagtcccgagcgtggtgggtgccctccttcgcgtgttcaggagaatcctagaaatgagctgccgggccccgatgcgtggaggggctctgccacagcgtctcctgtatgagtgacaagtgccaccactttatgaccaaaaacaagctgaacactggacgaccgactggttcaggtggcttcttttgaataaagcttttcctttttttttttttttcaagatggagtctcgctctgttgcccaggctggagtgcgg

SEQ ID NO: 71096 - DNA, 601 bp, Human
gagacgttaaaaaagaaaacttcagaaagaccagacacactcaaaccccctatttcaaaataacatcaagtcagggccccttccacccaccagagcgcgtgtaaactctcctgtgtgcccgatacgtgagcgtggacgaaacgaagccccagcaccctcacacccgtcagacgtgctcacagcaccgccagaacaaccggcagcagggatctgttcgtgtcaacttggtgtctcgcctctcctgactctgatcctctctcagggggaacaacagacctgtgggcccaccaaggctgccccrcgacggtggaatcactggttctgcctggaggcctcacagagaagcagccagtcccgagcgtggtgggtgccctccttcgcgtgttcaggagaatcctagaaatgagctgccgggccccgatgcgtggaggggctctgccacagcgtctcctgtatgagtgacaagtgccaccactttatgaccaaaaacaagctgaacactggacgaccgactggttcaggtggcttcttttgaataaagcttttcctttttttttttttttcaagatggagtctcgctctgttgcccaggctggagtgc

SEQ ID NO: 71097 - DNA, 601 bp, Human
tgaggaacaaacagaagaagccatctgggcccacgatgcggctgagctgccagtgcacctgggtccccacagccccaacagacacagggcggctccgtcttgcagtcggttgaatcttttcaaacttcccacagaagagacgttaaaaaagaaaacttcagaaagaccagacacactcaaaccccctatttcaaaataacatcaagtcagggccccttccacccaccagagcgcgtgtaaactctcctgtgtgcccgatacgtgagcgtggacgaaacgaagccccagcaccctcacacccgtcagacgtgctcacagcaccgccagaacaaccggcagcagggatctgttcgtgtcaacttggtgtctcgcctctcctgactctgatcctctctcagggggaacaacagacctgtgggcccaccaaggctgccccacgacggtggaatcactggttctgcctggaggcctcacagagaagcagccagtcccgagcgtggtgggtgccctccttcgcgtgttcaggagaatcctagaaatgagctgccgggccccgatgcgtggaggggctctgccacagcgtctcctgtatgagtgacaa

SEQ ID NO: 71098 - DNA, 601 bp, Human
caaaataaaattttaaatataatgtacaatgcaaactttatacacaaccatttaacaagggcaacaacacaatttcctgaccaggacaagacaccaggcctggcctgtctacacttgacacagcctcacgggattctttcaacaatcaaggttcgctgaggaacaaacagaagaagccatctgggcccacgatgcggctgagctgccagtgcacctgggtccccacagccccaacagacacagggcggctccgtcttgcagtcggttgaatcttttcaaacttcccacagaagagacgttmaaaaagaaaacttcagaaagaccagacacactcaaaccccctatttcaaaataacatcaagtcagggccccttccacccaccagagcgcgtgtaaactctcctgtgtgcccgatacgtgagcgtggacgaaacgaagccccagcaccctcacacccgtcagacgtgctcacagcaccgccagaacaaccggcagcagggatctgttcgtgtcaacttggtgtctcgcctctcctgactctgatcctctctcagggggaacaacagacctgtgggcccaccaaggctgccccacgacggtg

SEQ ID NO: 71099 - DNA, 601 bp, Human
ttcaggccgggcgcagtggctcacgcctgtaatcccggcactttgggaggccgaggcgggcggatcacaaggtcagaagatcgagaccatcctggctaacacggtgaaaccccgtctctactaaaactacaaaaaattagctgggcgtggtggcgggcgcctgtagtcccagctactcaggaggctgaggcaggagaatggcctgaacccaggaggtggaggttgcagtgagccgaaatcacgccactgcactccagcctgggcgacagagcaagactccatctcaaaaaaaaaaaaaaaagccaccttcagagaaaaaagatcgaaagacaagaacgggaacaaggcaacaaactaacaaacttaacagatggtttggacagagaaacctgaagatgtctcctagcatataacataaacaaagaaatggaaaatagagaagaaaattaaaggaccagcctgggagggccaacaaataatcagcgttaactctaaaagagagtcagagacggggagtcggccatgtgataaataactgggtgtaaagctcctcacatccaaatgtcgcaaggttccacagcacgagttcccagcacaagag

SEQ ID NO: 71100 - DNA, 601 bp, Human
actgtgcgattctgggaaatttcttgacctgtctgtgcctcagtgctaatctttacccagaacaaagaaaacaatggtgcccacaaggaactgagaagattaaatgagttcacacgcgggaagcctcgcagccatgaatgtgctgggtgctgctcaatcaccacatgataccgcggtgcttctcagccgggacgaataaccccagagaaaaagtgcgatatgcctttgacacaagggcagggcactctgccttaaaaaggcaccttcaggccgggcgcagtggctcacgcctgtaatcccrgcactttgggaggccgaggcgggcggatcacaaggtcagaagatcgagaccatcctggctaacacggtgaaaccccgtctctactaaaactacaaaaaattagctgggcgtggtggcgggcgcctgtagtcccagctactcaggaggctgaggcaggagaatggcctgaacccaggaggtggaggttgcagtgagccgaaatcacgccactgcactccagcctgggcgacagagcaagactccatctcaaaaaaaaaaaaaaaagccaccttcagagaaaaaagatcgaaagacaagaac

SEQ ID NO: 71101 - DNA, 601 bp, Human
tggggtttgagtcccagctcaaactgtgcgattctgggaaatttcttgacctgtctgtgcctcagtgctaatctttacccagaacaaagaaaacaatggtgcccacaaggaactgagaagattaaatgagttcacacgcgggaagcctcgcagccatgaatgtgctgggtgctgctcaatcaccacatgataccgcggtgcttctcagccgggacgaataaccccagagaaaaagtgcgatatgcctttgacacaagggcagggcactctgccttaaaaaggcaccttcaggccgggcgcrgtggctcacgcctgtaatcccggcactttgggaggccgaggcgggcggatcacaaggtcagaagatcgagaccatcctggctaacacggtgaaaccccgtctctactaaaactacaaaaaattagctgggcgtggtggcgggcgcctgtagtcccagctactcaggaggctgaggcaggagaatggcctgaacccaggaggtggaggttgcagtgagccgaaatcacgccactgcactccagcctgggcgacagagcaagactccatctcaaaaaaaaaaaaaaaagccaccttcagaga

SEQ ID NO: 71102 - DNA, 601 bp, Human
agcccttggggtttgagtcccagctcaaactgtgcgattctgggaaatttcttgacctgtctgtgcctcagtgctaatctttacccagaacaaagaaaacaatggtgcccacaaggaactgagaagattaaatgagttcacacgcgggaagcctcgcagccatgaatgtgctgggtgctgctcaatcaccacatgataccgcggtgcttctcagccgggacgaataaccccagagaaaaagtgcgatatgcctttgacacaagggcagggcactctgccttaaaaaggcaccttcaggccrggcgcagtggctcacgcctgtaatcccggcactttgggaggccgaggcgggcggatcacaaggtcagaagatcgagaccatcctggctaacacggtgaaaccccgtctctactaaaactacaaaaaattagctgggcgtggtggcgggcgcctgtagtcccagctactcaggaggctgaggcaggagaatggcctgaacccaggaggtggaggttgcagtgagccgaaatcacgccactgcactccagcctgggcgacagagcaagactccatctcaaaaaaaaaaaaaaaagccacctt

SEQ ID NO: 71103 - DNA, 601 bp, Human
gagccaagccttttaccatcacgctcacttatgagggtccgggacacggtggacagcgttgtggccgaggtcacgtggctggtgggcagcagagctggggcctgaccacgcagcttcaggccctggggcacgcggcaaatagcgtgggcttaagcccagcccttggggtttgagtcccagctcaaactgtgcgattctgggaaatttcttgacctgtctgtgcctcagtgctaatctttacccagaacaaagaaaacaatggtgcccacaaggaactgagaagattaaatgagttcacacrcgggaagcctcgcagccatgaatgtgctgggtgctgctcaatcaccacatgataccgcggtgcttctcagccgggacgaataaccccagagaaaaagtgcgatatgcctttgacacaagggcagggcactctgccttaaaaaggcaccttcaggccgggcgcagtggctcacgcctgtaatcccggcactttgggaggccgaggcgggcggatcacaaggtcagaagatcgagaccatcctggctaacacggtgaaaccccgtctctactaaaactacaaaaaattagctgggcgtggtg

SEQ ID NO: 71104 - DNA, 601 bp, Human
accagctctgtggtgccccacgagtcaatgtgggcagacaaatgcgggtcaccaggggcccaggaagccgcaaaggccaggacaaacacaaaaagggactctcggtgaaaacagctgagtacgaggccaaagaaaacaccaaaaggagacgttatcaccaaccgctgccagcacacatgctcccaccatgtgccgccatcagcagcagccgcggggccagcgttgtggcttagttactggctaatcccatgatagccttgggagccaagccttttaccatcacgctcacttatgagggtcygggacacggtggacagcgttgtggccgaggtcacgtggctggtgggcagcagagctggggcctgaccacgcagcttcaggccctggggcacgcggcaaatagcgtgggcttaagcccagcccttggggtttgagtcccagctcaaactgtgcgattctgggaaatttcttgacctgtctgtgcctcagtgctaatctttacccagaacaaagaaaacaatggtgcccacaaggaactgagaagattaaatgagttcacacgcgggaagcctcgcagccatgaatgtgctgggtgctgctc

SEQ ID NO: 71105 - DNA, 601 bp, Human
agcaaagaggaggacaggccgggtagtggatgccctgggacctggaaggcagagggccccgtggccaccaggagactgtactgggccgaaccccaaagaagggccccaagtcagaggctccaggtagcaggaaagtggggcacctgctgtgcagggtcccagtcagtgaggagtcgacccccagacccccttcctcacccaaagcagccagggaacgagagggcttgctggggcagcagactccttactaggggtgagacgcccggccctcccaggcaggacactcccctggggacttccrccaccaccagctctgtggtgccccacgagtcaatgtgggcagacaaatgcgggtcaccaggggcccaggaagccgcaaaggccaggacaaacacaaaaagggactctcggtgaaaacagctgagtacgaggccaaagaaaacaccaaaaggagacgttatcaccaaccgctgccagcacacatgctcccaccatgtgccgccatcagcagcagccgcggggccagcgttgtggcttagttactggctaatcccatgatagccttgggagccaagccttttaccatcacgctcacttatga

SEQ ID NO: 71106 - DNA, 601 bp, Human
gagcaataagtaagcgacacggtatccgattctaacccaagtatgaaattgacacctgcgagtccacatgaacagaaaggaataattaaataaccaatgggagaacagacgtacaagtcccgtgcaaaacttgacatcacgtatgtagctcctcacctcttaggtgtgggccacgcacgcctcactccgcagacaggacagcacgggggaagaggcacgggcaggtgtgagccgacaaacacaccgcggccaggtgacacgcaaggccagcacggacaggctgcgtggagggtgtggaccyggacccagcgatataaggaggcttcacctcctcccaaaacacaaggccccagtccttatgagaaaaacatgaggcaaaccccagcgaagggctgtcccacaaaacacctgaccagccctccttaaaactacgaaggtcgttgaaaatgaggcaagtctgagagacctgccacagtgagagggacctaaggagacgtgacggccaagtgccacgtggggccctggacgggatcctgggacagaaagggggcaggaggggagactgaggcaagcggaataaagccttagctggaaaggtgcc

SEQ ID NO: 71107 - DNA, 601 bp, Human
gtgcaagctatgaccataatccgaagcggacagcacctgccttcttcacactcgccctcatgagcgtggggggaattttccactgcgcttaggaagacctgcagaacccagtggagcaatatttcctaacagccaatatgcgatgttttttgttgttgctgtttgagacagagtttcgctctctcgcccaggctggagtgcagtggtgcaatcttggctcaccgcaacctccgcctcccaggtccaagtgattctcgtgcctcagcctcccgagtagctaggattaattacaggcatccgycaccatgcatgcccggctaatttttgtatttttagtagagatggggtttcatcacattggccaggctggtctcgaactcctgacctcaagtgatctgcccacttcggtctcccaaagtgctgggactacaggcgtgagccaccgcgcccggccaacatacgatttttaaaacacacgcacgcgtaagaaacctattcgagcgcaaaagagaccagcggatttttaaggtaactgcaggaaagtgacaccaatacagtttcagattccatgtttcaactgacatgtaagaaatgaccacgt

SEQ ID NO: 71108 - DNA, 601 bp, Human
tttgccatgttgcccaggctggtcttgaaaactcctgagctcaggcgatccacccggctaggcctcccgaagtgctgggatgacaggcgtgagccactgcgcccagctgaccccacatctgacctccacttgctgacaaggtgctgccacacagacccgatgctgggcaggcaggtggctggcactgacagctggtgggtgcagaacgcctccatgccccactcacccccatccacagtccaggcagagaccagggcagggtgagcacacaggaccgcaggcgggtgggccggacgcaggkacgcccatctgtgagccggccggccgcgcatgtgttctgccatatggtgaagcggcgggaactggctgaggccagggaggtctggggatgcctgggggtcccagagaccaggcaggggagccgcgagtgcaagctatgaccataatccgaagcggacagcacctgccttcttcacactcgccctcatgagcgtggggggaattttccactgcgcttaggaagacctgcagaacccagtggagcaatatttcctaacagccaatatgcgatgttttttgttgttgctgtttgagacagagt

SEQ ID NO: 71109 - DNA, 601 bp, Human
gtcatgttggggtgggagcagcctgtcgggcttctgtgcctgacctgcatctttttttttttctttttttaagagggtctcactctgtcacccaggctggagtgaagtggcacaatctcagctcactgcagcctcgaactcctgggctcaggcgatcctcccacctcagccttcccgaggagctggaacgacaggtgtgcaccactacaccaggctaatttttacatttttttgtagagatggggttttgccatgttgcccaggctggtcttgaaaactcctgagctcaggcgatccaccyggctaggcctcccgaagtgctgggatgacaggcgtgagccactgcgcccagctgaccccacatctgacctccacttgctgacaaggtgctgccacacagacccgatgctgggcaggcaggtggctggcactgacagctggtgggtgcagaacgcctccatgccccactcacccccatccacagtccaggcagagaccagggcagggtgagcacacaggaccgcaggcgggtgggccggacgcagggacgcccatctgtgagccggccggccgcgcatgtgttctgccatatggtgaagcg

SEQ ID NO: 71110 - DNA, 601 bp, Human
agctcttactcctgggatgatgccaacccagacaggagaagggagcgagagaaagagagaagtgcctctctgcatcaacacagtaagaccggggcctcccaaacccacccatgggtgcagacctgcctgtgagaggggagccgggcccgggccccccatatcctcagcccctccagcacggtgcctcacgggctctgagaacagggccccccgacgtcctcagcccctccagcacggtgcctcaagggctctgagaacagggccccccgacgtcctcagcccctccagcacggtacctcaygggctctgagaacagggccccccgacgtcctcagcccctccagcacggtgcctcacgggctctgagaacagggccccccgacgtcctcagcccctccagcacggtgcctcacgggctctgagaacagggccccccgacgtcctcagcccctccagcacggtgcctcacgggctctgagaacagggccccccatatcctcagcccctccagcgtggcgctgcatgggctctgagcaggcatcttcagaggacaagagttgtgaaaaacgcaaccaacaaatgtgaggtttggcaaaaagca

SEQ ID NO: 71111 - DNA, 601 bp, Human
atccttgagttcacattaggatcaagattcctttcaacagggaggggagaagacacagctcttactcctgggatgatgccaacccagacaggagaagggagcgagagaaagagagaagtgcctctctgcatcaacacagtaagaccggggcctcccaaacccacccatgggtgcagacctgcctgtgagaggggagccgggcccgggccccccatatcctcagcccctccagcacggtgcctcacgggctctgagaacagggccccccgacgtcctcagcccctccagcacggtgcctcamgggctctgagaacagggccccccgacgtcctcagcccctccagcacggtacctcacgggctctgagaacagggccccccgacgtcctcagcccctccagcacggtgcctcacgggctctgagaacagggccccccgacgtcctcagcccctccagcacggtgcctcacgggctctgagaacagggccccccgacgtcctcagcccctccagcacggtgcctcacgggctctgagaacagggccccccatatcctcagcccctccagcgtggcgctgcatgggctctgagcaggcatcttc

SEQ ID NO: 71112 - DNA, 601 bp, Human
aacctgggaggcagaggttgcagtgagccaagattgcaccactgcattccagcctgggcgacagagcaagactccgtctcaatttaaaaaaaaaaaaaaaaaaggatgataataaacccagtttttagaaaatccttgagttcacattaggatcaagattcctttcaacagggaggggagaagacacagctcttactcctgggatgatgccaacccagacaggagaagggagcgagagaaagagagaagtgcctctctgcatcaacacagtaagaccggggcctcccaaacccacccatgrgtgcagacctgcctgtgagaggggagccgggcccgggccccccatatcctcagcccctccagcacggtgcctcacgggctctgagaacagggccccccgacgtcctcagcccctccagcacggtgcctcaagggctctgagaacagggccccccgacgtcctcagcccctccagcacggtacctcacgggctctgagaacagggccccccgacgtcctcagcccctccagcacggtgcctcacgggctctgagaacagggccccccgacgtcctcagcccctccagcacggtgcctcacg

SEQ ID NO: 71113 - DNA, 601 bp, Human
cctggcacctcgggatgccatccacaggtgctggtgcagctctctgcgtggtggggctgcactgccagctgttgccacggtgagccgtggcgcctcaccacccaaaggtaagtaaaataaacaagaatgggggccgggcgcaacagctcacacctataatctcagcactttgggaggccgaggtgggtggatcccttgaggtcaggagttcgagaccagcctggccaacatggtgacaccccgtctctactaaaaacacaaaaattagctgggtgtggtggtgggtgcctgtaatcccagytactcaggaggctgaggtgcgagaatcaattgaacccgggaggcagtggttacagtgagctgagatcgcgccactgcactccagcctgggtgacagagcaagattctgtctcaaaaaaaataaataaaagaatggggaaatacactaaaatcaaatgcaaacagaaacaaataaagccaactgaccatcatactgacagcataaccccacgaaagacaacaaatgaataaacgaatccaagttaacttctggaaactgctctccaagggcatgggcatggcaggaggcattctgaggaca

SEQ ID NO: 71114 - DNA, 601 bp, Human
cacttcagagcaaaaccacctgttattcatttactctcttcacgtctttctgctggcatcgcacacatattactcgggtatcctgctatacttctctcggtaatcacatccaggtgatgggatacaacccaattaatgcaaaaataagagcatcattaaaaacccttgggagcgaaggttgtaggagagacacagaagccccagggttcgcctggcacctcgggatgccatccacaggtgctggtgcagctctctgcgtggtggggctgcactgccagctgttgccacggtgagccgtggmgcctcaccacccaaaggtaagtaaaataaacaagaatgggggccgggcgcaacagctcacacctataatctcagcactttgggaggccgaggtgggtggatcccttgaggtcaggagttcgagaccagcctggccaacatggtgacaccccgtctctactaaaaacacaaaaattagctgggtgtggtggtgggtgcctgtaatcccagttactcaggaggctgaggtgcgagaatcaattgaacccgggaggcagtggttacagtgagctgagatcgcgccactgcactccagcctggg

SEQ ID NO: 71115 - DNA, 601 bp, Human
tcgaagccaggcctccccgggtgcaggcagtgacctgcctggctcccgagggcctggatgctgcccccggtgcccggacaggccagacgctggtcctcctcaggggcctccggggactcctttccagagtcgggcattttctgttagtgggtacccggttaggggagcaggaaggttttaacctcccccgccacccccaccaaaaggtcacttcagagcaaaaccacctgttattcatttactctcttcacgtctttctgctggcatcgcacacatattactcgggtatcctgctatactyctctcggtaatcacatccaggtgatgggatacaacccaattaatgcaaaaataagagcatcattaaaaacccttgggagcgaaggttgtaggagagacacagaagccccagggttcgcctggcacctcgggatgccatccacaggtgctggtgcagctctctgcgtggtggggctgcactgccagctgttgccacggtgagccgtggcgcctcaccacccaaaggtaagtaaaataaacaagaatgggggccgggcgcaacagctcacacctataatctcagcactttgggaggccgagg

SEQ ID NO: 71116 - DNA, 601 bp, Human
ggggcagagctgtgcctcttctcaggtgtgctgggcgttatccagatgagggaggcggagtctgggccaggtaggtgaggacactgctgagtggcctccttaaagttacacgagtgggaaactgtaaaaccaaaaccccaactcaggcagcatccgagcccgaggcccccacccacacagcagagaaagccgctattcaggatgggctctgccgccatcaaaacaaagaccgtcttcactgagtgtccaggcggccagcacgcgccaggcaccagcagcctgtccctcacgccgtcccagygttcccagcctcgaagccaggcctccccgggtgcaggcagtgacctgcctggctcccgagggcctggatgctgcccccggtgcccggacaggccagacgctggtcctcctcaggggcctccggggactcctttccagagtcgggcattttctgttagtgggtacccggttaggggagcaggaaggttttaacctcccccgccacccccaccaaaaggtcacttcagagcaaaaccacctgttattcatttactctcttcacgtctttctgctggcatcgcacacatattactcgggtatc

SEQ ID NO: 71117 - DNA, 601 bp, Human
ccggaagccgctctgggcgtgggatggagaggctgagtcacgcggcaatcactcgccacagccgtcttcactcaaggactcgaggacgttcagcaaatgtccagggagccctgctgggtcccaggcaccattttcagccctaaggatgcaaccagggccaaagctgagggatttggttcccaggaagcccacgatggaaaggggcagcctccgagctgagactgcaggggaggaacagggaggcggagggaggggcgtgcagaccccatggggcgcaccatccaggcaagggggagggagsagtgaggaggacgagggacagacgggggcagagctgtgcctcttctcaggtgtgctgggcgttatccagatgagggaggcggagtctgggccaggtaggtgaggacactgctgagtggcctccttaaagttacacgagtgggaaactgtaaaaccaaaaccccaactcaggcagcatccgagcccgaggcccccacccacacagcagagaaagccgctattcaggatgggctctgccgccatcaaaacaaagaccgtcttcactgagtgtccaggcggccagcacgcgccaggcaccagc

SEQ ID NO: 71118 - DNA, 601 bp, Human
ggaaccagccctgccgaaacccagctctcggacgctggtctccagacagagaataaagctttttgtttggattttttttaatgggatctcgctatgttgccctggctacattcaaactcctgcactcaagtggtcctcccaccgcagcctccggagtagctgggatcaccacacaagctgagagagaattgagttctgccgtgtgagccgccatctgtggtacgttgctacagcggccccagcactgtgacctgagtgtttacgtcccaccgaattcacacgctgaaatcctcacccacargcgacggtgtcaggaggcctttgagaggtggtaaggttgtggccttccggaatgggattaatagtgcttttcaaagggaccccagagtgtttgttcgtcccctttatcacgtgaagaagactctgagaaggctctggctgtgaaccagtccttaccaggcaccaaatctgctggtaccttgcctggacttccccgccttcagcatctcgagcaatcagggtccttgtttacaggccacccctcgtggtgcctcctcacagaggctgaagcaaatgaacgcagaccccgacggaccagaga

SEQ ID NO: 71119 - DNA, 601 bp, Human
tcctacatgtgcacggggcctccttggagaagcactggtgtttcttcaaaaccagcccagggtgggctctgaccccagggaccggggcagactttaggggccttaagctcctggaaggagcagctgagggtgagggggctgggggggcatcccctcagtggtgagacggccagcaccatcctgtggggacacagggcacgggccctggcagtgctgagcccacgcccctcggtcagcagggccctctgaacaggtgctccctgacggctacaaaaccatgggtgcacgggccccttctgcrggagggctgggtgcagctgactacaaggactgcagaccggccaggccatgggaaccccttgccaaggtgcagcccccagggcctctgcatgagtgcaactgaatcccctcggaatccaagctgccgtcctgacccccaggagctcagaacatgcccttatttacacataggacactgcagatgtaatcagttaagtgagtgaggtcattacagcagacttagatccaaaacaactgctgttctcataacagagggtaacgtggacacggccgcacggggaggaagggcccgggtgaagaa

SEQ ID NO: 71120 - DNA, 601 bp, Human
acagtgggccacagctctctgacctctttattaaagcacatctatatgatggtacatgtggcagtttgaaaagatgatatttaagacgtgtgttcaataatctgcttagatcataatgtcaagaaaactgaggtcctacaaattccacagggagagctaaattaatatggataaaccatttgtttggaaaaaagtctgaaaataagtaaaccaaatgttaaaaccaaaaacccacaaccaggatccatggcctcccagattgtggggtcccccctgcactggctctctccgagacgccccyggctgccgctcccagggcgcccacgccaggtgccatgagcaaaaccacacacgcagcgcaggaggggcacgcggctgtgggaggacgagggcttcattcctacatgtgcacggggcctccttggagaagcactggtgtttcttcaaaaccagcccagggtgggctctgaccccagggaccggggcagactttaggggccttaagctcctggaaggagcagctgagggtgagggggctgggggggcatcccctcagtggtgagacggccagcaccatcctgtggggacacagggcacgggc

SEQ ID NO: 71121 - DNA, 601 bp, Human
actctgcggccgcacgggtggcagcaaggacagattcgtccaccggctcctggggacacggccattcttgcaagtaccaagcactgtctggcacgacgctttccattctacatgagtcttctccttaaataatttttataaagattttataaagatttggaagataccaaagaaagtaaaagaaaaagaaacaattgcccacaactccgtggccccaacacaggacgcgcatctgtcctcccgcctggggtcagggccctcggacgccccctgctgctcccacctggtaatcggtgggtcygcatggaacaagtgggatcagttcacacggtgcgtgcaggtcaaccaccccacaggacaacgcaaccacagaaacgaggaactcaattacaaaacgggcaaaggacctgtgcagacgtttctccaaagccgacacacaagcggccacaggcgtgagaggctcaacatcaccaaccaccgggagaggcaaactagacccacactgggcactgcctcgccccaagaggacggccaggaacagaaagtcgggagtgtcagcgaggacggcgagacatcgtaactcctgtgtgctgcaggtggg

SEQ ID NO: 71122 - DNA, 601 bp, Human
cgggaacgccgggctccgtcctgctgagctggggcttctcttgggcagggtttccctacaaagcagcaggggctgccctcctcttcacacagagggggcagggttcccggcctcctcctctcatcaaggattcgcctcccgtaggaaaacagggggagggcggcgggggtgaggggacaaagccctgggaaggggctggatggacggggccggagccaagggggcggctggcatggccggagtatctaggggagaagcgcgatgcctgccggtccctcctgtctcactctgcggccgcacrggtggcagcaaggacagattcgtccaccggctcctggggacacggccattcttgcaagtaccaagcactgtctggcacgacgctttccattctacatgagtcttctccttaaataatttttataaagattttataaagatttggaagataccaaagaaagtaaaagaaaaagaaacaattgcccacaactccgtggccccaacacaggacgcgcatctgtcctcccgcctggggtcagggccctcggacgccccctgctgctcccacctggtaatcggtgggtccgcatggaacaagtgg

SEQ ID NO: 71123 - DNA, 601 bp, Human
caacgctgacagccgcggacctccacgtcgacgcggggatcctcggctcgtcccgtgcccgccaaggcaggctgtgcccgatgcagctccaagcacaggcggggcaggccgcagggaggaggcaccgtacacagcacgtcctctgtgaggccctggggttcctctgggcccttccaagggcctcccccatctcagcccaccacgtttgggggcagaggcggggctgaagtcccaacttagagggtacaggtcccagcggccccgcaccaacagccacccggacaccctcacctttgaggarggcaccagccactgcagcgagcagtgactgtcaccaggaccttttccagggagactggctgagcagcttccagtcccacatcaaggagacccccaccctgcctttcgccttccagagaagtggacactgggggctggaccaggccagagccaagtcacagcgtcccagagtccccgcacgaagcagggtcaggcagaaaaaggcaagcaccccactccacaccccggcggtctgacctgccccagggcggccagaggacactagccgcccgccaagagcaaggctggggccagggggtga

SEQ ID NO: 71124 - DNA, 601 bp, Human
tggaagtgggggggctgctcccgggacgggggagggatggcgacggagggctctgaggttgtgcatcaggcagaaggttctagagacaagcaggttcccaagggatgtggctgcgctaggacaggacaaacaggagggtcacccaaagtgggctggcaggtgctgtggacgtgccgcagggagcagacacacgtgtcaggcagcacttcctccacccgggcctggagctgctggcctggctccctctgccctggccccacactcagcccttagtgcccggccgagggctgcaacgctgacrgccgcggacctccacgtcgacgcggggatcctcggctcgtcccgtgcccgccaaggcaggctgtgcccgatgcagctccaagcacaggcggggcaggccgcagggaggaggcaccgtacacagcacgtcctctgtgaggccctggggttcctctgggcccttccaagggcctcccccatctcagcccaccacgtttgggggcagaggcggggctgaagtcccaacttagagggtacaggtcccagcggccccgcaccaacagccacccggacaccctcacctttgaggaaggcaccagcc

SEQ ID NO: 71125 - DNA, 601 bp, Human
gcacagcgggcgcctcagaacgggcagcgcccaaggttcaacgagccgggcacagcgggcgcctcagaacgggcagcgcccaaggttcaacgagccgggcacagcgggcgcctcagaacgggcagcgcccaaggttcaacgagccgggcacagcgggcgcctcagaacgggcagcgcccaaggttcatcgagccgggcacagagggcgcctcagaacgggcagcgcccaaggttcaacgagccgggcacagagggcgcctcagaacgggcagcgcccaaggttcaacgagccgggcacagygggtgcctcagaacgggcagcgcccaaggttcaacgagccgggcacagcgggcgcctcagaatgggcagtgcccaaggttcaacgagccggggccactgcctccgccactgcccacgggcaccacacagcatcccaggcaccatcatggtaggagaagagttcaggccgggaggccgagggtaccctcgggtcaccaggcttggcacagcaggactggaaccacgtcccttccagctcccgtccaagacaggtggaagtgggggggctgctcccgggacgggggagggatggcgacggag

SEQ ID NO: 71126 - DNA, 601 bp, Human
tttttataggcaggagagagagggccaaaaccaggctctaagagaagtgactctgcagctccagaaatgaatccaaggccaaaagagccagcagagaagccagacggtaagggccacagcagacgcctcagaacgggcagcgcccaaggttcaacgagccgggcacagcgggcgcctcagaacgggcagcgcccaaggttcaacgagccgggcacagcgggcgcctcagaacgggcagcgcccaaggttcaacgagccgggcacagcgggcgcctcagaacgggcagcgcccaaggttcawcgagccgggcacagcgggcgcctcagaacgggcagcgcccaaggttcatcgagccgggcacagagggcgcctcagaacgggcagcgcccaaggttcaacgagccgggcacagagggcgcctcagaacgggcagcgcccaaggttcaacgagccgggcacagcgggtgcctcagaacgggcagcgcccaaggttcaacgagccgggcacagcgggcgcctcagaatgggcagtgcccaaggttcaacgagccggggccactgcctccgccactgcccacgggcaccacacagcatcccagg

SEQ ID NO: 71127 - DNA, 601 bp, Human
gaactggcatggagcagggaatccagggcagggctttttataggcaggagagagagggccaaaaccaggctctaagagaagtgactctgcagctccagaaatgaatccaaggccaaaagagccagcagagaagccagacggtaagggccacagcagacgcctcagaacgggcagcgcccaaggttcaacgagccgggcacagcgggcgcctcagaacgggcagcgcccaaggttcaacgagccgggcacagcgggcgcctcagaacgggcagcgcccaaggttcaacgagccgggcacagygggcgcctcagaacgggcagcgcccaaggttcaacgagccgggcacagcgggcgcctcagaacgggcagcgcccaaggttcatcgagccgggcacagagggcgcctcagaacgggcagcgcccaaggttcaacgagccgggcacagagggcgcctcagaacgggcagcgcccaaggttcaacgagccgggcacagcgggtgcctcagaacgggcagcgcccaaggttcaacgagccgggcacagcgggcgcctcagaatgggcagtgcccaaggttcaacgagccggggccactgcctcc

SEQ ID NO: 71128 - DNA, 601 bp, Human
cgcagacctagaagggtctggaaaggagacaaccagactccaccctgggtaccagaagcacaggtgccccagggagacggcatatctgggacccagtggtgatgttgcttggactcccaggggaccagcaaacccagctgcccaaaccaccaccctgctacggggcctggggtgtggcggagcagcacatggggggctggggtgacagtcagtgtctgcatcacccacaggcatcactcgggcaccagtgtccgtgtcgtgccggcgggggcagggagagaactggcatggagcagggaayccagggcagggctttttataggcaggagagagagggccaaaaccaggctctaagagaagtgactctgcagctccagaaatgaatccaaggccaaaagagccagcagagaagccagacggtaagggccacagcagacgcctcagaacgggcagcgcccaaggttcaacgagccgggcacagcgggcgcctcagaacgggcagcgcccaaggttcaacgagccgggcacagcgggcgcctcagaacgggcagcgcccaaggttcaacgagccgggcacagcgggcgcctcagaacgggcagc

SEQ ID NO: 71129 - DNA, 601 bp, Human
catcctgagtcacctgttctgtaaccatccttcccgtcaaactattcaccccgccactccggctcgtactgctactctctttaaaatagccaatcggaattagcttagactgtgcggtccaaccctagccaacaggggaaccacacagcagcagggactggctgcgttaggatgagacctccacctccctcgttcaggtgtgctctcgccattgctccatctgcaagacgcacccttctatagaagtaaaattgccttgctgagaaaattaaatttatgttcgagtgctatttcttttgcrgcacccaaaatttatttctaacatcccaagtcctgggccactgtccccaggagcctgggcccccctggcacgggccccaccaggagcacggtgcgaggcgtgccttccggggtgcatgggctgggggtgcacacaacatggggctctacagctgggtgcgaggcgtgccttccggggtgcatgggctgagggacgcacacaacacggggctccaggagaagtggtttgaaaggtttgaaagcctacgccagtcactggctcaccgggtccaagggcaggtaaggaatgccttcaggttga

SEQ ID NO: 71130 - DNA, 601 bp, Human
gctttagcacgacacggactaatgacctgtttaattggaacgggaaataggtcacacccaggcctcactaactccttaaagagtcatgaaatgtgcaactaacatggccaggggctcccgaggggccctcacccgaccctcacctccacgctgccccgtccagtgagctcccctctgtcaatgcctgggcaccacccacacctacagccacagcctgtgccgtgcccccggctgcccacagggtccttgctgccccctccctccgggtacagtcctgtgagcctcatctggaagtcactcytccccacggccttccccaccccgccccgcccactgcttctgaaggggctccttcctggcagccgcctgtgtccatcacaccctggaactgtcaatcattggtctgcacagtgagcccgctttgctttcactggtccgcccattagcaaggggcggttccggattgtgcctctggcagccgcccagcctggcatgggatgaatgaatgaatgaatgacagggctccagctgggaaaaggtctcagacgtcacactgaggaggatcctagcgccagctgcatcgcactgaaaattcccattt

SEQ ID NO: 71131 - DNA, 601 bp, Human
ttacccacccatccatcctgggcaggacacagggctgaactggtgtggaggtcggggcagggccaggcaggcaccaggggctgcctacccgctctggcatgtggctgctcctgatcctggcccccagtatggaagtcaccttctccacctgctactgggtaggagcggtgaccggggaaaggagacaggggatggaaattggacaatttttccaaagccccacctgcaatccttcctcgtgaaaaggccccaggacccccagaagacacagtcctctgtgacattcctgacttgtcattascatgcctggttcctatcacatatctgctacatatctgttataaatccaccacgcccgctgtatccattatatacccaccacgtatctctgccgtgtatccttgcgtgtctactgtgcgtctcgatcacgcatccactacgcctctgccacacatctttgctgtggagcactgtgtctactcagtacctgctgctaagtacctgctaagtatcagatgcggtccagacccaggatgcacgggctcatgtcatcttcgcaaacccccaggggaggtgctctcccaccctcattctccaggaa

SEQ ID NO: 71132 - DNA, 601 bp, Human
cggtggctcacacctgtaatcctagcactttgggaggccaaggcgggcggatcacgaggtcaggagatcgagaccatcccggctaacacagtgaaaccccatctctactaaaaatacaaaaaattagcgggacgtggtggtgggcgcctgtactcccagctactcgggaggctgaggcaggagaatggtgtgaacttgggagacggggcttgcagtgagccaagattgcaccactgcactccagcctgggcagcacagtgagacttcatctcaaaaacaaaacaaaacaaaacaaacaaacaaaaaaaacgcaataaaaaacgtgtactaggcttcacaaagcccacacgagaccctggaaatgaatgaatcaataaattacccacccatccatcctgggcaggacacagggctgaactggtgtggaggtcggggcagggccaggcaggcaccaggggctgcctacccgctctggcatgtggctgctcctgatcctggcccccagtatggaagtcaccttctccacctgctactgggtaggagcggtgaccggggaaaggagacaggggatggaaattggacaatttttccaaagccccac

SEQ ID NO: 71133 - DNA, 601 bp, Human
caaagggtaaggcccctccagcccctaggtttctgggccctgtgtctcctggttctgaaccaatccgtgacgcaggagagttgggggttgggggaggagacttgcatttttagatctctttctacaaagttgaaataaagtggagaaaaaaatacacgaagtttctagaaatctatcattactcataacaaagtaaaacaaacaaaaacgagggccgggcacggtggctcacacctgtaatcctagcactttgggaggccaaggcgggcggatcacgaggtcaggagatcgagaccatccyggctaacacagtgaaaccccatctctactaaaaatacaaaaaattagcgggacgtggtggtgggcgcctgtactcccagctactcgggaggctgaggcaggagaatggtgtgaacttgggagacggggcttgcagtgagccaagattgcaccactgcactccagcctgggcagcacagtgagacttcatctcaaaaacaaaacaaaacaaaacaaacaaacaaaaaaaacgcaataaaaaacgtgtactaggcttcacaaagcccacacgagaccctggaaatgaatgaatcaataaatt

SEQ ID NO: 71134 - DNA, 601 bp, Human
cctcccgcccacatcccagtgaggtgatgagggccctggggaaagttcaaaccctgcaagcctcagcccctgctcaccccgccttgccccagagccgccacggaaaccgagacagtctccttacaggcgcgctcaagacctttctggaccatcctggaagacccccctcccctgctctccccagaaaacctcattatgtggtgagaagctccctcccgtctgcgtgcggtgctgtcatctgtgtggacacctgagccaaatgttgggcaggggtccatcccatctcttcagggtgaccagygattacaagtgaacagctggcgtccaggccaggaggtgtttaaacgggggcgcgttgcccttcacccctctcctcccactgccgcctcaggtgcagcccccagagaccacagcagcttgtggagaggggagcggccagcactcacccgccgccccagaggcccttccttcccatctactttgctatccctgttttcccttctagacagtcctctctctctttctctgttgcccaggccagagtgcagtgttgcaatcatagccctgcagcctcgacctcctgggctcaagcgatcctccc

SEQ ID NO: 71135 - DNA, 601 bp, Human
ccattcgagccactggatgcctctggggctcccctgtctgtcccctcactcctctagaacacatacccctcgcagaccgatgctgctgtactggcccctgaactggacacagaggccctgaggttcaggccaccttcttcccctgcagctctggggcaagcactggcgtctatccaaccaccagccgtaaccttccctcagcccgtggggctaggagtccaggcttcagccaaagaaatcgcaaccaagagttggaccccctttttgatgttcgactgctggaggtgtttgagacgacccrctcccctcccgcccacatcccagtgaggtgatgagggccctggggaaagttcaaaccctgcaagcctcagcccctgctcaccccgccttgccccagagccgccacggaaaccgagacagtctccttacaggcgcgctcaagacctttctggaccatcctggaagacccccctcccctgctctccccagaaaacctcattatgtggtgagaagctccctcccgtctgcgtgcggtgctgtcatctgtgtggacacctgagccaaatgttgggcaggggtccatcccatctcttcagggtga

SEQ ID NO: 71136 - DNA, 601 bp, Human
acactggcttcccctggatgctccctgcctgggctccaccccagggcctcatcgcggccatcccctgccacctgggattgtcccctcccagcctcccctcttagggcccttcccaccattcgagccactggatgcctctggggctcccctgtctgtcccctcactcctctagaacacatacccctcgcagaccgatgctgctgtactggcccctgaactggacacagaggccctgaggttcaggccaccttcttcccctgcagctctggggcaagcactggcgtctatccaaccaccagcygtaaccttccctcagcccgtggggctaggagtccaggcttcagccaaagaaatcgcaaccaagagttggaccccctttttgatgttcgactgctggaggtgtttgagacgacccgctcccctcccgcccacatcccagtgaggtgatgagggccctggggaaagttcaaaccctgcaagcctcagcccctgctcaccccgccttgccccagagccgccacggaaaccgagacagtctccttacaggcgcgctcaagacctttctggaccatcctggaagacccccctcccctgctctccc

SEQ ID NO: 71137 - DNA, 601 bp, Human
accgcaacacccggtgaggaagcgccctccaactctccctttcgtgctcggccccggggggcagcagtgagccccgcaggccagcccgctgcgtcctgcctgtctggcaccgagcgatgttctgaccacccctcgccagggcaggcccagcctccctctctcctcccagtccccacccacactggcttcccctggatgctccctgcctgggctccaccccagggcctcatcgcggccatcccctgccacctgggattgtcccctcccagcctcccctcttagggcccttcccaccattcgmgccactggatgcctctggggctcccctgtctgtcccctcactcctctagaacacatacccctcgcagaccgatgctgctgtactggcccctgaactggacacagaggccctgaggttcaggccaccttcttcccctgcagctctggggcaagcactggcgtctatccaaccaccagccgtaaccttccctcagcccgtggggctaggagtccaggcttcagccaaagaaatcgcaaccaagagttggaccccctttttgatgttcgactgctggaggtgtttgagacgacccgctcccct

SEQ ID NO: 71138 - DNA, 601 bp, Human
ggatgggaaattgcttcatggcacgacagacgtgtgctgtgataaggggttactcgttctcaacaatgttggctatgcaagcgtccttgagaagtctgaactcacaggggagctgtcacagatcaaggtcaacaagccagggtggctgtcggggtgaggccggccgcgccctcctgaataaaaggcctgggtgctgtgtaatgaggtgtgaagaataaaggctactcaccctgaaaactgctcttctctctctgaagacagcacacactcaccagtccccgctcacaccgcaacacccggygaggaagcgccctccaactctccctttcgtgctcggccccggggggcagcagtgagccccgcaggccagcccgctgcgtcctgcctgtctggcaccgagcgatgttctgaccacccctcgccagggcaggcccagcctccctctctcctcccagtccccacccacactggcttcccctggatgctccctgcctgggctccaccccagggcctcatcgcggccatcccctgccacctgggattgtcccctcccagcctcccctcttagggcccttcccaccattcgagccactggatgcct

SEQ ID NO: 71139 - DNA, 601 bp, Human
cactgcactccagcctgggcaaaagagtgagactgtctcaaaaaataaataaataaggcctaacgtgacccttggccaaatgcctagtgcacttacttctactcccggatgggccccgggcaccctcatgaccaagccccaacctcagggcctttcaagagttgcgtctacaaacaccctgcaggccctcacccccaggcagggacaaaccagctgctggggtcacctgctgggcggcagtgccggtacacagcgcaagagctgtctcctgacgagcaggtttggaaggaacagcatggcmgtgacgcagtgacttatgccttcaaagccacagggatgggaaattgcttcatggcacgacagacgtgtgctgtgataaggggttactcgttctcaacaatgttggctatgcaagcgtccttgagaagtctgaactcacaggggagctgtcacagatcaaggtcaacaagccagggtggctgtcggggtgaggccggccgcgccctcctgaataaaaggcctgggtgctgtgtaatgaggtgtgaagaataaaggctactcaccctgaaaactgctcttctctctctgaagacagcacaca

SEQ ID NO: 71140 - DNA, 601 bp, Human
tgtttggatgccttggctggagctccacctcccttccctggctctgggtccggccctgtccttccctggctctagggggctttgtgtccacaaaatgtcaggctgctccatcagccacagggggctggggggacaccccatcgaagtcctgggcgaggccctcatctcccaacaatcctgaggacctgtctggcatggccaggagacgtggaagggccacatgcaaatgaggtggcacctcccacacagggcacaaacgcaggagccccctcatcctcagggggtgccactcgtggtcccmgcatgtgtgtgtgggggggtggggcctcatccaggcctggtgggcagcccctcccacctgagacctgagaataattctcatccgacgatgacaactatgtgtctgaaagtgaccttcccggcatcacctggtcatcacccacagcagctcccaggggcacgcagccaccctgctcctcctgacagctctgtgactacttcaccccaaattcattttgcttagacatttatttgaaaaaagacctggccaggagtggcagctcacgcctgtaatcccagcactttgggaggctgaggtggg

SEQ ID NO: 71141 - DNA, 601 bp, Human
agggtgatcagcctttcacccagtcccctacttctaggaactgatcccaaaaaagccccagcacaaaagtaaaatgggaggtatctgcacacgttttcccaccgcagctccatctgtagttgaaaaagatgggacggagcccccacatgcatcagtcagcccagcccaacgggcacgggagtgtgtgcggccgtggaaggagagaggacgcatccactgaggggtctcaggacacgtgacgtgcgggaaaaaagcaggtctggagcaggacctgcctcaggagagggaggacgcaatcccrcctcagtgttgcttggccagggagaggggcggcctccgcacaggagcccacacagccacggaaggcagccggctgttggtgcaggcagcactcactgttacacgaatcacgagacagagaactgcacaccagtgctccgcaccccggtcacagacgcagaaccccgaggaaacacgggggaggcagagcaggccctgcgaggcacaggccttcttttaactttgatctcaaaagcatgaactctcttaaacaactgagacagccgagccggagaaaccgcaatcctggctgcgtttggtg

SEQ ID NO: 71142 - DNA, 601 bp, Human
tcctgagaacccaaggtcagtgttaaaagaaggcctgcacctcgcagggctcatcctccctccctgtgtttcctccaggggttcggtgtctgagggtgatcagcctttcacccagtcccctacttctaggaactgatcccaaaaaagccccagcacaaaagtaaaatgggaggtatctgcacacgttttcccaccgcagctccatctgtagttgaaaaagatgggacggagcccccacatgcatcagtcagcccagcccaacgggcacgggagtgtgtgcggccgtggaaggagagaggaygcatccactgaggggtctcaggacacgtgacgtgcgggaaaaaagcaggtctggagcaggacctgcctcaggagagggaggacgcaatcccgcctcagtgttgcttggccagggagaggggcggcctccgcacaggagcccacacagccacggaaggcagccggctgttggtgcaggcagcactcactgttacacgaatcacgagacagagaactgcacaccagtgctccgcaccccggtcacagacgcagaaccccgaggaaacacgggggaggcagagcaggccctgcgaggcacagg

SEQ ID NO: 71143 - DNA, 601 bp, Human
cgacactgccgaagggccggagaggcacaggccggagaggcacagcccgggtagaggggatttcggcagtcctgagaacccaaggtcagtgttaaaagaaggcctgcacctcgcagggctcatcctccctccctgtgtttcctccaggggttcggtgtctgagggtgatcagcctttcacccagtcccctacttctaggaactgatcccaaaaaagccccagcacaaaagtaaaatgggaggtatctgcacacgttttcccaccgcagctccatctgtagttgaaaaagatgggacggagyccccacatgcatcagtcagcccagcccaacgggcacgggagtgtgtgcggccgtggaaggagagaggacgcatccactgaggggtctcaggacacgtgacgtgcgggaaaaaagcaggtctggagcaggacctgcctcaggagagggaggacgcaatcccgcctcagtgttgcttggccagggagaggggcggcctccgcacaggagcccacacagccacggaaggcagccggctgttggtgcaggcagcactcactgttacacgaatcacgagacagagaactgcacaccagtgctccg

SEQ ID NO: 71144 - DNA, 601 bp, Human
aggagccacggaggtcaatgcatggctgcagggacaaggggccacgcccatcagcatggagaaggccaggcaggcttcctggaggaggtgagcaggacagaacaggtgagcgggcaggggcgaagaggccggggttctgcaggagaggacggcctcaccacgcgcttggaccagcgcccagaaggatcatggccccacccagagatcacacgggtactcgagtgcggcatttacctcgatgccttttctctgaaggtctattgagagtgcgggccctgggctacctgacttctctaccccmagaacaggcatccaaccaccccgactggcccaggcctaaggctggcagcaccccacggaggcaggctcccttgacactgccggggttggggggctcccttgacactgtctgggggctcccttgacactgccaggggctcccttgacactgccggggttggggggctcccgacactgccctggggggaatccctggacactgccggggtgttgggggctccctcgacactgccctggggggaatccctggacgctgttggggtgttgggggctcccgacactgccatgggggaaatccctg

SEQ ID NO: 71145 - DNA, 601 bp, Human
ggaggctggcgatgtctccactgtcacgcacatggccgcgcgaggccaacctcctcctcgcagccagcccaggacagacctggacggcacccactcatgagaggacacagcggtggcgcctcggagccgccacggccccacgcacccaggctgtgcctctcactcacccagaggggatgaggacgtggcctggcctccaggagccacggaggtcaatgcatggctgcagggacaaggggccacgcccatcagcatggagaaggccaggcaggcttcctggaggaggtgagcaggacagaayaggtgagcgggcaggggcgaagaggccggggttctgcaggagaggacggcctcaccacgcgcttggaccagcgcccagaaggatcatggccccacccagagatcacacgggtactcgagtgcggcatttacctcgatgccttttctctgaaggtctattgagagtgcgggccctgggctacctgacttctctacccccagaacaggcatccaaccaccccgactggcccaggcctaaggctggcagcaccccacggaggcaggctcccttgacactgccggggttggggggctcccttga

SEQ ID NO: 71146 - DNA, 601 bp, Human
tcagacgctggagaaggcgggaaacggggtctccctggagcccccagaaagaacccacccagctggtgccttgactaaatttggcccagtgagctccatctgcactcgcaccctccagaccgctgagctaacaaatgcgtgttgctttaagccccccagtggcggccactgttacagcggccgcaggaagttcatccacctccatctgcccaggcaagacggacaggcagggggtggtgaccagggagcacatcagacagcctcgctcacagccctggggactcggggcctgcttctcccrcggccaccaggccaactactcaagagtcctggggacatggctggagagagaggggctgccgtcagctgtgcaagcaggaggctggcgatgtctccactgtcacgcacatggccgcgcgaggccaacctcctcctcgcagccagcccaggacagacctggacggcacccactcatgagaggacacagcggtggcgcctcggagccgccacggccccacgcacccaggctgtgcctctcactcacccagaggggatgaggacgtggcctggcctccaggagccacggaggtcaatgcatggc

SEQ ID NO: 71147 - DNA, 601 bp, Human
cctccaatgccaagcatccggaagcacccatggtcagctgtgcaaaacccagacagccccacatgcaagtcccgggacccaagactgtgtcaccttccgtggcatacgggactttgcagacgatgaagtgaaggacgtggggatggggagatgttcctggatgatctgggtgggcccacgtcattgcggggtcctcacaagagggatgggggggcggctgtatcagaggcggtgacgtgagacggaggcagaggctggggtgactcagggctgcaccaaggggcaggcggcttcagacgcyggagaaggcgggaaacggggtctccctggagcccccagaaagaacccacccagctggtgccttgactaaatttggcccagtgagctccatctgcactcgcaccctccagaccgctgagctaacaaatgcgtgttgctttaagccccccagtggcggccactgttacagcggccgcaggaagttcatccacctccatctgcccaggcaagacggacaggcagggggtggtgaccagggagcacatcagacagcctcgctcacagccctggggactcggggcctgcttctcccacggccacc

SEQ ID NO: 71148 - DNA, 601 bp, Human
accacggccgggactctccatgtcctatggactctcgctgaagccactcggccccgtgtgaccccctccgcccacagccggacccacacctggctgcatctgctcaaccgtccaagggagctctgtctagggttgcaatccgcatgtttaatattcacgaccacacctgatctcaggacaattcagtgaggaggacggagcaggtatcgtgtgcaccactttacagatgagaaaactgaggccaccaaggtcaagggtcaccccccagagacaagggaaggtggctcccaggcgccccccraccatcgcccctgtgcgtccggcagtgcctccatctgggtgccctctgctgccctcactccaggaatccttccagcagaggacagaaacctccaatgccaagcatccggaagcacccatggtcagctgtgcaaaacccagacagccccacatgcaagtcccgggacccaagactgtgtcaccttccgtggcatacgggactttgcagacgatgaagtgaaggacgtggggatggggagatgttcctggatgatctgggtgggcccacgtcattgcggggtcctcacaagagggatggggg

SEQ ID NO: 71149 - DNA, 601 bp, Human
tgcctctacaggctgggctgtacaatggggagaatgagagcccgaccccgtaaatgaggtggacctagcaccgccttccggacactgcagtgggcgtgagctgccgcaaccccgtgtcctcaccacggccgggactctccatgtcctatggactctcgctgaagccactcggccccgtgtgaccccctccgcccacagccggacccacacctggctgcatctgctcaaccgtccaagggagctctgtctagggttgcaatccgcatgtttaatattcacgaccacacctgatctcaggacrattcagtgaggaggacggagcaggtatcgtgtgcaccactttacagatgagaaaactgaggccaccaaggtcaagggtcaccccccagagacaagggaaggtggctcccaggcgccccccaaccatcgcccctgtgcgtccggcagtgcctccatctgggtgccctctgctgccctcactccaggaatccttccagcagaggacagaaacctccaatgccaagcatccggaagcacccatggtcagctgtgcaaaacccagacagccccacatgcaagtcccgggacccaagactgtgtc

SEQ ID NO: 71150 - DNA, 601 bp, Human
atggcccatgctggccggctcctccgcttgcccagactgggagacactggacatccctggagacgtctccctcaacaccccagccaatggccaggtctggcaattctgctactggacatttctggagtccaccccactgccctggccctctctcgcccggctccaggatgacggctttccccggcggctcccaccaccgacaccacaaaatctgagcgacgtggcacggcccacaggcccatggcctggacctcacctgcctctacaggctgggctgtacaatggggagaatgagagcccraccccgtaaatgaggtggacctagcaccgccttccggacactgcagtgggcgtgagctgccgcaaccccgtgtcctcaccacggccgggactctccatgtcctatggactctcgctgaagccactcggccccgtgtgaccccctccgcccacagccggacccacacctggctgcatctgctcaaccgtccaagggagctctgtctagggttgcaatccgcatgtttaatattcacgaccacacctgatctcaggacaattcagtgaggaggacggagcaggtatcgtgtgcaccacttta

SEQ ID NO: 71151 - DNA, 601 bp, Human
gctcagcccgagttaggcccaacacgcacagccagccccacagctcccagcacccacctcggctcctcctcgccttccctgccgcaatacccatgggtgcagcaggcccaactttcctcctgccttccatcctgagcccttacctcgccatgctgtgtgaactggcctgggtcccgccctcagggcgggcacggggtagggtgggggagctcaggatggcaggcctcgcacccgaggggaaggccgcagggacgtgtgcaagcttccagtccctcaccttccggctcggtctctcaggaaytacaccgtccaccagccccaccctggccccacagagtccactgtcaccagcccctacagggactctactgtccaccagccctgccccccacagggactccactgtcaccagccccaccccagcccccttcactccgctgctcccagctctctcaggacccagcccaccccacccacactcacagggtttcaggcagaggcccacagtcaccaaggccgatccaaacccccattccctgggccagcgatggtgtgagggtggacaagtgacccaagggtgtcgagggcccagtggactcag

SEQ ID NO: 71152 - DNA, 601 bp, Human
tgcccatcacttctcggaggctcagccccaggcctccatgttgcacccccaccccgcctgtccctgtcaacctgggaccctccctggctgtgccccagaccttcacagttgccgtggggttccctccccgtcccctaagtggtccaaagacaccttctctgcctctttcttttcccacagcaccctcctgagggctcagtaacctcagctcagcccgagttaggcccaacacgcacagccagccccacagctcccagcacccacctcggctcctcctcgccttccctgccgcaatacccaygggtgcagcaggcccaactttcctcctgccttccatcctgagcccttacctcgccatgctgtgtgaactggcctgggtcccgccctcagggcgggcacggggtagggtgggggagctcaggatggcaggcctcgcacccgaggggaaggccgcagggacgtgtgcaagcttccagtccctcaccttccggctcggtctctcaggaactacaccgtccaccagccccaccctggccccacagagtccactgtcaccagcccctacagggactctactgtccaccagccctgccccccacag

SEQ ID NO: 71153 - DNA, 601 bp, Human
ggtcggtcaggaggccggacccacaagtgcctacgtacctccctcctgcacgtcctgaggctgtaggtcaaagggcaagaaacaagggtggagccaggatgtgggtgctgtccacaccaggacagagggtctggctggtggggagtcgagggtgcgggctggagggtgagggtcctgagtccaggccggcagcagccccgccagttcctcatccagaccagcccagactggagaactccaacaatggcaggcggggcgcagcaggcaggggacagctcccaatgccaggtgacccggcaascaggctcccttcctccccctgccacacactcttccctaaccccagcccctccctgtccgcctcttgagtcctgacaaccagcttctctggagacacccagaccaccaaggtgcaccccttgttgcgtgatcccctctggccccctcatcctgcccatcacttctcggaggctcagccccaggcctccatgttgcacccccaccccgcctgtccctgtcaacctgggaccctccctggctgtgccccagaccttcacagttgccgtggggttccctccccgtcccctaagtggtccaaaga

SEQ ID NO: 71154 - DNA, 601 bp, Human
tcgaagacgactaaggtgaaaggaaggtgccaactgggaggctggcacacggcactgcccttcccgggtcttctgaaaggaagctgtggtcccttccccgacacccgtctctcccacatgggtgaacatccagaagcctggtggtggatggacggtcggtcaggaggccggacccacaagtgcctacgtacctccctcctgcacgtcctgaggctgtaggtcaaagggcaagaaacaagggtggagccaggatgtgggtgctgtccacaccaggacagagggtctggctggtggggagtckagggtgcgggctggagggtgagggtcctgagtccaggccggcagcagccccgccagttcctcatccagaccagcccagactggagaactccaacaatggcaggcggggcgcagcaggcaggggacagctcccaatgccaggtgacccggcaaccaggctcccttcctccccctgccacacactcttccctaaccccagcccctccctgtccgcctcttgagtcctgacaaccagcttctctggagacacccagaccaccaaggtgcaccccttgttgcgtgatcccctctggccccctca

SEQ ID NO: 71155 - DNA, 601 bp, Human
agtttcaaggacctttttcttcttccttgtttgagtactgtgatggttacaggcatccagagaaggaggaggaaacgtgtggggtcccattcacctccactccaagcggcggctgcaccccacagtcccccatgccgggacctcagcatgggcctctgggttggactgaggggtcctcagcatgaagctggctggtgttcacggggcaggggttccaggctgaccctccgcctgaggctcgttcatcctcattgcaatggagcacgtcagaggttcgcgggccgcctcgccggctgcttcrgacagaaggtgcactgtgccgtttgaggcctctgtgtcactggggcaggggcctcagcttaacccacataaggatcatgtctacacataaacgtcaaacactgtgttttatgagcaatttaggggattctaagcaaagcctgttttttgccttctaggcagactcctggaacccgcaccctgtaacccaggcagaggtgaaggaaggagaggggaaaagctctgctggaaaccacattctgcagcgattttcactcagtttgggaaacacttggagtttgggagacgttttacagcagat

SEQ ID NO: 71156 - DNA, 601 bp, Human
tggtggcgagctcctgtagtcccagctatttgggaggctgaggcaggaaaatcccttgaacccaggaggtggaggttacagtgagccgagatcacgccactgcactccagcctgggcgacaagagcaagactctgtctccaaaaaaaaaaaaaaccaaccaaccaaccaaacaaacaaaaaaacggaactgcaactccagcaagtttcaaggacctttttcttcttccttgtttgagtactgtgatggttacaggcatccagagaaggaggaggaaacgtgtggggtcccattcacctccrctccaagcggcggctgcaccccacagtcccccatgccgggacctcagcatgggcctctgggttggactgaggggtcctcagcatgaagctggctggtgttcacggggcaggggttccaggctgaccctccgcctgaggctcgttcatcctcattgcaatggagcacgtcagaggttcgcgggccgcctcgccggctgcttcggacagaaggtgcactgtgccgtttgaggcctctgtgtcactggggcaggggcctcagcttaacccacataaggatcatgtctacacataaacgtcaaa

SEQ ID NO: 71157 - DNA, 601 bp, Human
ccaacacggtgaaaccccgcctctaccaaatatagaaaaaaaatagccagacatggtggcgagctcctgtagtcccagctatttgggaggctgaggcaggaaaatcccttgaacccaggaggtggaggttacagtgagccgagatcacgccactgcactccagcctgggcgacaagagcaagactctgtctccaaaaaaaaaaaaaaccaaccaaccaaccaaacaaacaaaaaaacggaactgcaactccagcaagtttcaaggacctttttcttcttccttgtttgagtactgtgatgrttacaggcatccagagaaggaggaggaaacgtgtggggtcccattcacctccactccaagcggcggctgcaccccacagtcccccatgccgggacctcagcatgggcctctgggttggactgaggggtcctcagcatgaagctggctggtgttcacggggcaggggttccaggctgaccctccgcctgaggctcgttcatcctcattgcaatggagcacgtcagaggttcgcgggccgcctcgccggctgcttcggacagaaggtgcactgtgccgtttgaggcctctgtgtcactgggg

SEQ ID NO: 71158 - DNA, 601 bp, Human
gttcgagaccagcctggccaacacggtgaaaccccgcctctaccaaatatagaaaaaaaatagccagacatggtggcgagctcctgtagtcccagctatttgggaggctgaggcaggaaaatcccttgaacccaggaggtggaggttacagtgagccgagatcacgccactgcactccagcctgggcgacaagagcaagactctgtctccaaaaaaaaaaaaaaccaaccaaccaaccaaacaaacaaaaaaacggaactgcaactccagcaagtttcaaggacctttttcttcttccttktttgagtactgtgatggttacaggcatccagagaaggaggaggaaacgtgtggggtcccattcacctccactccaagcggcggctgcaccccacagtcccccatgccgggacctcagcatgggcctctgggttggactgaggggtcctcagcatgaagctggctggtgttcacggggcaggggttccaggctgaccctccgcctgaggctcgttcatcctcattgcaatggagcacgtcagaggttcgcgggccgcctcgccggctgcttcggacagaaggtgcactgtgccgtttgagg

SEQ ID NO: 71159 - DNA, 601 bp, Human
ggctcaagcctgtaatcccagcactttgggaggccaaggcaggcggatcgcctgaggtcaggagttcgagaccagcctggccaacacggtgaaaccccgcctctaccaaatatagaaaaaaaatagccagacatggtggcgagctcctgtagtcccagctatttgggaggctgaggcaggaaaatcccttgaacccaggaggtggaggttacagtgagccgagatcacgccactgcactccagcctgggcgacaagagcaagactctgtctccaaaaaaaaaaaaaaccaaccaaccaacaaaacaaacaaaaaaacggaactgcaactccagcaagtttcaaggacctttttcttcttccttgtttgagtactgtgatggttacaggcatccagagaaggaggaggaaacgtgtggggtcccattcacctccactccaagcggcggctgcaccccacagtcccccatgccgggacctcagcatgggcctctgggttggactgaggggtcctcagcatgaagctggctggtgttcacggggcaggggttccaggctgaccctccgcctgaggctcgttcatcctcattgcaatggagcacg

SEQ ID NO: 71160 - DNA, 601 bp, Human
ggggccgggcgcagtggctcaagcctgtaatcccagcactttgggaggccaaggcaggcggatcgcctgaggtcaggagttcgagaccagcctggccaacacggtgaaaccccgcctctaccaaatatagaaaaaaaatagccagacatggtggcgagctcctgtagtcccagctatttgggaggctgaggcaggaaaatcccttgaacccaggaggtggaggttacagtgagccgagatcacgccactgcactccagcctgggcgacaagagcaagactctgtctccaaaaaaaaaaaacaccaaccaaccaaccaaacaaacaaaaaaacggaactgcaactccagcaagtttcaaggacctttttcttcttccttgtttgagtactgtgatggttacaggcatccagagaaggaggaggaaacgtgtggggtcccattcacctccactccaagcggcggctgcaccccacagtcccccatgccgggacctcagcatgggcctctgggttggactgaggggtcctcagcatgaagctggctggtgttcacggggcaggggttccaggctgaccctccgcctgaggctcgttcatcctca

SEQ ID NO: 71161 - DNA, 601 bp, Human
cccccctcaaagcccaagatggggagacatcaggtagaagcagcaggagcacatacttggcgatccacaggcagcccaccgaagagaacgtcacagtcaccacaaatcactgctgaaggcgagaccagtggggaggaaacggggcggctgcctttttaaaccttacgttaaaaccttacattaaaaaacatactcatgaatcgaggtactcgctagtcagaactgagaccctggagggatcccccggggccctgactggtgctgcaggccctcaggcagtgcccggctccagagcaggagrggcaggcacctgggtgacccggccagcctcggccagcagtgggcaggccctagccaagccactgtctttccttcagctgatgactgtaagtcacaaatgtaaagaaaatggggccgggcgcagtggctcaagcctgtaatcccagcactttgggaggccaaggcaggcggatcgcctgaggtcaggagttcgagaccagcctggccaacacggtgaaaccccgcctctaccaaatatagaaaaaaaatagccagacatggtggcgagctcctgtagtcccagctatttgggaggctgagg

SEQ ID NO: 71162 - DNA, 601 bp, Human
aacacacaagacgaacctgccctgcatccggggtccctccttccacgtcctcccaggccacgacggagcgtcctcctggagaaaagctggggtgggagggtgggggggtgcagccctctgctgtttttatctcctgagcattccgaacgcttccacaaacttacgcagccggccataccctcacccacgcgccacacgcaccacacacacaacatggcgcccgctctccctcccccagagccagccccgtggagcccttgaccggtggcacccaatccccagggcatggatgctgttggcyggggccccgccctctctacactcccacaccatcatctcccctccctcaaacacatgggcactgcggtcccttctccctgccccaacaccagtgccttgacctccctcctccttggccacaccacccacctgccatccctggagtcacccccacaaggactggaccacagcctctgccccatgagtcctctgtgccccaactctcacccactccccagcattctccacggcagctaggctgccattggctctcagagataccactacttcgtgcatcatgaggaaagacaaaaaatgttgc

SEQ ID NO: 71163 - DNA, 601 bp, Human
tctcaacacacaagacgaacctgccctgcatccggggtccctccttccacgtcctcccaggccacgacggagcgtcctcctggagaaaagctggggtgggagggtgggggggtgcagccctctgctgtttttatctcctgagcattccgaacgcttccacaaacttacgcagccggccataccctcacccacgcgccacacgcaccacacacacaacatggcgcccgctctccctcccccagagccagccccgtggagcccttgaccggtggcacccaatccccagggcatggatgctgtkggccggggccccgccctctctacactcccacaccatcatctcccctccctcaaacacatgggcactgcggtcccttctccctgccccaacaccagtgccttgacctccctcctccttggccacaccacccacctgccatccctggagtcacccccacaaggactggaccacagcctctgccccatgagtcctctgtgccccaactctcacccactccccagcattctccacggcagctaggctgccattggctctcagagataccactacttcgtgcatcatgaggaaagacaaaaaatg

SEQ ID NO: 71164 - DNA, 601 bp, Human
ggagtgcagtggcacgatctcggcccactgccacctccacctcccgggttcaagcgattctcctgcctcagcctcccgagcagctgggactacaggtgtccaccaccacactcggctaatttttgtatttttagtagagactggatttcaccgtgttagccaggatggtctcaaactcctgacctcgtgatctacccgcctcggcctcccaaagtgctgggattacaggcgtgagccactgcgcccagtcatcttatctttttcttcagcttattttatttgctctgtaagcttaactttygtgagctgaactccaaagtcaacctgctgtttgattatttttgtgacttgtttcaaataaaacctcttctaagaattaatgtccaccatattccttttttgtccaacaaaataagtcatctcttctgtttcaaatgttccttccctcattggacactgtgcttgggctacctgtattaacacagatccctggagagcacgttctcaacacacaagacgaacctgccctgcatccggggtccctccttccacgtcctcccaggccacgacggagcgtcctcctggagaaaagctggggtgg

SEQ ID NO: 71165 - DNA, 601 bp, Human
acagccagttggtcagaatccaggttgtcacctggcacttgcagctggctctcaagtaggggcaggcttgtgggaatgagcccttcatctgcagggtctgcgctaacgtcaggtaattgatgtcagagctgaatggaaacacaggacaaccagctggcgccagagtggctgtgggtgcagaaaaccccacataactggaggcagaaacacagtgcagagtgcgacctggtgcggccacgcgagggaaacgtctgtttcccggaaactccactcctgggtgtgcccacatgaaagatgcgcyacgggcaacagaaggcgctcggatgtctgtggccaaaagccgggaccccggtgcctcgcaagatgagggtggatacataagacgtggagaattcagccagcagagcagccccgcagtggggacggacacggcagaaccgcaccccacaccacgggaaagccccacacaggggcccgactgagcggccacacccagggtggatggccccggatcccaagacaaaagctcgaaacaagcaaaactatctgcaggcaccaaggccggggacgggtaggttacgcctggggtcacctcggggtg

SEQ ID NO: 71166 - DNA, 601 bp, Human
ctgcaccccccatacctcagcctcccgtgcagctcctccgtgtggctgtcctttctaataaacgggtacactaagcaaagtgttttcctgagttccgggagctattctagcccacccgagcctcaggaaggggtcacggacacccccgattcacagccagttggtcagaatccaggttgtcacctggcacttgcagctggctctcaagtaggggcaggcttgtgggaatgagcccttcatctgcagggtctgcgctaacgtcaggtaattgatgtcagagctgaatggaaacacaggacamccagctggcgccagagtggctgtgggtgcagaaaaccccacataactggaggcagaaacacagtgcagagtgcgacctggtgcggccacgcgagggaaacgtctgtttcccggaaactccactcctgggtgtgcccacatgaaagatgcgctacgggcaacagaaggcgctcggatgtctgtggccaaaagccgggaccccggtgcctcgcaagatgagggtggatacataagacgtggagaattcagccagcagagcagccccgcagtggggacggacacggcagaaccgcaccccaca

SEQ ID NO: 71167 - DNA, 601 bp, Human
ctttgacagcccaattttgaaatggggcaaaagactggaacaggcacctttaaaaggagggtccccaataacccgggagcctcggagaagcagctcacctcagccgtcgcgaggccacagcctagtgcctttcagatctgctgtgctggcgacaacgcagggctctgacagtccatgtgctggaaggaggtgcatcgggaattcccacacgacccagagtgactgtgccatcaacacagattcagcctttgtctcagtttcccggcgcgcagcccctctgaccctaggaatcctggagtgyggtaagagtgtctttttgcatgctaatgagatgacggggagccgggagcccggacagctccaggatgcggctggtcttcagcaggaccaaggaatgcctagcgggttggaactttccgtcccacagcccacggtccagagaggagacaggagagactgaggtaatcagcagtggctggctgttgaatcaaccgtgcctgtcacgaagcctccacaaaaagccctcaatgacatggtctggagagtgtccgagttggtgaatataccaaggtgctggagggtggcgtgcctggagagggca

SEQ ID NO: 71168 - DNA, 601 bp, Human
aaccaacaaaaaagacggaccccccaatgacattgttctttgacagcccaattttgaaatggggcaaaagactggaacaggcacctttaaaaggagggtccccaataacccgggagcctcggagaagcagctcacctcagccgtcgcgaggccacagcctagtgcctttcagatctgctgtgctggcgacaacgcagggctctgacagtccatgtgctggaaggaggtgcatcgggaattcccacacgacccagagtgactgtgccatcaacacagattcagcctttgtctcagtttcccrgcgcgcagcccctctgaccctaggaatcctggagtgtggtaagagtgtctttttgcatgctaatgagatgacggggagccgggagcccggacagctccaggatgcggctggtcttcagcaggaccaaggaatgcctagcgggttggaactttccgtcccacagcccacggtccagagaggagacaggagagactgaggtaatcagcagtggctggctgttgaatcaaccgtgcctgtcacgaagcctccacaaaaagccctcaatgacatggtctggagagtgtccgagttggtgaatat

SEQ ID NO: 71169 - DNA, 601 bp, Human
cttctgtcccatactgttttggaaggatcaacagtgccagggtaacaaggcaacatctgaaggaaaggcagaaacaaacagccggtcactgacaaaatggcagcgcacagagaggttccggagcaaccacagacaaactacggggaccaggagaggccaagacaaatgagttaatcacacttctttacacattgctataaacaaaaagataaaaaaaaaaaaactgtaaaagtaatacggcttaaaacagcataagcactgaaataccagggaatcatttgaacaaaaaatgtggatgacygctacacacaagactacaaaatattattgaaagaatttaaggccgggtgcagtggcttgcatctgtaatcccagcaccttaggaggctgaggcagaaggaccacttgagcccaggagttcaagaccagcctgggcaacatagggagaccctgtctctacaaaaaaatgccaaaatagctgggcatggtggtgcacacctgtagtcccagctacttgggaggctgaggtgggaggattgcttgagcccaggaggtcaaggctgcagtgagccatgatcatgccactgcactccagcctggg

SEQ ID NO: 71170 - DNA, 601 bp, Human
acacactcagtccatagcattccggaagtacacgccttgttcgcttatgctggcccacagccagggaggaacttggcctcaggaggaatgggcctccaggctcccccatgccttgttcagacaagactgcccccgccacactgggaggagttaagggttctggggccattgggatgtaatgacagtattttgcacgtgagaaggacacagaatagacattcccaccccagaagagagaactacgatgccaggcgcagtggctcacgcctgtaatcccaacactttgggaggctgaggcaarcggatcacccaaggtcaggagttcgagaccagcctggccaacatggcaaaaccccgtctctaataaaaacataaaaattagtggggcgtggtagtgtgaccctgtaatcccagctgcttgggaggctggggcaggaatattgcttgaacctgggaggcggaggttgcagtgagccgagagcgtgccattgccatcctgggcaaaaaaaaaaaaaaaagaatcaaatggaaattctaaaagtaaaaaatgaagtgactgaaattaataatttaaagggtagatttaagagtagattgggtg

SEQ ID NO: 71171 - DNA, 601 bp, Human
aagccgggccaggcatctcactggagacaaaaactggggttcagggccaccaggacaatcaagacctatggaactgtctccgtcggctcagccaccacagcaaaataccacagactgggcggcttaagtgacaggcattgactttctcatgtttccgaggctggagtcaggatgacggaacctgcagggcggggtatctccttgcttgctggcggcctcatgctcaccatgttctcatgtggagcagagagcacaggcgcagcacaacctctcttgtgtctcatcctctcatcctataaarggcacaaatcccaccacaagggttctaccctgtgactctaaccaccaccgtgaccctaaccaccaccgtgaccctaactaccaccatgaccctaactaccaccatgaccctaactaccaccatgacgctaactacagccgtgaccctaactaccaccatgaccccaactatagccgtgaccccaactaccaccatgaccctaactaccaccatgaccctaactaccaccatgaacctaaccaccatgaccctaaccaccaccatgaccctaactacagccgtgaccctaactaccaccat

SEQ ID NO: 71172 - DNA, 601 bp, Human
tctgaggatctggggtggccgtggggcaggggcggcggtggggggggcagtggaggtgcagcccctccatctgagggacctgcccggatcgcaagcctgcaactcaaacttcccgtttctaaccacagatctatttcccagctgaacatgtgattgaaaacatgctatgcttttaaaggtgactgaagaataacactaaagtcacagaagacgacttggaaaaggttttgggcaccactgtggcgggaagcagatggttgcccggggcgcagggtctgttttggggactggcagccacagsccaggctcccactgaggcaacaacctcccccttccccacagctgcttagtgcaaccacacggcacagaagagctcgagagacagaagaggcacagccgaggcgccagtcgggcgaacagggagccaagctctgccgacttccgtcctctcacgtctaggcacgtgggacacacggacccccaggaacaggcagaacccggccctgtgggcaccgggccacacggcgcagcacaatgggtatcagggtgtcagtgatacgaagggacaggcaggtggataagggacccaggagggatgggc

SEQ ID NO: 71173 - DNA, 601 bp, Human
aacggcccctggcccccagatactaccggcgaggaggctgtgggcctggcaccgcgagtcccccggctacctctgtggaacagggtctcaaagtcaagcccaggttagcaggaggtccttccgggggtacgtgtggacacagcctggggtctcctgcagtggacagcgcacagtggacggtgcagccacacgggtcaggctttggagtcagagctggctcgatgtcacgtgcccattggggacccatcctgccacctccctgggtgccaggctctgctgaagcaagcagggaacaaaattrtggggatcacaggggccgctcctcctctttcagccttaactccgacaacctcaaggagctctgtgcgtgtctttgagattctataattaggacggccacaggaattctaaggagctcagtttccatggcaatctcgcgccttgagcactctgacaagacgtagaaaacacgttttaaaacactaaactcggagcagcaggctgggacaggcgacagcccttgggtgcggtggcggtgagggaggggccgagtccctggcagcaggtcagggggcacttgaggcctctcctgttcactgga

SEQ ID NO: 71174 - DNA, 601 bp, Human
cgtgacagttctgagtgcaggctgggtgtctgcaggacgcccctccgttaggactggcctgatatttttctcaaggtgagactgcacttagggcctccttagcttctgaatcaaaggagcacctgccttgaaaaatccacattcccaccttttcgggggattctgcaactgccaaaacaaacggaagcaaccacaaaaaccccccaaaccttcgaacttcaggcaattgactagaaggttccctcagtgtaaggggcctggacacgcgggccggcagccactctgcctttctgggcccgcrggcagggatgttggggggacctggcggtccccacccctcaaaagtcacagtcgaattttcagtgtttgggtttctgcttggaaagcgatgggcctatttctgacctaagcgacagacagcgctgtgaaaaggagaagggagcccttctggggagtgtgctctggaaacggcccctggcccccagatactaccggcgaggaggctgtgggcctggcaccgcgagtcccccggctacctctgtggaacagggtctcaaagtcaagcccaggttagcaggaggtccttccgggggtacgtgtg

SEQ ID NO: 71175 - DNA, 601 bp, Human
cacgtgtcaccatcctgcctcttccaggagcccacgtgtcaccgtcttgcctctcgggccctgctgcaccgtgactttctcagactttctgaccgtgctttctgaccgtgacagttctgagtgcaggctgggtgtctgcaggacgcccctccgttaggactggcctgatatttttctcaaggtgagactgcacttagggcctccttagcttctgaatcaaaggagcacctgccttgaaaaatccacattcccaccttttcgggggattctgcaactgccaaaacaaacggaagcaaccacraaaaccccccaaaccttcgaacttcaggcaattgactagaaggttccctcagtgtaaggggcctggacacgcgggccggcagccactctgcctttctgggcccgcgggcagggatgttggggggacctggcggtccccacccctcaaaagtcacagtcgaattttcagtgtttgggtttctgcttggaaagcgatgggcctatttctgacctaagcgacagacagcgctgtgaaaaggagaagggagcccttctggggagtgtgctctggaaacggcccctggcccccagatactaccgg

SEQ ID NO: 71176 - DNA, 601 bp, Human
agggcagcctgtacttaacaaatacaccttttggccaggcgtggcggctcatgcttgtaaccccactacctcggtaggtcgaggcaggtggatcacttgagcccaggaatttgaatccagcctaggcaatatggtgagaccccgtctctataaaaaaaatataaaaaatgagccgagtgtggtggcgtgcacctatagtcccagctactcgggaggctgaggtgggaggatcacctgagcctggcaggtggaggctgcactgagcagagatcacaccactgtattccagcctgggcaacaragccagaccctgtctcaaaaacaaaacaaaacaaacaaacaaaaaaacccatcctttttatttgggggtaatttcagattcacagggaaactgcaaaggctgtggagaacctggtaaccagaagcctccctgtggccaaggccctgcctggtccctactcgcctatggaggctgagaggaagcctggtgctagaacctcaactccagctgtaggcagggccgccctcaactgtcttttttaatagactatttttaagaacagctttaaattggagagttcccagagaccccccctgcctg

SEQ ID NO: 71177 - DNA, 601 bp, Human
ctgggccatggtgcccagacggctggtcaaatgttatcctggatgtttccatgagggtgagtatggatgagataaacatttaaatcagctgactttgggggaagcagactgcccaccacaatgcaggtgggcctcacccaagcagaaaaaggcctccacagagcaaaggctgagctccctaagcagcagtgctgcggctgtggctcctcctaggtctccagcctgctgggccccctgtagattttgggcttcataagtctctatgaacaagccagttccttacaatagatctttctatacrcacaccctattggtttggtctctctggaaaaccctggcacagggtctccgaggtgggagttttgggcaggcatcatgtttcccattttcctcgccctcccagccccccatgcggagtcccacgggaaggcacgccaggagcccctggccctggggaccctggttgggcaggacacccaatacccccagcatctgggtcttgcctcagtgaaatgggggaagccccatggggtccatgccagtccccagctggaaagcagggaccaggtgagttataagggataacggacagcagggcagc

SEQ ID NO: 71178 - DNA, 601 bp, Human
gcggtcacacagctgtggggcggagccgagggacggccgcgcagctggggggcggagctgagggactgacgcacagctgggggtcgaagctggctggagcggggacacacaggacccacccccagtgcgcctgggaaaccctgaaaatgcgccaactggacatccttcgagttcaatcagtaaagagaatgacgtcctagcagacgccagggctcatcagggagcctccagcagggtgaacaaactctcccacaggacacagcacacagcccggcgtccccagtccccgccgggacgaackgaagtgtcccctaaattcacgtggggagccctaacccccaatgtggctgtatttggagatggggtccccacgcctccagaacttgagaaaagacgtttctgtcgtgtgtaagtcaccctgtctgtggggttctgtcacagcggtccaggcgggggctgaccccgcttcccaccatacacacactaggcccctcagagactaagggtggaaacgtggacagcaaagcggcaaaacattttagaaggaattacagaagattttagtcaccgtgagtcacctgcacacatgagagacaaaggg

SEQ ID NO: 71179 - DNA, 601 bp, Human
caggggtcctccaggagcgcaggtcaaagaggcctcacggcagcgggcggctcagcccacccagccctcccaggatgcggcttggggtttgacagaggcctggtgacaccaaaggcccctccggccacagacgcgactcccagcaagcccgaggccaggctggggtcgtgcagcctgtgccccctccacactccacccacctgggcgccaggcctgggctccacaagaggcgcagacccccaggggcggccacactttcggcccctgtgcccctcagccctgagggggtcgggtgagcccycatgtggctctacccacgaagacagggcgcatcctgccctaaccagcctacggcaggtcctggctccaggagtccgtaggcctgacttgtcccctcgggggatgctctgcctgcccaacaaccctctctgaagagagaaagaaagagaagggtgtgaagcggcggagacggaggtactgtgggccacagagaaagtggcgcacagctgaggggccgagtcgagggacagacgcgcagccgggggcggaaccgagggacggacgcacagccgggggcggagccgagggatgagcgcacagc

SEQ ID NO: 71180 - DNA, 601 bp, Human
aagtcaggggtcctccaggagcgcaggtcaaagaggcctcacggcagcgggcggctcagcccacccagccctcccaggatgcggcttggggtttgacagaggcctggtgacaccaaaggcccctccggccacagacgcgactcccagcaagcccgaggccaggctggggtcgtgcagcctgtgccccctccacactccacccacctgggcgccaggcctgggctccacaagaggcgcagacccccaggggcggccacactttcggcccctgtgcccctcagccctgagggggtcgggtgascccccatgtggctctacccacgaagacagggcgcatcctgccctaaccagcctacggcaggtcctggctccaggagtccgtaggcctgacttgtcccctcgggggatgctctgcctgcccaacaaccctctctgaagagagaaagaaagagaagggtgtgaagcggcggagacggaggtactgtgggccacagagaaagtggcgcacagctgaggggccgagtcgagggacagacgcgcagccgggggcggaaccgagggacggacgcacagccgggggcggagccgagggatgagcgca

SEQ ID NO: 71181 - DNA, 601 bp, Human
cgtcctcagggcctcccagacactggctggactctcccgtgcctgccacatcctcggtgctcctggcatctcctctgcactgacctcccaggcagtatgatcagatgcctcctcctccaggaagtcctctgggctctccaggcaatgtccaggtcttcctagtgctgacctgctcatctcctggagcctagttcccaccacacccctcttcagtcactcaggagcttgtcctgcatcctcacctgtgttagccccaagaggaatgggagtccagacccactcttgccacatgacagggacygagcacacgcaggggcaggaggagtggctcacatgaacagaacttcctgatggtctagagggcagaccatgggagtagaaggaggggcaggtgacttgaggccgctccaggagacagaggtgccgtacacccagcggaggttgacacgtgaggccacgtggcaggtgagtgtggaatgcaaaggtagccccagggccaccgctcctgtgaggggctgtcaggggctctgtgtggagtcccgcagtggggacaggccctgtatacttccacgcacccccaagacactccctgtgtgggacc

SEQ ID NO: 71182 - DNA, 601 bp, Human
gggggagggtcacttatggtctgcacctgccatcggcagaatggacttttctcctcaaagctgcacagtgagaggccacaccctgtgctgcccggagccctggcccatgtcactgggtgggtagggttcactctgggctaatccgtcatgcagaatgacagaagagacagatacagaggaggccatgtggagacggaaacagaggtgagtggttcctctgccagcacaggaacaaggctgcccgcagctaccagtggctgcgggggaaggagggcgcagccctgcggcactgtaatgggtmacaccaggcgccgacttgactgggttgaaggatgcctagagaactggtgaagtattgcatctgggtgtgtctatgagggcgctgccctgagactggtatttgagtcagtggactgggagggcaagacccaccctcaatgtgggtgggcggtggcgtccaatcagctgccagtgcggctggggcaaagcaggcggaagcaggtgggagaagcagttttcctgggtcttctggctttcatctttctcccatgctggatgcttcctgccactcgtcctaccctgggacatcagattccaggtt

SEQ ID NO: 71183 - DNA, 601 bp, Human
agatctgcacagcttctaggtttcttctttttatttatttgagacggagtctcactctgtcgcccagtggcacaatctcggctcaccgcaacccccgcctcctgggttcaagtgattctcctgcctcagactcctgagtagctgggattacaggcacgtgccaccacgcctggctaatttttgtatttttagtacagatgggtttcaccatgttggccagatggatcttgaactcctggcctcaagcgatcacccatctcggcctcccaaagtgctgggattacaggcgtgagccactgcrccgggccctgtgatttttttttaacctcaatccacctgccgtttactgtgatgggagccagcagcctggattcctacccacctcaccccccattcctgggctgataattaaccaatcacctcctcaggatttactggaggatcccttccctcctctgcaagaagtgctcagccctgggccagctctgacccagcagttctgttccactgagtgggcttccctgccacccccggcaccatccttcatggaggaggcagcccctcctcacctccttcttcagaacctcgctggctctctccc

SEQ ID NO: 71184 - DNA, 601 bp, Human
caccggttctcagcttctcggtcccagcatttaccaaaagcctttgtgtaggagctcttcaattctaagtgtgagatgtctggatctcttctgggttttacgtgctacaaacccctttcctgtatgttttttgcatttaatttggaaactgaaaaaatctgaaaattctgtgtggctgagtctaaagaccctctggtcctcactgcccggtttttctccagagatctgcacagcttctaggtttcttctttttatttatttgagacggagtctcactctgtcgcccagtggcacaatctcrgctcaccgcaacccccgcctcctgggttcaagtgattctcctgcctcagactcctgagtagctgggattacaggcacgtgccaccacgcctggctaatttttgtatttttagtacagatgggtttcaccatgttggccagatggatcttgaactcctggcctcaagcgatcacccatctcggcctcccaaagtgctgggattacaggcgtgagccactgcgccgggccctgtgatttttttttaacctcaatccacctgccgtttactgtgatgggagccagcagcctggattcctaccc

SEQ ID NO: 71185 - DNA, 601 bp, Human
ctgaaacctccagctccctggttcaagccattcccctgcctcagcctaccgagtacctgggattacaggcacccaccaccacgcctggctaaatttttgttgtatttttagtagagacagtgtttcactatgttgaccaggctggtctcgaactcctgacctcaggcactccgcctgcctcggcctcccaaagtgctgggattacatgcgtgagccaccgcgcccggcctcctgctcatattttcaatcgcccattttcatgttttagacctgtcacacccttacctattctgatggttgragcctctgtctgggcttttaccagcttggactcaggatatcctgcttcccactgtgttttgtggttttccattgcgagctcagatgcctgatttatttatcatcaggaattctttgatgctggcttgaaaaggaattgcattggcctctgccagccacctgagggcactgcttggaccaaacctgacaggcactgctgctcatggatggcatcttctgatctcccttccccaccctcactctctatagcctcttctccagggacccaagtggtcactcctctgtccactcatgataaagg

SEQ ID NO: 71186 - DNA, 601 bp, Human
ggagtacagtggcatgttctcagctcactgaaacctccagctccctggttcaagccattcccctgcctcagcctaccgagtacctgggattacaggcacccaccaccacgcctggctaaatttttgttgtatttttagtagagacagtgtttcactatgttgaccaggctggtctcgaactcctgacctcaggcactccgcctgcctcggcctcccaaagtgctgggattacatgcgtgagccaccgcgcccggcctcctgctcatattttcaatcgcccattttcatgttttagacctgycacacccttacctattctgatggttggagcctctgtctgggcttttaccagcttggactcaggatatcctgcttcccactgtgttttgtggttttccattgcgagctcagatgcctgatttatttatcatcaggaattctttgatgctggcttgaaaaggaattgcattggcctctgccagccacctgagggcactgcttggaccaaacctgacaggcactgctgctcatggatggcatcttctgatctcccttccccaccctcactctctatagcctcttctccagggacccaagtggt

SEQ ID NO: 71187 - DNA, 601 bp, Human
gacccccaggccctcagccctatcagtggggctgaagaggtggccacagggacatgtggcccagggcctgggcccatccttcctgatcagtgccctccctcaggggaaggaaggtaaagcgaatgcagctaatgcctgccaagagctcccaaaccggcaggcacacattattagaaataattattagaaatacccaggagaaaggcgctccgaggaagaacagaagcctctgcctcccgcaagctacacctggcaaggaggtcggggtggaggaggcggttccttgggaggtgctgttctktgcggcaaaatggattctgctttttttttttttttttttttgagacggagtctggctctgtcgcccaggctggagtgcagtggcacgatctcgactcactacaagctccacctcccgggttcacgccattctcctgcctcagcctccccagtagctgggactacaggcgcccgccaccacgcccagctttttttttttttgtatttttagtagagacggggtttcaccgtgttagccaggatggtctccatctcctgacctcgtgatctgcccgcctcagcttcccaaagtgctgggatt

SEQ ID NO: 71188 - DNA, 601 bp, Human
aagcccggaggaggccccagggcagcgcgttcccgggcccccgggccccatgagaagcggcacctacctcgtcatcatgcaccagctctttcttcaccactttcatggcgtaaatttggtcattcttcttcaaccgcaccaggagaaccttggcgtagctcccgcgcccgatgactctgattaggtcaaagtcctgcagcccaagcccctgagagattttgattccatccatcccatcgataactggcttaaggtcctagggagggagaacaagaccccagaaagtgagaggggggttccygggagactcagaggaccacgcatcactcatgcggtcccaacagagacctgctcctcagagcccagggcctcatgattcgagtctcagttctgcgtcccacatatcccacccccaaactcccatctaaactggggcatgaaaggtaagaatttaaggctgtgtgcttctgaggaaggtgctagaaagctagaagctgttcgttccacagaccatggctctggtcacagctgcaggtgggagggacccccaggccctcagccctatcagtggggctgaagaggtggccacagggacatgtgg

SEQ ID NO: 71189 - DNA, 601 bp, Human
atacccatcttcaccttttctaagcttagacacgtgagtgctctcgtggtggtcccctcactgcctgcagtgtgcagtgcactaacagccgtacgggcttgcagcctgggagcaggagctgcactgtgcatcttggctgtggagttggctgtgctgtttgggtttgtggagtgcacactgtgatgttcacacaacagtgccattacctaaccaggcactttccagaacacatcctggtcgttacacgatgcatgactattgattttgcacaaactccgtcaacgtgaggctaggtctctcrtgcatggattaattccgctaaagcccggaggaggccccagggcagcgcgttcccgggcccccgggccccatgagaagcggcacctacctcgtcatcatgcaccagctctttcttcaccactttcatggcgtaaatttggtcattcttcttcaaccgcaccaggagaaccttggcgtagctcccgcgcccgatgactctgattaggtcaaagtcctgcagcccaagcccctgagagattttgattccatccatcccatcgataactggcttaaggtcctagggagggagaacaagacccca

SEQ ID NO: 71190 - DNA, 601 bp, Human
agtctgctggaaggcaacgtatcagtggttggccatacatgagaaggttgcagagaccacgatacccatcttcaccttttctaagcttagacacgtgagtgctctcgtggtggtcccctcactgcctgcagtgtgcagtgcactaacagccgtacgggcttgcagcctgggagcaggagctgcactgtgcatcttggctgtggagttggctgtgctgtttgggtttgtggagtgcacactgtgatgttcacacaacagtgccattacctaaccaggcactttccagaacacatcctggtcrttacacgatgcatgactattgattttgcacaaactccgtcaacgtgaggctaggtctctcgtgcatggattaattccgctaaagcccggaggaggccccagggcagcgcgttcccgggcccccgggccccatgagaagcggcacctacctcgtcatcatgcaccagctctttcttcaccactttcatggcgtaaatttggtcattcttcttcaaccgcaccaggagaaccttggcgtagctcccgcgcccgatgactctgattaggtcaaagtcctgcagcccaagcccctgagagattt

SEQ ID NO: 71191 - DNA, 601 bp, Human
cctaacaagggtgatgacatcctaaaactcaaccgcagtctgctggaaggcaacgtatcagtggttggccatacatgagaaggttgcagagaccacgatacccatcttcaccttttctaagcttagacacgtgagtgctctcgtggtggtcccctcactgcctgcagtgtgcagtgcactaacagccgtacgggcttgcagcctgggagcaggagctgcactgtgcatcttggctgtggagttggctgtgctgtttgggtttgtggagtgcacactgtgatgttcacacaacagtgccatyacctaaccaggcactttccagaacacatcctggtcgttacacgatgcatgactattgattttgcacaaactccgtcaacgtgaggctaggtctctcgtgcatggattaattccgctaaagcccggaggaggccccagggcagcgcgttcccgggcccccgggccccatgagaagcggcacctacctcgtcatcatgcaccagctctttcttcaccactttcatggcgtaaatttggtcattcttcttcaaccgcaccaggagaaccttggcgtagctcccgcgcccgatgactctgatta

SEQ ID NO: 71192 - DNA, 601 bp, Human
gaccgtttccaaaaaaaaagatttcaacaaataaaccattgatcctataatcaacaaacttctcccctagaaacagctggtgtgggaagatctgctacacagagccacggcagctcagcatgtactgcaaagctggggccttgtgcaggacggagcagggcagtgcctctgggcagcttcctgtcccaccccatcacccgtccagttcagctcaaccccagagatttcctaacaagggtgatgacatcctaaaactcaaccgcagtctgctggaaggcaacgtatcagtggttggccatayatgagaaggttgcagagaccacgatacccatcttcaccttttctaagcttagacacgtgagtgctctcgtggtggtcccctcactgcctgcagtgtgcagtgcactaacagccgtacgggcttgcagcctgggagcaggagctgcactgtgcatcttggctgtggagttggctgtgctgtttgggtttgtggagtgcacactgtgatgttcacacaacagtgccattacctaaccaggcactttccagaacacatcctggtcgttacacgatgcatgactattgattttgcacaaactcc

SEQ ID NO: 71193 - DNA, 601 bp, Human
ctctgtatctcaatatgctaaaagccgcctaactgtacactttgtttgcatattttattattttttaaagacagagtctcatttggtcgcccagactggagtgcagtagcgtgatctcggctcactgcaatctccgcctccctggttcaagcgattctcctgtctcagcctctgagtagctgggattagaggtgtgcgccaccacacctggctaatttttgtatttttagtagagttggggtttcaccatattgttcaggctggtcttgaactcctgacctcaggtaatccacctgtctcrgcctcccaaagtgctgggattataggtgtgagccaccgcgcccggccctaactgtacactttaaaatggcaaattctatgtcatgtgtattttactttaattaaaagaaaaaggtctatgaagtcagaattaagatttcaacaaacaggccaggcatagtgactcatgcctgtaatcccagcactctagcaggctgaggggggcagagtgcatgagcgcaggaattctagaccagcctgggcaatatagtggaaccccgtctctacaaaaaacacaaaaaatagctgggcatggtggtgc

SEQ ID NO: 71194 - DNA, 601 bp, Human
cccagccccagctctgccctcccagccccgagcatggctggcgaggagggaccccctctgtggcccatcggggctcgacgagcagccagttgccttctgtgctagcagcacttggtgacaacagcattactgccacccacacgttggccttttatctaatcctgagagacgcaacctgcattcaggaatgaaagcaaaagaccaaaaataccagaagccaacaggtgcatgaaagatgctgaacactgtcagtcatcagagacatgggagtcaaagccaccactgcacacctgccaggatrgcgatcatcacaatcacacgcgtcactgaggacctgcagaaacaggcccgtgtggtgttggcggggaggtgaaacggcgcggctgcgtgggaagcagcctggcaggtccccatcagttgaacagagaactaccatgtgacccagcaactgtactgctaggtttgcactcaaaagaactggaaatagactcaaacagattcttgtacgcgaaccttcacagtggcaccactcacaacagccaagggtgggaacactataatgccccttggcaggtgcacgcacaaacgtggggcctccact

SEQ ID NO: 71195 - DNA, 601 bp, Human
gtggggagaaagaaatttctagaaaccatccaagcattcaacaactcctgcaatcaggctcttctcgaaagacaaccccagagtccccacctcggcatcccggcccacagaggatgatttcaagacagaacaaaaccgcagcagcgactcttccaaatgtcttttctcagggtcccgcaaacctgctctcatacgtggcattaactttccagctgaccgggacgtgctgcaaagggggctggaatcctcctgtgctgccgctggccagcagcggggctgtcagcagggcaccacacctctyggggcctctgttcctcggcgcagggcatggacgctgccacccacttttgagttctgcacccagggatgaggggccagttggacagcctgtgcactgcacagacacgccctgctgggaggtagtagaggctcagccccagccccagctctgccctcccagccccgagcatggctggcgaggagggaccccctctgtggcccatcggggctcgacgagcagccagttgccttctgtgctagcagcacttggtgacaacagcattactgccacccacacgttggccttttatctaatcctgag

SEQ ID NO: 71196 - DNA, 601 bp, Human
tcaccactacctcaccatcatcaccatcatcaccatcatcgtcaccatcatcgtcaccatcatcatcaccatcatcttcaccacgatcaccaaagctaccagctctggttgtatgctggcctctggtggtatactggcctctggcctccaggctttgccctaacagttccaggaggcaggtattattatctccagttaggacacaaggaaattgaggtggagggctaagcagattccccaaggtcccagcgctaccgagtgataagcccacacccatcaccagagcactagcttcagccayaggactgtcaccctcccaattcatgctgcagttcagcaaaatgctgcaaggtcaaagtcaactttagagtgacaaagatccaacagcttggtctcatcttgaccccagaaagtagagctggacgaagttctcaagccttcctaggtcaaccccttgtcttcggggttagaaaaatgacagtgaaagaaatgcgtcaaaataggctggatcacaggggtgcgattactgctcactgcagcctcgacctctggagctccagcgatcctcccacctcagcctccagaggagctgggactacag

SEQ ID NO: 71197 - DNA, 601 bp, Human
aggcaggagcccaggagtttgagaccagcctggggcgacagagcaagaccctatctttatttaaaaaaaaaaaaaaaaaaactctggaggcggggctcagtcactcatgcctgtaatcccaacactttgggaggctgcagagggcagatggcttgaggtcaggagttcgagacccgcctggccaacacagagtactaaaaatacaaaaattagccaggtgtggtggcaggtgcttgtaatcccagctactcaggaggctgaggcaggagaattgcttgaacccaggaggtggtgactgcartgagccaagatgttgccactgcactccagcctgggtgatagagcgagactccatctcaaaaacaagaaaagcacattaaaaaaaaaaagctttggaataagagctgcttgctgtgcccaaactgtgtgtgcctgaacaggatgccttatgctcgtgatggtgaattcaacggtcaccttgactgggcacgggacgccctagtagctggctgtacatgacttccgggcatgcctgttgagggggcttctggaagagtaagcagacggccctccctgaagtagactggcatcatccaggccc

SEQ ID NO: 71198 - DNA, 601 bp, Human
ggagagcaagtcgccagatgtacagctaagaaccgagcagcagagggttgcacccagggcctaggaccgctgtgcttaggaagcctggcccgcaaagctggcccggagctggggctgggaacgtgaactgcaaacagttccctacacggatataacatgcttctgcatgaccgccaggcagagtggtggacacctgtaatcccagcactttgggaggctgaggcaggagcccaggagtttgagaccagcctggggcgacagagcaagaccctatctttatttaaaaaaaaaaaaaaaaaaactctggaggcggggctcagtcactcatgcctgtaatcccaacactttgggaggctgcagagggcagatggcttgaggtcaggagttcgagacccgcctggccaacacagagtactaaaaatacaaaaattagccaggtgtggtggcaggtgcttgtaatcccagctactcaggaggctgaggcaggagaattgcttgaacccaggaggtggtgactgcagtgagccaagatgttgccactgcactccagcctgggtgatagagcgagactccatctcaaaaacaagaaaagcacattaaa

SEQ ID NO: 71199 - DNA, 601 bp, Human
aagactccgtctcaaaaaaaaaaaaggcaaaaaaatcagacatgcataggaattattcccaactgtgaatgccgaatgctcccacaggacagtgattggtgccgctgcggggatcccacagacaccccacagacgacaattctttaagttcaggtttacgcatctgggaacttgtgacttgacagaagagtccaaagacacaagtgcagaaggggctgagctttgggccactcaggggaagtgagggtgggatatcggaccccttatacatctacatccctacaagttcacatatgaagamgaaccaaagcaaaacaaaacccttcttggaacctcaccatttaggaagtgtggggggccgggctgccttcccctgggcgtattcccaaatcgcaagggatggcagtcagggcggaaagaggcctggaaaagcgcaatgggaatgcacaaagggaggcattgactcactccgggaagcaggggagcagaaggaaaggggacagagccgtcaggcgcaggcggtgcgggcgagggcgccacgctgaagcacacgatggggcactggggcctggtcaccacaagcctcgtccacacgcacagg

SEQ ID NO: 71200 - DNA, 601 bp, Human
gagaagcgcttccacagataagcaaaggtgtgtgtttgttctttttaaagaaacattgagtgtgaatgaatgtaaaataatcaaccgtggcaaacagtaagagattttattttagaacagcgagtgaatgggcgtattttaagggtagtttgctcacctaccatctgagatcaccgtgccttagtgagaaagtgtcctccgactccagttgaatggggcgggggacgctgaaagtagtcatttcagctaaatctctagttacctggttttcctgaaatagcttaaactgaagcgatttctygttttggagactttatggctcatttcaattttggctgctgtctggaaaaggtgggctgtctgtgtagatatggggtatggtttgtccataaagcaggtgcttattgtgtcttaaaactgcgaatgaattgtttctctccatctggacacacgaggtgagactaatgttgaactgtaacattcaggaattccctgtagccgcccagtggacacgaacatggccggccagaagaggcaagaccagatttggggtggaaagaaagcaattctgattcttccccactcacagaccctttatggg

SEQ ID NO: 71201 - DNA, 601 bp, Human
agagaggaagatgaacagagacggcacgacctggttgcagcggctgaggtgggtgatgctgccccacctgcagatgctaaccctgtgcatccaaagccccagaaaaccacctgaaagttactacaaggaagaactcagaagccatgaaagttactacaaggaagagaactcagaagccatgaaagttactacaaggaagagaactcagaagccatggggcccacagttaccacgcagagaccaagctgcctgctgctggatgctctgagagaagaaaaaatacctcgtttataacagaaaygagatgaaacactcaagacaaaattaaacaaggaagtggccaggcaccgtggctcacgcctgaaatgccagcactctgggaagctgaggtgggagaatcgtttgagcccaggagtttgagaccagattgggcaacatagcaagacccccatctgtaaaaataataataataataattagacaaggaagtgaagaaaaccacatgaagacttcaagagtctcctgaaagaggatgtgagtgaatgaaaaggtaaaccgggttcctgaatgggaagatccaacacttagaaggatgtcaatt

SEQ ID NO: 71202 - DNA, 601 bp, Human
tcattgccagggcctttgccagcaggtgtcctcagagaccagatgatgggcccaggaactgggagggtccgttcccgtctccaacagctcaggcagggacagctcctctgtgggctccagaacccagttccacggctgcaggcagagcccctgtctctcctctcccctgtggccctcccaacaccctttgcacatgccagggcaaatgctgcctgcccgagatgggtaaatgcttccgttctgccttgaggatggcactgcgcttccggtgcaaagtgttccagctggggtcaggaataggacagggccgtccagtgtcaacgtcaccccagtgaggcaggtgctggccactgtcaccagagaggaagatgaacagagacggcacgacctggttgcagcggctgaggtgggtgatgctgccccacctgcagatgctaaccctgtgcatccaaagccccagaaaaccacctgaaagttactacaaggaagaactcagaagccatgaaagttactacaaggaagagaactcagaagccatgaaagttactacaaggaagagaactcagaagccatggggcccacagttaccacgcagagacca

SEQ ID NO: 71203 - DNA, 601 bp, Human
ataccagcagctacattacgatgacaccattcattccaggaggccctaaggagtaaaaatcgtaacaatgatctccacaaatggcaaggaggcccctgcacaacttgcagtgttcttcttttttttttcttttttttgagatggagtctcgctctctcgcccaggttggagtgcagtggtgcaatctccgttcactgcaagctccgcctcccgggttcacgccattctcctgcctcagcctcccaagtagctgagactacaggcacccaccaccacacctggctaatttttttttttttttgtatttttagtagagacggggcttcactgtgttagcgaggatggtcttgatctcctgacctcgtgatctacccgcctcggcctcccagagtgctgggattacaggcgtgagccaccgcacccggcctcagtgttttttcttgatagcaaaacagaaatgggtggaaagtcccttaataggacaagtcacacctctgcatgcagttatcggtcatcttctctcagcttcacgctgctgctcagcctttctagaaccttctcccagtggctgggggctgagaggctgtatgtatcattgcca

SEQ ID NO: 71204 - DNA, 601 bp, Human
ccccaggaatctaaggatggttcaataccagcagctacattacgatgacaccattcattccaggaggccctaaggagtaaaaatcgtaacaatgatctccacaaatggcaaggaggcccctgcacaacttgcagtgttcttcttttttttttcttttttttgagatggagtctcgctctctcgcccaggttggagtgcagtggtgcaatctccgttcactgcaagctccgcctcccgggttcacgccattctcctgcctcagcctcccaagtagctgagactacaggcacccaccaccacrcctggctaatttttttttttttttgtatttttagtagagacggggcttcactgtgttagcgaggatggtcttgatctcctgacctcgtgatctacccgcctcggcctcccagagtgctgggattacaggcgtgagccaccgcacccggcctcagtgttttttcttgatagcaaaacagaaatgggtggaaagtcccttaataggacaagtcacacctctgcatgcagttatcggtcatcttctctcagcttcacgctgctgctcagcctttctagaaccttctcccagtggctgggggct

SEQ ID NO: 71205 - DNA, 601 bp, Human
atggactgtgcagccacactgcagagtcccccgacagtcacagtgtggccccacggagctcaggcctgcttgctttaagtccatcagttaaaacttcccatgggaaacctgtgtgcagaacaccctggacccaataaagggtccctgtctctctttacgctccctggcctcccagcaggttgtgtacccccaaggcctgtgggtgacaaaaggtgtgtttccatcctgtgtctcccttgatcactggagcagtagctctgtgtcctgaagattctaaactaaaacaatatgaatatcaacmaaaaaaaatcctaaataaaatatcagcaaattgaattcagaagcacattaacagagtagcacactaagacagggcacggttttccccaggaatctaaggatggttcaataccagcagctacattacgatgacaccattcattccaggaggccctaaggagtaaaaatcgtaacaatgatctccacaaatggcaaggaggcccctgcacaacttgcagtgttcttcttttttttttcttttttttgagatggagtctcgctctctcgcccaggttggagtgcagtggtgcaatctccgttc

SEQ ID NO: 71206 - DNA, 601 bp, Human
tctaagctggactttctcccaccagaagcagggctgtcgccctgacagtttccagttccacatcccccattcctcgagctggcccatccagacacccaccctatgcaactgccccctggtgacttccctgcagccccactgataccacacccaacatggactgtgcagccacactgcagagtcccccgacagtcacagtgtggccccacggagctcaggcctgcttgctttaagtccatcagttaaaacttcccatgggaaacctgtgtgcagaacaccctggacccaataaagggtccccgtctctctttacgctccctggcctcccagcaggttgtgtacccccaaggcctgtgggtgacaaaaggtgtgtttccatcctgtgtctcccttgatcactggagcagtagctctgtgtcctgaagattctaaactaaaacaatatgaatatcaaccaaaaaaaatcctaaataaaatatcagcaaattgaattcagaagcacattaacagagtagcacactaagacagggcacggttttccccaggaatctaaggatggttcaataccagcagctacattacgatgacaccattcattcca

SEQ ID NO: 71207 - DNA, 601 bp, Human
atctaagctggactttctcccaccagaagcagggctgtcgccctgacagtttccagttccacatcccccattcctcgagctggcccatccagacacccaccctatgcaactgccccctggtgacttccctgcagccccactgataccacacccaacatggactgtgcagccacactgcagagtcccccgacagtcacagtgtggccccacggagctcaggcctgcttgctttaagtccatcagttaaaacttcccatgggaaacctgtgtgcagaacaccctggacccaataaagggtccgtgtctctctttacgctccctggcctcccagcaggttgtgtacccccaaggcctgtgggtgacaaaaggtgtgtttccatcctgtgtctcccttgatcactggagcagtagctctgtgtcctgaagattctaaactaaaacaatatgaatatcaaccaaaaaaaatcctaaataaaatatcagcaaattgaattcagaagcacattaacagagtagcacactaagacagggcacggttttccccaggaatctaaggatggttcaataccagcagctacattacgatgacaccattcattcc

SEQ ID NO: 71208 - DNA, 601 bp, Human
tttctccatcaaagataaaaggccagaaagtgcccaggaaatgcactcgagcactggagggcagtgtgtcccagcgacaatggggctcacgtgcaaaggcaaacacgggtgtcctcaacatgaaaggacgcatgggaggcagcccctcaccttcctggagccaggagacacggcctggggtgaagttgagcagaggagaaggcaaggcagggtgcagccgtgggactgggtgagaacacccagcctcggcagggtaaagctcacaacatcacgaaagccagggcggagcgaggcagctgcsctccacgacacccaaggcccggcaatcgcacagggatcccgccaagaggtaataacgcaatttagaatgttcccgggaattgaaaaattaggaaaatttaaaaatccaatgaagcttgcacaagaaagggaagctagagatcagacgccagagtgtgcagggaacgctcatggttttaggctgcctcggcatccattctggatctaagctggactttctcccaccagaagcagggctgtcgccctgacagtttccagttccacatcccccattcctcgagctggcccatccagacaccca

SEQ ID NO: 71209 - DNA, 601 bp, Human
aaatcagattcctgactcggagagcaggacggacattaaagctctgaggaagacaccagcagatgaggaaaggcggtaaagctgaatccacagaaggattttacttcgtccaaagaaatctactggtggggatgctggcaggcctcggatttctccatcaaagataaaaggccagaaagtgcccaggaaatgcactcgagcactggagggcagtgtgtcccagcgacaatggggctcacgtgcaaaggcaaacacgggtgtcctcaacatgaaaggacgcatgggaggcagcccctcaccktcctggagccaggagacacggcctggggtgaagttgagcagaggagaaggcaaggcagggtgcagccgtgggactgggtgagaacacccagcctcggcagggtaaagctcacaacatcacgaaagccagggcggagcgaggcagctgccctccacgacacccaaggcccggcaatcgcacagggatcccgccaagaggtaataacgcaatttagaatgttcccgggaattgaaaaattaggaaaatttaaaaatccaatgaagcttgcacaagaaagggaagctagagatcagacgccag

SEQ ID NO: 71210 - DNA, 601 bp, Human
gtgacagcaccgtcattacagggcacgctggaaaatcagattcctgactcggagagcaggacggacattaaagctctgaggaagacaccagcagatgaggaaaggcggtaaagctgaatccacagaaggattttacttcgtccaaagaaatctactggtggggatgctggcaggcctcggatttctccatcaaagataaaaggccagaaagtgcccaggaaatgcactcgagcactggagggcagtgtgtcccagcgacaatggggctcacgtgcaaaggcaaacacgggtgtcctcaacrtgaaaggacgcatgggaggcagcccctcaccttcctggagccaggagacacggcctggggtgaagttgagcagaggagaaggcaaggcagggtgcagccgtgggactgggtgagaacacccagcctcggcagggtaaagctcacaacatcacgaaagccagggcggagcgaggcagctgccctccacgacacccaaggcccggcaatcgcacagggatcccgccaagaggtaataacgcaatttagaatgttcccgggaattgaaaaattaggaaaatttaaaaatccaatgaagcttgc

SEQ ID NO: 71211 - DNA, 601 bp, Human
tgttaacgcacttgaccccatcaccaggaagtaagttcagctctcgccattttacagatggggaagccgaggcacagacaggttaggggacgttctccggctcacacagctcctggcttgtcagacccaacatcagatgactcgggcgggcccagaaccctcacttggaaaccccacttccaggtcctgtccccacctcacagcggacatcacagcggtgacagcaccgtcattacagggcacgctggaaaatcagattcctgactcggagagcaggacggacattaaagctctgaggaaracaccagcagatgaggaaaggcggtaaagctgaatccacagaaggattttacttcgtccaaagaaatctactggtggggatgctggcaggcctcggatttctccatcaaagataaaaggccagaaagtgcccaggaaatgcactcgagcactggagggcagtgtgtcccagcgacaatggggctcacgtgcaaaggcaaacacgggtgtcctcaacatgaaaggacgcatgggaggcagcccctcaccttcctggagccaggagacacggcctggggtgaagttgagcagaggagaaggc

SEQ ID NO: 71212 - DNA, 601 bp, Human
gggacgtcacactgtgggggacatgatgccctctgccatcctacctggacttccctcccttgagctccctgctgacccctggagaaggtccccggccccctccacgtgcaccccgccccccccgcccccgtcataccccctccgtgcacaccccacccagccacctcccctctgcgcacacccacccggccccccaactccgcgcgcacccacccgtcatccctctgtgcgcacccacccagccccccaacaccgcacgcacccacccatccccaactccgggcgcacccacccggccccstccacgcgcacccacctggcgtgctcctcagggagcttcctctgcctctgcatgtggaacatcaggtccccgccgttgacgtactcaatgaccaggaacaacctgcagggagagaggcgccggaggctgcagtcacctcggcagacggcggcctccttagacagaagccccacagaagcggccttcgtgggcccgaaccctcccgcaggttcagtcttgcaaagagcaaagagcagcaggagcaccctggcagcagagaggggctggtggggacgggctgcggggccgctcgtgaagggt

SEQ ID NO: 71213 - DNA, 601 bp, Human
cctggtgaggacttgcctgtgttgtgtgccatttgcccagtgccgcccagactctgactctgagcaagagctttgggagctcagccttggggccccggagcccctcccttcctacagcccagcaatatctataacccggagtcccgccgggtcctccctgggcctcctggttacatgcgctggcacgtgtcgtaggatcggacgtgaaccagcagctccccttcctcagccccaagatcgcaggtacacgggtgcctctgcaggctggccaccagagggcaccgcggagacagccgcgttyccagatcccacatccccacagcactgaattccagaccaggagcaggtcccggggcctccaggtgggaaggagcccatgatggtggctgtgggttttgggggtgggggctgtgctttcagctcggtacagcctcggtcaaggacatgctggggctccagcatgtgctgctggccagggcaggagggagttggagctgaatggggacaggttctctttcctgctgacccacaggtgtggtaaccccaccccacggcccggggagtggcatgtgacacagggtctggccaggaggaatggttc

SEQ ID NO: 71214 - DNA, 601 bp, Human
gccggctccttgcgcagcacacaacgtggctgggttcctcccaccgagctcccaggaacgtgcctgtcgcacgtgggaaagtcctgaggctcccaccacacgaagcattagagtccttgctcctccctggggcctcccaccagcagccctgggcccggggtgggaggagcaaaccactcctggccctgaggcagaatctccccagcaacatgggcagcaaatgactctcaagagaatcggctgtcaccacgcaaacgtttccatccagggggagatgagttagcgcagcaccgcccggccrtgtgggacacgtggggttgggcagcaggtggtggctcagctgttaactcaccaccacctttcacatcagtggggagctgggaccatgctgggaaatccatcgcttcaaatctcagactcctgatagtcactagcacagatcacgtgatccacaaatactcaggctttgcagtgtgccaagtaccggggatcctgcggggatggggaccctcttagagtggcagccccagccaccaggccaggacgtgctgtctggacccagttccttcagaatgagcctgtccatcactcaaagctcacc

SEQ ID NO: 71215 - DNA, 601 bp, Human
ctgccttctacacactccaggcttgagaattttacggccacacaggttggccctgggtagtggagctggcaccagcccagctgtggggcttgtccctctccatgaggtcacagctgtgatccccacttctgacggcctccactgctccacgtctcccataaccgcctccctcctgctcccacccgctgcccagacccagccatctctctgtgggcctcctgtcacctgccctcctctgcgtctttccgttttcccctccctgccgccggctccttgcgcagcacacaacgtggctgggttyctcccaccgagctcccaggaacgtgcctgtcgcacgtgggaaagtcctgaggctcccaccacacgaagcattagagtccttgctcctccctggggcctcccaccagcagccctgggcccggggtgggaggagcaaaccactcctggccctgaggcagaatctccccagcaacatgggcagcaaatgactctcaagagaatcggctgtcaccacgcaaacgtttccatccagggggagatgagttagcgcagcaccgcccggccgtgtgggacacgtggggttgggcagcaggtggtggct

SEQ ID NO: 71216 - DNA, 601 bp, Human
cagctagaggccccacgcctgccctgtgccacgcagcatggggtggacagaggggttcgcgggtggccaggccagggcactgctgccttctacacactccaggcttgagaattttacggccacacaggttggccctgggtagtggagctggcaccagcccagctgtggggcttgtccctctccatgaggtcacagctgtgatccccacttctgacggcctccactgctccacgtctcccataaccgcctccctcctgctcccacccgctgcccagacccagccatctctctgtgggcctcytgtcacctgccctcctctgcgtctttccgttttcccctccctgccgccggctccttgcgcagcacacaacgtggctgggttcctcccaccgagctcccaggaacgtgcctgtcgcacgtgggaaagtcctgaggctcccaccacacgaagcattagagtccttgctcctccctggggcctcccaccagcagccctgggcccggggtgggaggagcaaaccactcctggccctgaggcagaatctccccagcaacatgggcagcaaatgactctcaagagaatcggctgtcaccacgcaaa

SEQ ID NO: 71217 - DNA, 601 bp, Human
gaagggacatctgagaaatagcctgggggaggtgagggctggagcctggggagggcacagctgtgcaaaggccccatagtgggtgcgtgccttgtgcgctgggggccacagaggggccccatgagacccgagtgaaggggctgagggggaggaggcttttggacacaggacgaccctgctgtccgtagggccaggcaggatgctggtggcttggtggaggtggcgggggtggggtggggagaagcagcagggctggggggctgggctaggccccgcatggcagagcatggtcaggcacagratggacgagccccacgtgctgggcagggcctggaggcgtccaaggggacagcacgccagggtccactttggccatactagccggccacatggaaacatcctggagccagttcttggcaatgatgagaggaggtccctgagaccaccctgcactgttggggtgatgacggtgagccctgccaccggatgcagggctgggcccaggaggtagtgccctgggggcagcatgggactcccaggctcctggtgcccaaaccacaggaaacgcccagagagccctggggtggcagcacagcagcgg

SEQ ID NO: 71218 - DNA, 601 bp, Human
gacgctgtggcagtaacaggtgttgcccctgtggctgcaaccacagcagtgacctgagatacaacagggggcccgttccgtgtcaatggggctgggggcccaagggctctagttctgaagggacatctgagaaatagcctgggggaggtgagggctggagcctggggagggcacagctgtgcaaaggccccatagtgggtgcgtgccttgtgcgctgggggccacagaggggccccatgagacccgagtgaaggggctgagggggaggaggcttttggacacaggacgaccctgctgtccktagggccaggcaggatgctggtggcttggtggaggtggcgggggtggggtggggagaagcagcagggctggggggctgggctaggccccgcatggcagagcatggtcaggcacaggatggacgagccccacgtgctgggcagggcctggaggcgtccaaggggacagcacgccagggtccactttggccatactagccggccacatggaaacatcctggagccagttcttggcaatgatgagaggaggtccctgagaccaccctgcactgttggggtgatgacggtgagccctgccaccg

SEQ ID NO: 71219 - DNA, 601 bp, Human
cttttcccaccgccgccccctgcgcccaacccatggacgtcctggcctctcagagcagtgcgtttgaatgcacgctggccccaggtcggacgctgtggcagtaacaggtgttgcccctgtggctgcaaccacagcagtgacctgagatacaacagggggcccgttccgtgtcaatggggctgggggcccaagggctctagttctgaagggacatctgagaaatagcctgggggaggtgagggctggagcctggggagggcacagctgtgcaaaggccccatagtgggtgcgtgccttgtgygctgggggccacagaggggccccatgagacccgagtgaaggggctgagggggaggaggcttttggacacaggacgaccctgctgtccgtagggccaggcaggatgctggtggcttggtggaggtggcgggggtggggtggggagaagcagcagggctggggggctgggctaggccccgcatggcagagcatggtcaggcacaggatggacgagccccacgtgctgggcagggcctggaggcgtccaaggggacagcacgccagggtccactttggccatactagccggccacatggaaac

SEQ ID NO: 71220 - DNA, 601 bp, Human
gtgcctgacaccttttcccaccgccgccccctgcgcccaacccatggacgtcctggcctctcagagcagtgcgtttgaatgcacgctggccccaggtcggacgctgtggcagtaacaggtgttgcccctgtggctgcaaccacagcagtgacctgagatacaacagggggcccgttccgtgtcaatggggctgggggcccaagggctctagttctgaagggacatctgagaaatagcctgggggaggtgagggctggagcctggggagggcacagctgtgcaaaggccccatagtgggtgygtgccttgtgcgctgggggccacagaggggccccatgagacccgagtgaaggggctgagggggaggaggcttttggacacaggacgaccctgctgtccgtagggccaggcaggatgctggtggcttggtggaggtggcgggggtggggtggggagaagcagcagggctggggggctgggctaggccccgcatggcagagcatggtcaggcacaggatggacgagccccacgtgctgggcagggcctggaggcgtccaaggggacagcacgccagggtccactttggccatactagccggc

SEQ ID NO: 71221 - DNA, 601 bp, Human
cgtagcagggggctcccaggaaggtgagatacagcacctaagggggtcaggacaggcattgggagatgccctggctgccctgtgggctctgccaggcttggccccacagcctgaatctccctctgtgcaatggggaggagcggcagtgcctggtagagaggacagaagcgggccccaggccaggctcatggaacaaccttgccgaccgctggagcccgggatagggtggggaccgcccctcctccagccctgatgacgctgcctggcagcgcggagccctgggaactggaactctgccctygccagggaccccacaccccacacctgggagcattgagcccactgggcagacaacctgccggcccccctgctggcctaggttggacctgctgacccctgaagagccagcaggggcagccagggatgggccccagaggctcacaagccagacagtgggtgacaggctgatcagggccacatcggggagggtggctctgccgtggcctcgttcctgggctggctgatgggcagtcgggggcccctgatggggatagtggctggacaggcaggagtgccacatgagcatggagagtatccccac

SEQ ID NO: 71222 - DNA, 601 bp, Human
gtcctccttgcaggacggcagagctggggcgtagcagggggctcccaggaaggtgagatacagcacctaagggggtcaggacaggcattgggagatgccctggctgccctgtgggctctgccaggcttggccccacagcctgaatctccctctgtgcaatggggaggagcggcagtgcctggtagagaggacagaagcgggccccaggccaggctcatggaacaaccttgccgaccgctggagcccgggatagggtggggaccgcccctcctccagccctgatgacgctgcctggcagcgyggagccctgggaactggaactctgccctcgccagggaccccacaccccacacctgggagcattgagcccactgggcagacaacctgccggcccccctgctggcctaggttggacctgctgacccctgaagagccagcaggggcagccagggatgggccccagaggctcacaagccagacagtgggtgacaggctgatcagggccacatcggggagggtggctctgccgtggcctcgttcctgggctggctgatgggcagtcgggggcccctgatggggatagtggctggacaggcaggag

SEQ ID NO: 71223 - DNA, 601 bp, Human
gacagcatccacaggccaaggactgctgccagggcgccctgccaggctgaacccctggctcagccaaacgaggtgcccagaggtacccagcatggaggacctgaggccgggagggacaccaagggacggcagagctgcgtgtgggacgagggcttgcaggaaggtcctgggagggcttcgttgatgggagaaaccagccttctgcccagatgggcaggacgccgagcttgcactgtcagttccagggcagggtcccgcaggcaggtcctcgccccacgtgcccacccagacacccacccckcaaacgggtttcccatctgtgcaaaccaggccattccaatggcagaggcaggtagggtgagagccccacttcttcaggtactggtggaggtggggtacaagctgggcctgggcccctcctgagggcagcctcacctgccacctgtgcccccacatcctcagcccaagtagacaggtgctttcacaagaggggaggggcatggaactgggcatgcaggttgaggtgtgagccccaaatcccagcctacatgcatgaacccccaaagcactccagcttcctcttctgttcatggctagccca

SEQ ID NO: 71224 - DNA, 601 bp, Human
gctgagaggggtacgtggaggccgggacaccatccacgggccaggacagcatccacaggccaaggactgctgccagggcgccctgccaggctgaacccctggctcagccaaacgaggtgcccagaggtacccagcatggaggacctgaggccgggagggacaccaagggacggcagagctgcgtgtgggacgagggcttgcaggaaggtcctgggagggcttcgttgatgggagaaaccagccttctgcccagatgggcaggacgccgagcttgcactgtcagttccagggcagggtccckcaggcaggtcctcgccccacgtgcccacccagacacccaccccgcaaacgggtttcccatctgtgcaaaccaggccattccaatggcagaggcaggtagggtgagagccccacttcttcaggtactggtggaggtggggtacaagctgggcctgggcccctcctgagggcagcctcacctgccacctgtgcccccacatcctcagcccaagtagacaggtgctttcacaagaggggaggggcatggaactgggcatgcaggttgaggtgtgagccccaaatcccagcctacatgcatgaa

SEQ ID NO: 71225 - DNA, 601 bp, Human
atgccgtcgaggaaacctggggctccagacagcggggcactggggaccagggtggaaatgggaggggtgtccgccacccaccgcttacctcccttctgcaccctctggcccgggctggaggtggcgtaagcgcggcacgcggcgcagtggtccccgtcctggacgatgcagaagtggcctgggctgcagccacacacggcgttctctgtcctggagcagttccggctcgcgcgcaggcccatggctggagtccaagaggaggggctgagaggggtacgtggaggccgggacaccatccacrggccaggacagcatccacaggccaaggactgctgccagggcgccctgccaggctgaacccctggctcagccaaacgaggtgcccagaggtacccagcatggaggacctgaggccgggagggacaccaagggacggcagagctgcgtgtgggacgagggcttgcaggaaggtcctgggagggcttcgttgatgggagaaaccagccttctgcccagatgggcaggacgccgagcttgcactgtcagttccagggcagggtcccgcaggcaggtcctcgccccacgtgcccacccagacacc

SEQ ID NO: 71226 - DNA, 601 bp, Human
gaacaagcgcttcacagtggagaggccctgcccaccataccagcaggtgcccagttgggtgagactaagctgctgcccggcctaccctagagcctgaggccccgagacctccccgcattggaggccccgggtgaggatcaggtggctttgctgccgcctggctggaggatggggctgactttcccttcagacctcaatgcttagaagctgcgtccccgggggctgtgcacagggctcccagggccacagccgggtccacacagcggggtcagtgcccaggaggccaggcacaggaggccargcacagcacaggtgcccagaccagggcggataggtggatgaatgaatgaatgaatgaatggccttactctcctcaatgaggacaaagccttgtccccagcagggcggctgttgaccctcagcccagagcttctcccagctgagcagggcctgtcctgctccccacatcccacagggggcaggcaggagcacagggtcatagagtgcgtgggcaggggtggctgagggctccacggtcaggggtcccaccttcccttcccccagggaggccagctgacacctgggctctggccacagcaga

SEQ ID NO: 71227 - DNA, 601 bp, Human
ccacattccagcctgggctccccgctcctctgggcctgaccatcttatatctccacctggctctgacacactgttaccgccgtcgccgtcacctcaggcatacggcagaagccatgtgagagtctgaattactgagaaccctttatccacttacggggataactgcatcttcctgggaaatgtcaactcaactaaaaataaagtgcttccaggactagcggccagtctctactcttcataaagggaaaagggcaaaagcccactgaaggtacttaggctgaaagcagccctctgtgctgtragacacctggcagagaaacgaacgatacctttatcagtggggccacagaccagtactaagtcagcctggagaatttatgattttattgcctatttagaatacgatcaaaaccgatgtaactagtttcccttcagcccgtcagtaacgccttcaccccagagcttaacactaaatcctacagataagcgctgacctggacgcaggatggggacagggcacattactctggaatacagcccaactcgcagcgctgtgggggccgcgactgcccgcttcccccagatgccaagcaggggatgc

SEQ ID NO: 71228 - DNA, 601 bp, Human
gaacgtgaactttggactccaacagcctgctttcagatcctggctctaccactctctgccagtgtgactaggacaggctattccaggatgcctcaggttccagtctgtgaaatgggacaacagcacctctcatgccttctccacaaggctctcgtgaggaatcagtgggcagcccgtggagcacccttggagccgggcaaggcagtgccagccctgttcctggatcagggccagccctcacaccagctgccccctctgcagtcctcttctctgctcagtttgaagcccacctcctcttcasaggcctccgttaccgcccacactgacccccagtcccttacatcacatcaccctatttttattttgtgtacaactgtttcctgatacctttctggtttacttctcaattttctcctgctagaatgaagctccttgaggggtcccttgtctggttcggggctgggccctgccacctggaagtccattacatagtagacagcccatcaattacctgttgaaggtgactgctttatgcctggtcacaaacaaaacagaaagggagataaaaccagtccaagcagagaccatgaggacgtgccag

SEQ ID NO: 71229 - DNA, 601 bp, Human
taaagatgagaggcctcctggcccctgagctagagaagacgccaggggtgacgttcacctcccccaccaccccccatctgctccctcggcagggcagtgaggagaaacagactctggtctcaagtttggcttaaagtcccacctgtgctaagcggctgtgaggccttcagcaaaccctctgagcacgcagccagcctcagtttcctcatctgtaaaatgaggctctaagaaataccagacatgaaagcaaagacatcattcctcagcaacagttggggtcagtcttattgttctcatttayagataagaaaactgaagctcacaaagactaaagagttgccctggcccatcagcatgttcgcagtgggcaggagccagaacctgcaccttcctgaaaccaacgcttttccagtcccatcctcactgtgagcactggggaaatcttcccttcaggtggaaggcaacaggtggccagacgcaatcccgccctcaagtgccttggctctcccatcacaactgatgcgctgaagtgatccaggcagctccctccacatcatcaagtctgtgcagaatgtggctccatgacaccgttcctggatcc

SEQ ID NO: 71230 - DNA, 601 bp, Human
gtccatataccatttgtgtttttaccatgaattgttcgggaaaaagtagcaggtacacaggcttccctggagaggaagggcagcgtgagacgcatgggcccaggagcacaggccgcattttcattcccacactggcacctcagtcacctgcgtgggcgggactgtccaccccactggccccaggagcagccttgctggccatggggtccactggctggtccatggcacgtggcactgcatgtcctccctccaaggaccgcaccctctgtggatccctcagggttcccccgcccaggcaccytgtctgctccacgccctgtcctgggtctctggtctggcaggagcaggagggatcctgtcctctcagggccaggtcctccaccccatgaacaggaaaatgttatctacaactctcaggtagtccatccatctgcgtcccagtttcttatctggcaagcggaggtaacgtatctgctcctatttcaacactgctgtgatgccatgaggaattcacctgagaacccaggtgccagaggtcacattgttcacccacttaattcccagatgctcaagtgaagggcatcatgacccccatttcacc

SEQ ID NO: 71231 - DNA, 601 bp, Human
gagaaaaacacaaaatacttttcagtaaaaagcattcacgggtgtgaaatcctggccctattttcaccaacactgtcaagtaggtttcttccacattcagtattttgtccatataccatttgtgtttttaccatgaattgttcgggaaaaagtagcaggtacacaggcttccctggagaggaagggcagcgtgagacgcatgggcccaggagcacaggccgcattttcattcccacactggcacctcagtcacctgcgtgggcgggactgtccaccccactggccccaggagcagccttgytggccatggggtccactggctggtccatggcacgtggcactgcatgtcctccctccaaggaccgcaccctctgtggatccctcagggttcccccgcccaggcaccttgtctgctccacgccctgtcctgggtctctggtctggcaggagcaggagggatcctgtcctctcagggccaggtcctccaccccatgaacaggaaaatgttatctacaactctcaggtagtccatccatctgcgtcccagtttcttatctggcaagcggaggtaacgtatctgctcctatttcaacactgctgt

SEQ ID NO: 71232 - DNA, 601 bp, Human
gaaaatgctgggagtcccgtttctttttcaaatatttatactcatctactaaaaaacccaccaacctgtccaagtcttgtgaaaaatctgtacaccaccgaaggtttcccatggacggattctcccacactgtccccttcagacattctgtaactgggagaaaaacacaaaatacttttcagtaaaaagcattcacgggtgtgaaatcctggccctattttcaccaacactgtcaagtaggtttcttccacattcagtattttgtccatataccatttgtgtttttaccatgaattgttcrggaaaaagtagcaggtacacaggcttccctggagaggaagggcagcgtgagacgcatgggcccaggagcacaggccgcattttcattcccacactggcacctcagtcacctgcgtgggcgggactgtccaccccactggccccaggagcagccttgctggccatggggtccactggctggtccatggcacgtggcactgcatgtcctccctccaaggaccgcaccctctgtggatccctcagggttcccccgcccaggcaccttgtctgctccacgccctgtcctgggtctctggtctgg

SEQ ID NO: 71233 - DNA, 601 bp, Human
cccaaggaatgaggcagccacagagcgcaaccttgtcctgagcatcatgcagcagggtcggagggacaccagcggctccactgtccaggcctggacgtgcccagggcagggccaggctgggctcaggacggcctgggtatactgagaagcctggcgaggcgactccgggtgaatcataaacaaccctgttcgttaaagacagtcactgagatctttctgacatttggcgtttagctgaaaattgattactagagaccacttcctgcaagacagactggatcaacaacatccccacaaacaycacgcccaggtaacgtggacagagccaagtctcgtcacttcagcccacacctacctgcagcaggtaaactcgaatcatgtagacaaagctcaggcccagtgtcacgacccatcgcacagccgtgtagggtgtggacttgtctagccaggactgataaatctagaaagacaagagtccaaaagcatgaagcaggtcctgtaacttctgtactgaccctgccacaaaatgtaccttctgctagggttggctttcaatttttaaaacagctaaaagagtgagttaaaatagcaagagatcatc

SEQ ID NO: 71234 - DNA, 601 bp, Human
cagctgctcgggaagctgaagtaagagaatcacttgaacccaggaggtggaggttgcagtgagccaagatcaggccactgcactccagcctgggcgacagagtgagaccccatctcaaaacaataaataaaaatataaatgctttaactttctcatacaaacaagaagtctttctgcctaaaagcttttccagtcagacggctgaacgccagatgtgagggctaactgatgtctgtgtgtccatccctggctgaacgccggatgtgagggctaactgatgtctgtgtgtccatcctcggcygaacgccggatgtgagggctaactgatgtctgtgtgtccatcctcggctgcagggccacacctgaagagacgccaaatgaggcacgagcttggtttcgaacgcaataaaactgacctgtgggtgctgcactcttcccgccccctgctcctgcctgaagtccctgattcaagatttctaggtcattctttccatcagagaatggacccagttccaatttaaaaacaaaaataaataaataaattaaggtgtgtgctttaaacaaggaagtatcttctacagtccccagaggagaaaatagc

SEQ ID NO: 71235 - DNA, 601 bp, Human
atccagaaaagtgtgcttatgccaagccttcctcaagagatgaaaagtggggagaattttggcaagatgcctgagtgcagcacacttatttgcaactaattcattttttaaaatgattaagcatatcccgttaaaagccagaaccgcattctcaatttcaaaagccttaaatttctgtcgggtgtggtggctcacgcctgcaatcccagcactttgggaggccaaggcgggtggatcacctgaggtcaggagttcaagaccagcctggccaacatggtgaaacctcgtctctactaaaaayacaaaaattagccaggcatggtggcacatgcctgtgatcccagctgctcgggaagctgaagtaagagaatcacttgaacccaggaggtggaggttgcagtgagccaagatcaggccactgcactccagcctgggcgacagagtgagaccccatctcaaaacaataaataaaaatataaatgctttaactttctcatacaaacaagaagtctttctgcctaaaagcttttccagtcagacggctgaacgccagatgtgagggctaactgatgtctgtgtgtccatccctggctgaacgccg

SEQ ID NO: 71236 - DNA, 601 bp, Human
tccacaactgggaaatccagaaaagtgtgcttatgccaagccttcctcaagagatgaaaagtggggagaattttggcaagatgcctgagtgcagcacacttatttgcaactaattcattttttaaaatgattaagcatatcccgttaaaagccagaaccgcattctcaatttcaaaagccttaaatttctgtcgggtgtggtggctcacgcctgcaatcccagcactttgggaggccaaggcgggtggatcacctgaggtcaggagttcaagaccagcctggccaacatggtgaaacctcrtctctactaaaaatacaaaaattagccaggcatggtggcacatgcctgtgatcccagctgctcgggaagctgaagtaagagaatcacttgaacccaggaggtggaggttgcagtgagccaagatcaggccactgcactccagcctgggcgacagagtgagaccccatctcaaaacaataaataaaaatataaatgctttaactttctcatacaaacaagaagtctttctgcctaaaagcttttccagtcagacggctgaacgccagatgtgagggctaactgatgtctgtgtgtccatcc

SEQ ID NO: 71237 - DNA, 601 bp, Human
gcccgggcacctgagcgatgctggcccagagccccacccaggagcagcttcatcagaaacagaagacagactctcaactgtgactggaggcgtgctggctgatgttcctccaacagacaattcacattgccaaaaacactctgccaggagggttaaacctttgcccagaagaaatccacaactgggaaatccagaaaagtgtgcttatgccaagccttcctcaagagatgaaaagtggggagaattttggcaagatgcctgagtgcagcacacttatttgcaactaattcattttttaaamtgattaagcatatcccgttaaaagccagaaccgcattctcaatttcaaaagccttaaatttctgtcgggtgtggtggctcacgcctgcaatcccagcactttgggaggccaaggcgggtggatcacctgaggtcaggagttcaagaccagcctggccaacatggtgaaacctcgtctctactaaaaatacaaaaattagccaggcatggtggcacatgcctgtgatcccagctgctcgggaagctgaagtaagagaatcacttgaacccaggaggtggaggttgcagtgagccaagatca

SEQ ID NO: 71238 - DNA, 601 bp, Human
actccagcaaaatgtgggtacgttactaacacaagatggaacttgagatttcctgaagcacagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctscggccgggtgggcagatgccgccgtggctccatccatcagcacccagtcctttgcttcactgtgctctggccaagcgcgtgcgacttcctgtcacaccttaggcctgagcgcttattaagaaaacagtatgaaaaatgacaaacactcctgtccacagtctgagaatcccaagtgtctcaacacggtaccagaagtaccacctgggagcagcactggctatcttgggtcagggacacacaagcttgaacgtggcctcttagaggagctcgatgtcagatatgtaaacactggcacaagaa

SEQ ID NO: 71239 - DNA, 601 bp, Human
ctcttcctgacccagacgcactcacgagccaggtcctgggggtatgggggctgccaggggcgcccgagccctctcctggggggcctgctgggcaggcgacctgctgacccacggtcactgctgtgttcagcccctcagctcggccccagcctatttcccgcctccatttgatgtttccaggttttcaaaactgcatttaacctgcgccagagagttcaccgtaggcatctttaataaactaactccagcaaaatgtgggtacgttactaacacaagatggaacttgagatttcctgaagcrcagtgttaaaatgcctcgagggcgtgtgccacatttccctgctgacgtaaaacacctggccagcaggaccggcttccggcaaagacccgcgcaaaccatgtcttgctgtttgacttacttaggaatgaggatgaccctgtattcctgggttagtcaaggtcagcttgccagagacggaggagggcgggggggccgtgaccctctagactgggaggaccaccaggagaggcactgggggctccggccgggtgggcagatgccgccgtggctccatccatcagcacccagtcctttgcttca

SEQ ID NO: 71240 - DNA, 601 bp, Human; identical to SEQ ID NO: 25442

SEQ ID NO: 71241 - DNA, 601 bp, Human
tgtattagacacactttttaaaatctcaggacatgaatattctggaaggcacccatctccagcacaagccagatgtactggcgttagaagcctgaatctctgcttgatgggttcaggaaagatctctgtggctggtgacatagggaggcacctgttctccctgctggctctctgcccttctggtgctctctctctctctccttgcttagctcctctgccttctactttacctggatgcttcttcccccagccttccaggtttggcttcaatgctaactcctcagggaggttcctcctgctyccccaaaaatattatgttcattttataaaccctgaaatcactgtaattttcctttacagcataatgttaattgggcaattatttgtgcaagtttttcctaagtgtctcttttccatgggccccctgtctgtctcagtcactgctgcatctccgacatgtagcagcacattgtacatgcatagtagacactctatgaatagcaattcaaggttgaatggtggaaatctcccgtaagttccgtggtggacactatcaccctctcaagttttcagagaagccatcagcacttagaattgaatg

SEQ ID NO: 71242 - DNA, 601 bp, Human
gttcatctcctgtgggcagagccagagacggccctggcaaattgcagggggtgggcacggtggctctgccaccccaaccagctcctcctcatcttggtagatggtcgctccatccattcttccagcagcccaggccaaaaacacagagtcatcctcacacccccatagccaaacggcacgttccagtattccgcctcacagagcattcagaatctgacctcttcttatcattgcctccgctgccctgctctgttctgagccctcgtcacctctcccagtccttccctgtcactagtgtccytgcttcctcccctaccctggttactctctgcactgctgcaaaacaatccattcaaacccaagtcagatcccatctctgctctgctcaaaaccctctagtggaccccagctcaccaaagtcaaagcaaaaatctggaccacagcccacaaggctctacatgacctgcccccagtcttggtgacccaccttgtactctgtttccctcaagtactctgcccgagccacactggcttcctcactgtccaagcacactctgacctcaggaccttggcacctgctgttcccattgcttggaaggct

SEQ ID NO: 71243 - DNA, 601 bp, Human
gaccaaaccatcccttgctgagatgggctttggggagccctggtaccagctgtgcaattgtgggcaaatgacttcaccctttcatctcggctgtcctatataatacggttaataacagactgatcagccatgtggggaggttggaggggtgaagcctagcgtggtggtgcccagcctggtcagtattggggaatatctgagggtgatcccacacaatattattgagtcctttctatctgccagcccccaacttctgtgccagggagacaggaaaaaaaactgtttcttctccaagggggtstttggagctggtcagacctgggtttgcatcctgtcttcattcttactgcctggtgtccctgagccagtgctgtaacctccccatgcctcggtcctcctgtctgtgaagtgggcctagtaataagatcttgtggggaagggagcgttctttcctgttgactgctggtaagcctaatgtttcctgtttcttctagtttccttctaggacacctcccctgcttttggaaaaaggatgaggttggtggccgtgtgctccaagatgtgtttttggattggtgggttctcatttgtcacttgttgc

SEQ ID NO: 71244 - DNA, 601 bp, Human
agatcttgtggggaagggagcgttctttcctgttgactgctggtaagcctaatgtttcctgtttcttctagtttccttctaggacacctcccctgcttttggaaaaaggatgaggttggtggccgtgtgctccaagatgtgtttttggattggtgggttctcatttgtcacttgttgcccttactccaggttcccttggggcagctcccccaacccaatccagcacacagactcccagcctcaccttcccctagcccaggttactcccagccccagcagttcctcccctgagtggaggcargtgaggctggcttggaagccatgctctgccattcatccactgcaggaccttagaccagccgtcagaagctctctgagcctcagtttcctcatctgtaaactgggtgggggggtgtgaccaggtaacagtcattgtttggtgtgacacttttttacatttttcaaagtactttcaaagatgcgaatcatttgattcccaggacaaccttttgggacaatcaaagaaggagtgtttccaaccctattccatggctgtggaaactgaggcctgctgggggacatgactcggcaagtgagcaac

SEQ ID NO: 71245 - DNA, 601 bp, Human
catgctctgccattcatccactgcaggaccttagaccagccgtcagaagctctctgagcctcagtttcctcatctgtaaactgggtgggggggtgtgaccaggtaacagtcattgtttggtgtgacacttttttacatttttcaaagtactttcaaagatgcgaatcatttgattcccaggacaaccttttgggacaatcaaagaaggagtgtttccaaccctattccatggctgtggaaactgaggcctgctgggggacatgactcggcaagtgagcaacagggcagagccttgcccccrgggctcctgggccccaggacagcactcttttggtagcatgcattgagcaccttctgggacgggaaacatcggtttctcagctgggcggggttggtgatggtcatacctcaggtggttgacagtttccttcgggtcactttggtttccagggctaagaagtatggacctgttgtgcgggtcaacgtcttccacaaaacctcagtcatcgtcacgagtcctgagtcggttaaggtaggaggaagagtggtttccatgagggagttccctgcctttccttgggttgggggagtgaagcctggt

SEQ ID NO: 71246 - DNA, 601 bp, Human
gagcaacagggcagagccttgcccccagggctcctgggccccaggacagcactcttttggtagcatgcattgagcaccttctgggacgggaaacatcggtttctcagctgggcggggttggtgatggtcatacctcaggtggttgacagtttccttcgggtcactttggtttccagggctaagaagtatggacctgttgtgcgggtcaacgtcttccacaaaacctcagtcatcgtcacgagtcctgagtcggttaaggtaggaggaagagtggtttccatgagggagttccctgcctttycttgggttgggggagtgaagcctggtcccagagactttggatgaatgttccagagccaggcgcatttcggctggtttcccaaagatccagaaaggaatggcatctttccctctaagcacccactccttggggactcttgcaagcattgccttttgatgtggggagtagatggggaccttgctgtccccatttgggttggaagttttgcccaactagtgcacacacgtttagtttgcctctctttgcctcagttccttcatctgtgagatgggaattataactctatctccagggctatga

SEQ ID NO: 71247 - DNA, 601 bp, Human
attcaccagtgaagtcatgtgggcctggagttttatttgagggaaatttttattttttttaagttacaaatttaattttgtttacattgtatgttttaaattttaaattatgataaaatgcacataacataaaatttaccatttttaggtgtagagttcagcagcattaaagacattcacattgttgtacatccatcaccaccatccatctccagaactttttcatcttccctaactgaaactgtgtatcagttaaacaataactccccattcccctccccccagaccctggaaaccactrttctaccttctgtctccgtgaattggactactttatgtgcgtcatacatgtgtaatcatatggcatttgtcctttcgcatctgacttatttcacttagcataatgtttccaaagtgaattaatcttgtagcatgtttcagcatttccttctctagttgacatatggcattcagattttctgttttcttgagtttgataattcacatatttcaagagatctgttcacttcacataatttgcttaaattattggcataaagttgttcatgagattttctttctttttttttttttaatgtct

SEQ ID NO: 71248 - DNA, 601 bp, Human
cctttcgcatctgacttatttcacttagcataatgtttccaaagtgaattaatcttgtagcatgtttcagcatttccttctctagttgacatatggcattcagattttctgttttcttgagtttgataattcacatatttcaagagatctgttcacttcacataatttgcttaaattattggcataaagttgttcatgagattttctttctttttttttttttaatgtctgtaggatctgtgatatgttccctctctcattcctgagagtagtaatttgggttttctttttttttttttttcttgatcagttcaccaaaaggtttatcaattttattcatctttccaaataagtagcttttagttttattggttttcttcattgtttgtcttctatttcattgatttctcctctttttttttttttctttttgagatgaagtcttgctctgtcacctaggctggagtgcagtggcgtgatctcagcttactgcaacctctgcctcccaggttcaagtgattctcctgcctcagtctcccgactagctgggattacaggcgcccaccactgcacgtggctaaatttttatttttttggtaga

SEQ ID NO: 71249 - DNA, 601 bp, Human
aagcagtttcgctcttgttgcccaagctagagtgcaatggcgctatctcggctcactgcaacctccacctccagggttcaagtgattctcctgcctcagcctcccaagtagctgggactacaggtgcctgccaccatacccagctaatttttgtatttttagtagagatggagtttcaccatgttggccagtctagtcttgagctcctgacctcaagtgatctgcccacctcagcctttcaaagtgctgggattacaggcgtgagccaccatgcccagcctccattccagctttcttatgyttagtgttgcatgttatatcttttttctgttatattacttttaacctatctgcatttttatatttaaaatgggtttcttatagatagcacacagttgattcttgctgttttatacagtctgacaatctctgcctttaattagagtgcttaggttgtttacatttactgtaattattgatatggctgtgtttaaatctaccatgttactgtttgttttctatttgtcccatctgttttttgttcccttttcctcctttcctgccttcttttggattaagtatgttttagtattctgtttca

SEQ ID NO: 71250 - DNA, 601 bp, Human
actctgttccccaggtttcatagctcaccacagcctcaaactcctgggctcaagcaatcctcccacctcagcctcctgagtagctgagactaccaccatgcccagctaaccactattatcttattggttccttttctctctttcttagttgttttcttagggtttataatttcatctttaacttatataaatatatcttcaaataatattataccacttcatctcagtctactgttaagatttttctctttatcactgatgtcagcaattgattatgatctgccttggtatactttatttsctgtacttttctttgttaattctatttgggatcctttgaatttcttagatatgtgggttccatgatcatattagtaatacatgttttatagttcttgtctgctagttctatcattccattatctgggcctgggtataggtcataatatcctgctttgtggcatgtctaatgattttttattggatactggacattgtgaattttacatttttgggcactaggttttgttatattcctttagagattctttgacttcattctgagatgataaagttacttgcagatcagtttgatcctttc

SEQ ID NO: 71251 - DNA, 601 bp, Human
ttgagtcatcctcttactgcttcccagcacccacaggataaagcagtagcccagagggcaggcctctgggctctgggtcctgcagcacgttccccctcatgtacctctgcctgaatgtaccaggggacctgtggtcccttggtctggatcatagccgtctctcccctctctccgcagcaaattgcctggattcaaatcctgtgtctaccatttactatgtgtgtaaccttgggtcagttttcaacctcagtttctccatctgtatgtaagatgagcataaaaacaacacccgcagccaggygtggtggctcacacctgtaatctcagcaacttgggttgactgggcattgagtgaactgcagggtgcagctgtgcacctggcatttattgagcacctgctatgtgccgggcaccattcttagcacttcttatgtagaattgacactcttcacaacaaacttgccaggcaggaactcttatatccatctaagatgaggaaactgaggggcagaggaggtgagtaactcatccaaggtcccagagttagcatgtggtgcagcagggatgctgagcccagatccaaattgaagctggctgacta

SEQ ID NO: 71252 - DNA, 601 bp, Human
gcaggcctctgggctctgggtcctgcagcacgttccccctcatgtacctctgcctgaatgtaccaggggacctgtggtcccttggtctggatcatagccgtctctcccctctctccgcagcaaattgcctggattcaaatcctgtgtctaccatttactatgtgtgtaaccttgggtcagttttcaacctcagtttctccatctgtatgtaagatgagcataaaaacaacacccgcagccaggcgtggtggctcacacctgtaatctcagcaacttgggttgactgggcattgagtgaacygcagggtgcagctgtgcacctggcatttattgagcacctgctatgtgccgggcaccattcttagcacttcttatgtagaattgacactcttcacaacaaacttgccaggcaggaactcttatatccatctaagatgaggaaactgaggggcagaggaggtgagtaactcatccaaggtcccagagttagcatgtggtgcagcagggatgctgagcccagatccaaattgaagctggctgactacacagcccacgctgttaaccactgggcaatcctgcctcaagagctgttggctgatgt

SEQ ID NO: 71253 - DNA, 601 bp, Human
gatgagtgccccgtaaacagtggccccactcttgtcacgagcagtttcctccttctcccccaacctccagatggcagggaatatagaggccactgaggttgggtaacacgatcatccttttcctttttaagttatttttaaaattccggtaaaactgacataacattcaccattttccccaccttagagggtacagtctagtggaattcagtgccttcacaatgtggcgcaaccgtcgccaccgcctagctccaataccgtttcctcatcccaaaatatgaccccaagcccatcaagcagycgctccccaccccccaccctctttcccgcatcacgtgtgtgtctcctacagactcttcggccaaggcttggtgtccgaatgcaactatgagcgctggcacaagcagcggagagtcatagacctggccttcagccggaggtgagtgtggccggaggctccgtggctcctgcctggccagaggcagtaggggctgccgaagtgtaggtgggccttggggagggaagtgtccacccaagggggcctccctcagctgaagggagagaggaaaaaggggaaagacagggtgttaatagtcaaaag

SEQ ID NO: 71254 - DNA, 601 bp, Human
ggtacagtctagtggaattcagtgccttcacaatgtggcgcaaccgtcgccaccgcctagctccaataccgtttcctcatcccaaaatatgaccccaagcccatcaagcagtcgctccccaccccccaccctctttcccgcatcacgtgtgtgtctcctacagactcttcggccaaggcttggtgtccgaatgcaactatgagcgctggcacaagcagcggagagtcatagacctggccttcagccggaggtgagtgtggccggaggctccgtggctcctgcctggccagaggcagtaggsgctgccgaagtgtaggtgggccttggggagggaagtgtccacccaagggggcctccctcagctgaagggagagaggaaaaaggggaaagacagggtgttaatagtcaaaagggagagagagagagacaggctgaccaagtggggatgaatgaggcccccatgcagtttgggaacatcaagggctgagtgcccacgatggccagaagcatgggggttcctgtcgtccaagagctccccacatcagacctcatcactccttgtcagggcttcttcttttattcatttgagtttttatgtttt

SEQ ID NO: 71255 - DNA, 601 bp, Human
caccctctttcccgcatcacgtgtgtgtctcctacagactcttcggccaaggcttggtgtccgaatgcaactatgagcgctggcacaagcagcggagagtcatagacctggccttcagccggaggtgagtgtggccggaggctccgtggctcctgcctggccagaggcagtaggggctgccgaagtgtaggtgggccttggggagggaagtgtccacccaagggggcctccctcagctgaagggagagaggaaaaaggggaaagacagggtgttaatagtcaaaagggagagagagagagacaggctgaccaagtggggatgaatgaggcccccatgcagtttgggaacatcaagggctgagtgcccacgatggccagaagcatgggggttcctgtcgtccaagagctccccacatcagacctcatcactccttgtcagggcttcttcttttattcatttgagtttttatgttttggtgatatagttgtgctttgtataacgatgtttcggtcaacgatggaatgcatatgtgacagtggtcccgtaagattataatggagctgaaaattgctattgcctagtgatgctgtaaccatggta

SEQ ID NO: 71256 - DNA, 601 bp, Human
agactcttcggccaaggcttggtgtccgaatgcaactatgagcgctggcacaagcagcggagagtcatagacctggccttcagccggaggtgagtgtggccggaggctccgtggctcctgcctggccagaggcagtaggggctgccgaagtgtaggtgggccttggggagggaagtgtccacccaagggggcctccctcagctgaagggagagaggaaaaaggggaaagacagggtgttaatagtcaaaagggagagagagagagacaggctgaccaagtggggatgaatgaggcccccaygcagtttgggaacatcaagggctgagtgcccacgatggccagaagcatgggggttcctgtcgtccaagagctccccacatcagacctcatcactccttgtcagggcttcttcttttattcatttgagtttttatgttttggtgatatagttgtgctttgtataacgatgtttcggtcaacgatggaatgcatatgtgacagtggtcccgtaagattataatggagctgaaaattgctattgcctagtgatgctgtaaccatggtaatggcgtagtgcaatgtgttactcacatgtttgtg

SEQ ID NO: 71257 - DNA, 601 bp, Human
agtcatagacctggccttcagccggaggtgagtgtggccggaggctccgtggctcctgcctggccagaggcagtaggggctgccgaagtgtaggtgggccttggggagggaagtgtccacccaagggggcctccctcagctgaagggagagaggaaaaaggggaaagacagggtgttaatagtcaaaagggagagagagagagacaggctgaccaagtggggatgaatgaggcccccatgcagtttgggaacatcaagggctgagtgcccacgatggccagaagcatgggggttcctgtcstccaagagctccccacatcagacctcatcactccttgtcagggcttcttcttttattcatttgagtttttatgttttggtgatatagttgtgctttgtataacgatgtttcggtcaacgatggaatgcatatgtgacagtggtcccgtaagattataatggagctgaaaattgctattgcctagtgatgctgtaaccatggtaatggcgtagtgcaatgtgttactcacatgtttgtggtggtgctggtgtaaacaaacctgctgcactgccagtcatgccaaagtctagcagatgcaat

SEQ ID NO: 71258 - DNA, 601 bp, Human
attagcgtgcagtaatgtcctaggccttcacactcaccactcactcactgactcacccagagcaacttccagtcctgcaagctccattcacagtaagtgccctatccaggtggaccatttaaaaaaatcttttagactgtatttttactgtaccttttctatgtttagatatacaaataccattgtgttgcagtaacctgttgcacaggtgtatagcctaggagcaatagtctagaccatatggcctaggtgtgtagtaggctatactgtctaggtttgtgtaagtatactctatgctgtwcacacaatgaagacattccctaacaacacatttcttagaatgtatccttgtcgttaagtaacacatgactgtactttactttttaaataactattatggaggtataattcacataccatacagctcacccatttaaagtgtacgattcaatggcgttggtatattcatagaattctataaccatcaacacagcacattttagaacattttcatcaccctcaaaagcagtcattcagccaggcgtggtggttcatgcctgtaatcccagcactttggggggccaaggcaggcggatcacct

SEQ ID NO: 71259 - DNA, 601 bp, Human
atttaaaaaaatcttttagactgtatttttactgtaccttttctatgtttagatatacaaataccattgtgttgcagtaacctgttgcacaggtgtatagcctaggagcaatagtctagaccatatggcctaggtgtgtagtaggctatactgtctaggtttgtgtaagtatactctatgctgtacacacaatgaagacattccctaacaacacatttcttagaatgtatccttgtcgttaagtaacacatgactgtactttactttttaaataactattatggaggtataattcacatamcatacagctcacccatttaaagtgtacgattcaatggcgttggtatattcatagaattctataaccatcaacacagcacattttagaacattttcatcaccctcaaaagcagtcattcagccaggcgtggtggttcatgcctgtaatcccagcactttggggggccaaggcaggcggatcacctgagatcaggagttcatgaccagcctagccaacatggagaaaccatatctttactaaagatacaaaaattagctgggtgtggtggcgcatacctgtaatcccagctactcgggaggc

SEQ ID NO: 71260 - DNA, 601 bp, Human
ggctatactgtctaggtttgtgtaagtatactctatgctgtacacacaatgaagacattccctaacaacacatttcttagaatgtatccttgtcgttaagtaacacatgactgtactttactttttaaataactattatggaggtataattcacataccatacagctcacccatttaaagtgtacgattcaatggcgttggtatattcatagaattctataaccatcaacacagcacattttagaacattttcatcaccctcaaaagcagtcattcagccaggcgtggtggttcatgcctrtaatcccagcactttggggggccaaggcaggcggatcacctgagatcaggagttcatgaccagcctagccaacatggagaaaccatatctttactaaagatacaaaaattagctgggtgtggtggcgcatacctgtaatcccagctactcgggaggctaaggtaggataatcacttgaacctgggaggcggaggttgaagtgagctgagatcactccactgcactccagcctgggtgacagagcgagactccatctcaaaaaaaaaaaaaaaaaaaaaaggcagtcattcctcatttctt

SEQ ID NO: 71261 - DNA, 601 bp, Human
agtatactctatgctgtacacacaatgaagacattccctaacaacacatttcttagaatgtatccttgtcgttaagtaacacatgactgtactttactttttaaataactattatggaggtataattcacataccatacagctcacccatttaaagtgtacgattcaatggcgttggtatattcatagaattctataaccatcaacacagcacattttagaacattttcatcaccctcaaaagcagtcattcagccaggcgtggtggttcatgcctgtaatcccagcactttggggggccraggcaggcggatcacctgagatcaggagttcatgaccagcctagccaacatggagaaaccatatctttactaaagatacaaaaattagctgggtgtggtggcgcatacctgtaatcccagctactcgggaggctaaggtaggataatcacttgaacctgggaggcggaggttgaagtgagctgagatcactccactgcactccagcctgggtgacagagcgagactccatctcaaaaaaaaaaaaaaaaaaaaaaggcagtcattcctcatttcttcccaattcccctacctgctggcaa

SEQ ID NO: 71262 - DNA, 601 bp, Human
cattcagccaggcgtggtggttcatgcctgtaatcccagcactttggggggccaaggcaggcggatcacctgagatcaggagttcatgaccagcctagccaacatggagaaaccatatctttactaaagatacaaaaattagctgggtgtggtggcgcatacctgtaatcccagctactcgggaggctaaggtaggataatcacttgaacctgggaggcggaggttgaagtgagctgagatcactccactgcactccagcctgggtgacagagcgagactccatctcaaaaaaaaaaaaagaaaaaaaaggcagtcattcctcatttcttcccaattcccctacctgctggcaaccactaattaccttctttgtctatggatttttgcattctagacattttatataaatagaatcatgcaatatgtagtcctttatgcctggcttctttcattagcatcttgtttctaaggctcatccatggtgtcatctatattaatgcctcattcctttttattgtcaaataatattccattgtatggatataccacatattgtttacccattcatcagttaatggacttttgggctgtttccacttt

SEQ ID NO: 71263 - DNA, 601 bp, Human
caggcgtggtggttcatgcctgtaatcccagcactttggggggccaaggcaggcggatcacctgagatcaggagttcatgaccagcctagccaacatggagaaaccatatctttactaaagatacaaaaattagctgggtgtggtggcgcatacctgtaatcccagctactcgggaggctaaggtaggataatcacttgaacctgggaggcggaggttgaagtgagctgagatcactccactgcactccagcctgggtgacagagcgagactccatctcaaaaaaaaaaaaaaaaaaaaaaggcagtcattcctcatttcttcccaattcccctacctgctggcaaccactaattaccttctttgtctatggatttttgcattctagacattttatataaatagaatcatgcaatatgtagtcctttatgcctggcttctttcattagcatcttgtttctaaggctcatccatggtgtcatctatattaatgcctcattcctttttattgtcaaataatattccattgtatggatataccacatattgtttacccattcatcagttaatggacttttgggctgtttccacttttgggctat

SEQ ID NO: 71264 - DNA, 601 bp, Human
agttctcagcctttctttggctttctttaccttaacatttttgaagatgacaggacagttttgtagatggttcttcagtttgaatttgtcagctgtctctctgcactgttagactcaggctatccctctttggtggtaatgctacagagtgatgctgtgtcctctgtggggcattgtatcaggaggcacatgctactgatttgtcccattgctggccatgttaagtttgcacagtggttgaggtggtgcctaccaggtttctccactgtgaagcaattcttgactatgtaatctgtggagractgtataaacatccttgccagaactcttgctacagcctcctcattggcctaccctcctcctgtctccctcctccaatgtatccactcaccatcctgaagagatcttgctaaagctcagatctgaccatgccactcccctgttctgaagccttcaatggcttcctatcatctgagagatgaagatcagaccccattcaccctcagtctgcccctaaacccctccaacctttgcatcccctctccccagcctttctggaaaccactgtgctttttctggcatctctgctgttcccactgcc

SEQ ID NO: 71265 - DNA, 601 bp, Human
aggaagctttgaggttatgggaaacatcaattctaaccagatgatggcccacatgatcatgacataaccatgtcattgtcttgaggaagcatctccagcacatagaacctcatgtttgaacagtgctttatagtttataaagtgctttcacagacatttttatttttttaactttttatacacacagcataaagtttgccatcttaaccatttttaggtgtgcagttcagtggtattaaattcattcgcattattacgcaaccatcaccagatatttttattttttaatctcacaataagrtgttgtcttagagatgactgttctatagtaaatgccaaatttacaaggctttatgaaagaaactttagaagatgcctgtgtttatgaaagtattattgagccttggtgaatcctaattcactaatgaagaaaaaataggaaccactgatgagtttcatctccaaccattacccacacagaatataattttgtacttttaataaaactgtgagagtaaattgctagtttctacttttccagattttggttttatgggaagacctcagtctgagtccaccaagggagtcaggattttattgt

SEQ ID NO: 71266 - DNA, 601 bp, Human
agggtgctgtgggagcatatattgcacctacctggggctcaagagttactgcctgaggaagcggcctttgagtgtccatctggagaagggagacattcaggtagtgatggttgtgggggatagagggtgagtgctccaggagaggggatgtgtgtgcaccagccccatggtgggcaggagcattgtatttggaggagccaaaaggcccctggaacaggaaggcaatgttataggtggaggtcagcgagaagcagactccagctcttaagctcaggtgaagattttcatccccctcctaagrgcaacagcatgcttcaaagtgttttatgttgcaaagggaccagatgagagtggagagccccaggctcacctgctgccaggcatgtgcgtcggctagttgggcaatgaaaagctggttactattttagtttttcttctcccattctctctctcttttttagagacagggtctcactctttcacccagactggagtgcaatggtgtgaccatagcttactctaaccttgacctcctgggctcaagtgatcctccggcctcagcctttcaagtagctggggctacaggagtgtgccaccatgc

SEQ ID NO: 71267 - DNA, 601 bp, Human
tgcctgaggaagcggcctttgagtgtccatctggagaagggagacattcaggtagtgatggttgtgggggatagagggtgagtgctccaggagaggggatgtgtgtgcaccagccccatggtgggcaggagcattgtatttggaggagccaaaaggcccctggaacaggaaggcaatgttataggtggaggtcagcgagaagcagactccagctcttaagctcaggtgaagattttcatccccctcctaagagcaacagcatgcttcaaagtgttttatgttgcaaagggaccagatgagwgtggagagccccaggctcacctgctgccaggcatgtgcgtcggctagttgggcaatgaaaagctggttactattttagtttttcttctcccattctctctctcttttttagagacagggtctcactctttcacccagactggagtgcaatggtgtgaccatagcttactctaaccttgacctcctgggctcaagtgatcctccggcctcagcctttcaagtagctggggctacaggagtgtgccaccatgcccagctagtttttatttttattttttgcagagacggagtcttgctgtgt

SEQ ID NO: 71268 - DNA, 601 bp, Human
gatgagagtggagagccccaggctcacctgctgccaggcatgtgcgtcggctagttgggcaatgaaaagctggttactattttagtttttcttctcccattctctctctcttttttagagacagggtctcactctttcacccagactggagtgcaatggtgtgaccatagcttactctaaccttgacctcctgggctcaagtgatcctccggcctcagcctttcaagtagctggggctacaggagtgtgccaccatgcccagctagtttttatttttattttttgcagagacggagtcttgctgtgttgtccaggctggtctggaactcatggccgcaagcaatcctcctgctctcgccttccaaagtattggggttataggcatgagcccctggccctggccccatttctctttttaaaaattttctatttggaaataatttcaaattttcagatacgtttcaagaataagaataggacaaagaatacccatgtactctttactcagattaatattaaaagattaacatttctaggtccgggtgcagtggctcacacctgtaatcccagcactttgggaggccaaggtgggtggatcatg

SEQ ID NO: 71269 - DNA, 601 bp, Human
gtgtgccaccatgcccagctagtttttatttttattttttgcagagacggagtcttgctgtgttgtccaggctggtctggaactcatggccgcaagcaatcctcctgctctcgccttccaaagtattggggttataggcatgagcccctggccctggccccatttctctttttaaaaattttctatttggaaataatttcaaattttcagatacgtttcaagaataagaataggacaaagaatacccatgtactctttactcagattaatattaaaagattaacatttctaggtccgggtrcagtggctcacacctgtaatcccagcactttgggaggccaaggtgggtggatcatgaggtcaggagtttgagaccagcctggccaacatggtgaaaccctgtctctactaaagatacaaaaattagccagccatgctggcacatgcctgtaatcccagctactcgggagcctgagacagaaaaattgcttgaacccaggaggcagaggttgcagtgagccgagattgcaccactgcattccaacctgcatgacagagcaagactctgtctatggaaaaataaataaataaaaataacatt

SEQ ID NO: 71270 - DNA, 601 bp, Human
taatattaaaagattaacatttctaggtccgggtgcagtggctcacacctgtaatcccagcactttgggaggccaaggtgggtggatcatgaggtcaggagtttgagaccagcctggccaacatggtgaaaccctgtctctactaaagatacaaaaattagccagccatgctggcacatgcctgtaatcccagctactcgggagcctgagacagaaaaattgcttgaacccaggaggcagaggttgcagtgagccgagattgcaccactgcattccaacctgcatgacagagcaagactcygtctatggaaaaataaataaataaaaataacatttcttttaattataaaagcagcattttctcttagcaaaatttcagaaacatgtaatgtacaaaatggcagtcccctccttccagctcccttggggttgccatttttgtgagtttggagtgcattcttccatatctctttctaagctctgtgcctgggagggagccctgtgggttgggagctctggggtgcaaatggtatctgaggactcatttccacatagagttggacaccatgattgctcaaggacaggcagtgaagtgggaaaa

SEQ ID NO: 71271 - DNA, 601 bp, Human
ctaagctctgtgcctgggagggagccctgtgggttgggagctctggggtgcaaatggtatctgaggactcatttccacatagagttggacaccatgattgctcaaggacaggcagtgaagtgggaaaacaaaatgctgcagctggtgcccagggcagggcaggtaaggagagcaggcaacgggagtagagggcaggaggggaaccgggattgccctctcatggactgtaggaggcccaaagtttctacactgtcacgtccctttgaggtcagggctgaagggccacagtgaccaacagagkacctgtggaactgttaggacaagagcaagggaacagcatccatcctgagtggaggagaatggtgaaaccccagggtgtagttcagttactacaactccaacctgcaatctgggtctcaaggggaggccagaaagactgggagggaccacccaccttcactctgcacagtatcctctctgtggagagggagggcacatggcagtccaccatattgggctggccagtggccgttgatgcctgtgctgtttctccagctccttggttagcttaatggaaacattcaacgagaaggctgagcag

SEQ ID NO: 71272 - DNA, 601 bp, Human
agcaggcaacgggagtagagggcaggaggggaaccgggattgccctctcatggactgtaggaggcccaaagtttctacactgtcacgtccctttgaggtcagggctgaagggccacagtgaccaacagagtacctgtggaactgttaggacaagagcaagggaacagcatccatcctgagtggaggagaatggtgaaaccccagggtgtagttcagttactacaactccaacctgcaatctgggtctcaaggggaggccagaaagactgggagggaccacccaccttcactctgcacagtrtcctctctgtggagagggagggcacatggcagtccaccatattgggctggccagtggccgttgatgcctgtgctgtttctccagctccttggttagcttaatggaaacattcaacgagaaggctgagcagctggtggagattctagaagccaaggcagatgggcagaccccagtgtccatgcaggacatgctgacctacaccgccatggacatcctggccaaggtgatgggtgacagtcgggcatgggggccaggagggccacatggggtagaggggtctcttctctccctcttcccttc

SEQ ID NO: 71273 - DNA, 601 bp, Human
atgaccttgcccttctctctcccccaggcagcttttgggatggagaccagtatgctgctgggtgcccagaagcctctgtcccaggcagtgaaacttatgttggagggaatcactgcgtcccgcaacactctggcaaaggtactgcctcagcaccccctctggtgaccagccaccagagctgttgtcttcatttgctgaagaacctccttcagtgattttttttttttttcccagaatgggttttgagttctggtatgtctgaagtgacttctgaatcaggatttgcatgcattgcctaaartaaaggcttaaaatcaaattgccttaaagtaaattaggagttaatctttctctcatgtgaaatgatccccaaagcaggcaatgtaggatgactatgatggctccatggtgtcagattttctggatccttctgtcttcctgttccactgtctcagcacatcacctcattgtcataagatggctgctgcgaaaggtgcaccctgcctgccactgcccgtgcccacatggggcctgggaaccaatctgccccacccgctgcagctaccaccacctgcacgcactgtccagggaccagacatgc

SEQ ID NO: 71274 - DNA, 601 bp, Human
cccgcttgccgacactggcccccacatgcatcatccaggggcctgaggaatggtctaccatgactgctgccactagcgcctgccattgagagggcctgaggagaggcctgccccacttgccgacactggcccccacatgcatcatccacgggcctgaggacaagcctgcccagcccaccacccactgttgcctgcacccaagcatgccatctggaggcctggggattggcttgccctgcctaatgtaggtagtgcctgtgtgcaatattggaggacacctgaggataggcccatccctccygctactgctggcgcccacatatgccatccaagggcctgagcacaggcccatcctacccactgttgccaccagtgatgctcaaggactggcctgcctggcatctccatcctcagcaaagcctcaggatggcctccactaacaatgacagtctaagccactgagaaactcagagataccactgacactgattacagctgaagaaattaaacagaaactatgttactgtgccaatccataatcaagccaaagcaccctacccacccaacactataaatgcccctatagaaaagtctttcccta

SEQ ID NO: 71275 - DNA, 601 bp, Human
tgcccagcccaccacccactgttgcctgcacccaagcatgccatctggaggcctggggattggcttgccctgcctaatgtaggtagtgcctgtgtgcaatattggaggacacctgaggataggcccatccctcccgctactgctggcgcccacatatgccatccaagggcctgagcacaggcccatcctacccactgttgccaccagtgatgctcaaggactggcctgcctggcatctccatcctcagcaaagcctcaggatggcctccactaacaatgacagtctaagccactgagaaastcagagataccactgacactgattacagctgaagaaattaaacagaaactatgttactgtgccaatccataatcaagccaaagcaccctacccacccaacactataaatgcccctatagaaaagtctttccctatgaaagccaatccataaaattggaagaagtaactattacactagatgcacaaaggggcaaaagaaacatggaaaaagcaaggaaatactataccttcaaagaaacaataactctccagcaacagattccaaagaaaataaaatttattatatgtctgaaaaagaat

SEQ ID NO: 71276 - DNA, 601 bp, Human
gccaaagcaccctacccacccaacactataaatgcccctatagaaaagtctttccctatgaaagccaatccataaaattggaagaagtaactattacactagatgcacaaaggggcaaaagaaacatggaaaaagcaaggaaatactataccttcaaagaaacaataactctccagcaacagattccaaagaaaataaaatttattatatgtctgaaaaagaattcaaaataatgatattaaactctgagatacaagagaacacagataaaaatgcaaagaaatcaggaaaacaattcatsacctgaatgagaaattcaacagagagacagatagatgtaaaagagaaacaaacagaaatcttaaaactgaggaattcagtgaatagaataaaaatataattgaaaacttcaacaatagactagattaagcagaagaaagaatttctgaacttgaagacaggtcttttttgaagcaacccaatcagaccaaaaaaagaaaagattgaagaaagcctttgtgacatgagacagcagtaagtgaccaaatattccagttccgggaatttcaggagaagagatgggcaaaggcatatgaaacct

SEQ ID NO: 71277 - DNA, 601 bp, Human
ttccacacaaacacaagccaaagctgtcaggagtagctataattatatcaaataaaacagactttaagtcaaaaactgtaaaaagagacaaggtcattatataatgataaagggatcaattctgcaagaagataaaatacttctaaatatatttgcacccaataccagagcacccagagatagaaagcaaagatctaaaggaaaagatagactctaatacagtaatagctggggacttcaacaccccactctcagcactggacagatcatctagacagaaaatcatcacagaaacattggmtttaactacactttagaccgtatagacctaatagacatttacagaacttttcatctaatagctgcagaacatacattcttctcatcagcacatgaaagattctccaggatagatcatatcttaggccacaaaacaaattttaagaaattgaaatcatatcaagtatcttctcagaccacaatggaataaaactagaaatcaataacaagtgaaactttggaaattgtacaaatacatggaaattaaacaatatactcctgaatgaccactgggtcaatgaagaaattaagaaggaaataa

SEQ ID NO: 71278 - DNA, 601 bp, Human
aattagtagaaggaaataaatatcagtgcagaattaaaggaactaaagactaaaaaagtacaaagaccaatgaagtgaaaggttgatttttggaaaagataaaatcaataaaccaagccaagaaaaaaaagaagacccatataaataaaagcagaaactaaaaaggagacattacaactgataccacagaaatacaaaggaacattacagatttttatgaaccactatacactaacgattggaaaacttaaaagaaatggaattcctggacacatacaccctgccaagatgattgaacaargaagaaatagaaaacctgaacagaccaatggtgagtaatgagattgaaatactaataaaaagtcttccaacaaagaaaagcccgtgaccagatgtctttactgctgaattctcccaaacccatgaagaagaacaccaattcttctcaaactattccaaaaaattgaagaagagggaactcttcctaacttattctatgaggccagcactaccctaccctgataccacaaacagacaaggacacaataaaaaaagaaaaactacatgccaacgtccctgatgaacatagatgcaaaaatat

SEQ ID NO: 71279 - DNA, 601 bp, Human
tgataaaatttaacaccacttcatgattaaaaactctcaacgaattatgaatagaaggaacgtagctcaacataatgaaggtcgtatatgatatacccacagctaacatcatacttagtggggaaaagctaaaagtctttcctttaagaactggaacaggataaggatgcccactttcatcactcttattcaacgtagtactattaatagaagtgctagccagagcagtcaggcaagagaaagaaataaaagacgtccaaattggaaaagaagaagtcaaactgtccctctttgcagaagmcatgatcttatatttagaaattcctaaagactctaccaaaaaactcttagaactgatgaatgacttcagtaaagttgtggggtaaaaaaaaatcagcatacaaaaatcagtagcaattctatacaccaataatgaactcatggaagaagaaaccaataaagcaatcccatttacaattgttatgtagaaaataaaatacctaggaataaatttaaccaaggaggtgaaagacctatacaaggaaaactacaaaacactgatgaaagaaattgaagaagacacaaacaaatgaaaaaacat

SEQ ID NO: 71280 - DNA, 601 bp, Human
aaaataacagatgcgggtgaggatagagagaaatggaactcttatgcattgttggcagggatgtaaatttgtatagccattatggaaaacagtgtggaggtttctcaaactaaaaagagaactaccatatgattccgcagtcccactactgggtatttatccaaagaaaaatcagtatatcaaaggaacacctgcacaatagccaaaatatagaatcaacctaagcatccatcaacagataaatggataaagaaaatttggtgtagctgggtgtggcggttcatgcctgtaatcccagcamtttggaaggccaaggcaggtagatcccctgaggtcaggagttcaaaaccagcctttcacatggtgaaaccccatctctactaaaaatacaaaaaattagccaggcatggtgatgggcacctgtaatcccagctactcaggaggctgaagcaggagaatcacctgaacctggaaaatggaggttgcagtgagctgagatcgtgccattgcactccagcctgggcaacaagagtgaaaccccatctcaaaaaaaaaaaaaaaagaaaagaaaatttgatgtatatacacatggaatgctatt

SEQ ID NO: 71281 - DNA, 601 bp, Human
tcccacatacgtgggagctaaaaaagttgatctcatggaggtaaagagtataatgatagttactagaggctgggaaggatgagtggggggatgaagagaagttggttaatgggtacaaacatacagttatgtagaaggagtaagttttagtgtcagtagcacagtgtgtgactatagctaacagcaaggtattgtatatttcaaaaacagggagatttgaaatgtttccaacacaaatgataaatgtttgaggtgatgaatatcctaaatatgctgatttgaccattgcacattgtattcrtgtatcaaaatatcacatgtaccccatatgtgtgtataattattatgtatcaattaaaatatatagatttttaaaaagatggctgctgcagctccacatatcacctccttattccaggcatgaagaaggaagaaaggggaaaggtgatagctgagttcatctcagggccccctcccgttccctgggacttcggcccctgagcttgcagccgccaatgccgccccgtctttttggcagttgatcgcactctacttcccactgcttgggatttcttccttcgatgcaagcctagctgcctcc

SEQ ID NO: 71282 - DNA, 601 bp, Human
gatgaagagaagttggttaatgggtacaaacatacagttatgtagaaggagtaagttttagtgtcagtagcacagtgtgtgactatagctaacagcaaggtattgtatatttcaaaaacagggagatttgaaatgtttccaacacaaatgataaatgtttgaggtgatgaatatcctaaatatgctgatttgaccattgcacattgtattcatgtatcaaaatatcacatgtaccccatatgtgtgtataattattatgtatcaattaaaatatatagatttttaaaaagatggctgctgyagctccacatatcacctccttattccaggcatgaagaaggaagaaaggggaaaggtgatagctgagttcatctcagggccccctcccgttccctgggacttcggcccctgagcttgcagccgccaatgccgccccgtctttttggcagttgatcgcactctacttcccactgcttgggatttcttccttcgatgcaagcctagctgcctccactcatcaggggtccctttttaccttgcagggccacgtggatgttttaagccatcccgcccaccactgctaaggatttggtgcaggaaa

SEQ ID NO: 71283 - DNA, 601 bp, Human
cgccccgtctttttggcagttgatcgcactctacttcccactgcttgggatttcttccttcgatgcaagcctagctgcctccactcatcaggggtccctttttaccttgcagggccacgtggatgttttaagccatcccgcccaccactgctaaggatttggtgcaggaaagggaggctgaggcctgggctcagtctgccatcttgatccagtctccctggctgcttcatcttttctagaatttctcacattctactgacctcccagcttgccagtgccgctaacgtcatttcggggtggygggggagaggggagagggaacatgcgtgttcacttggccatctggagctgaaactcttgtttagttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaaggtgcaagggccccctctgcggactggggagggcggggtgggccaggacgttccccaggtgatacatcgccactgactctgtttgg

SEQ ID NO: 71284 - DNA, 601 bp, Human
agaggagaaacacagttagttattttatgagccatggggaaagggagcaaagatttgctgggaactgagactctccttgtttttcagctgaagagggagcccaggacgacgagggtctgctggacaacttcgtcaccttcttcattgctggtttgtagctttggcggtggccaagggcccggagctctgcagaaatgctgtggaccatggatccctcaaacccaactctttgggattttttgggctatctgagcagagctcaccgcagggctagggggctgggctgaagggagcagaagcmccatctcctagctgtcttgggggcctctgacctggtaatgcagctggcaattgtggggatgtgtgaagctggcctgtcagctccagagagcttggctgtgtgaatgcaggcatcccctcactcagaatttgtggggaggcctgcattagactggcacaagaagagatgctaagcagcttcattcatttgctcatcagatatttcctgaacatggttcttcacctagaagactcctcttcagccgtcagtgagccctcgcatgcctcctccccagggaagcacaggctgcctcaggcactc

SEQ ID NO: 71285 - DNA, 601 bp, Human
acagtttctagcctattggtggaggtggaaagacagagagacaaatactgatggacgaagaggtctgcaggtgaaaggcatggaggaaggccctttaggtgggagaagcacttgcagatgccccaggagattagaagcggccagtgttaaagcaaggctgcagggcgccattccctgcaatggatagaaaggacttgcggaaccaatggctggtcctcattcctgcagctgggaacccaggtcctggatgaggcttctggacagacctagcctcagtctcctcatctgtaaaatgggggcyttgaggagctctccaggcttctatccagccttccagagagggtttattaatcccgtctcgtccctccagtctatccctgagccctgcgtccagatgctatgggggactggccgagggcacggtgggttgtgtctgtctttccctttgcctgtgaggaaactgaggccgaggagggaagtggcctcctatagtcacagcccgcgatgcagagctggggccagggctgctgtgttctcccaccctgctcccaggctgagggctccgctggctgtgtgaatggcccacctccacaccctagga

SEQ ID NO: 71286 - DNA, 601 bp, Human
caggctgagggctccgctggctgtgtgaatggcccacctccacaccctaggagctgggccctgcttcccagctctgacttgctgtaagttataggcccttctcctgcattcaagcaggcccctcaagccccctggctcctttagagtaaactcacgtctgttccctcccaggccagcttggaggggttgactctatcaccttggccagaccctgccagaactcaaaatcagcctcccgaaatgtccaccaccccctcatagaacctcagggtcatggggggcttttgtgtgcaccctgcakcctgggaaggcgaggccttgggctcacggactttgaattgtgtcccccccactctccctgctgtgtgaccacagagacccattcctctccacctccactttctcttctccaaaatggaggtgagcacctccccgggccaagtgagacctagacgatggttcaaggaaggggcttttagagccagatgcctgggggcacatgccatttacatgccagcactggctggcatagaggcaggcacaaactgtctccttcatcctgtggccccatgtggagcaaccaccgtcctcccttcccaca

SEQ ID NO: 71287 - DNA, 601 bp, Human
tccgctggctgtgtgaatggcccacctccacaccctaggagctgggccctgcttcccagctctgacttgctgtaagttataggcccttctcctgcattcaagcaggcccctcaagccccctggctcctttagagtaaactcacgtctgttccctcccaggccagcttggaggggttgactctatcaccttggccagaccctgccagaactcaaaatcagcctcccgaaatgtccaccaccccctcatagaacctcagggtcatggggggcttttgtgtgcaccctgcatcctgggaaggcraggccttgggctcacggactttgaattgtgtcccccccactctccctgctgtgtgaccacagagacccattcctctccacctccactttctcttctccaaaatggaggtgagcacctccccgggccaagtgagacctagacgatggttcaaggaaggggcttttagagccagatgcctgggggcacatgccatttacatgccagcactggctggcatagaggcaggcacaaactgtctccttcatcctgtggccccatgtggagcaaccaccgtcctcccttcccacaggtcacgagacc

SEQ ID NO: 71288 - DNA, 601 bp, Human
ggctggcaaagaggtctgtctgatttcttgttcctgagggccacctgcccccacctcccatggttgagtcccctcaacatgccctgcttcccctgggccttggcacatgctgttccctctcttggaagcgctctccctgcttttcccctggagaacacacctcctcctcccactcctcttctagaaagggcttctcagatccctaaaggagccaccccacgtttcccctccgagcctgctcccgactcatgagtgtgtttccctgggattgtttcatgtctatttcagccatgagaccagragctccaggagggcagggaccgtggttttttccctccccacagcgtacccagtgcctggccagggcctggcagtgaggatggagcagaatccctgctaaattgccaagagcgtgcttgtcttctgatggcaagacaaaggagggtgtccctggggaggtggtatttgagtcgggccattggtttccttaaatacaaacaggctccctctgggacagttgcatggagtggctgaagcaagtgtcaaagctctctgaatgcaccaacaggctgggtgggagctctggggaggtggggtcagg

SEQ ID NO: 71289 - DNA, 601 bp, Human
cccgactcatgagtgtgtttccctgggattgtttcatgtctatttcagccatgagaccagaagctccaggagggcagggaccgtggttttttccctccccacagcgtacccagtgcctggccagggcctggcagtgaggatggagcagaatccctgctaaattgccaagagcgtgcttgtcttctgatggcaagacaaaggagggtgtccctggggaggtggtatttgagtcgggccattggtttccttaaatacaaacaggctccctctgggacagttgcatggagtggctgaagcaagkgtcaaagctctctgaatgcaccaacaggctgggtgggagctctggggaggtggggtcaggccttcaattacaattattagtcatcagcagcatataagggcggaagtgaaagattgtgtgaaaatatacaatctttctagggtttaaaaataagtataattgtaataagcatttcgtataaaaattttgggaaaagcagaaaagctataataataataataaacccacccatggcaccccacccacccagcggcacttcgctgttaactgctgagtatctgttcagcaccttctcaccta

SEQ ID NO: 71290 - DNA, 601 bp, Human
ccaaatccactctttaaaaaattgtggtaaaatatacataacataaaattttacattttcattgtttttaagcccacagtttagtggcattaagggcattcacattgtgaatgtcatccccctccactatttttatttttacttttttgagacagagtcttgctctgttgcccaggctggagtgcagtctcagctcactgcaacctccgcctccccagttcaaacagttctcctgcctcagcctccagagtagctgggattacaggtgtgcaccaccacacctggctaatttttttttttktttgtatttttagtagagacggggttttgccatgttggccaggctggtctcaaactcctggcctgaagtgatccacccatcttggcatcacaaagtgctgggattacaggtgtgagccactgctcctggcctccgtctccagacctttttcatcttcccaaactgaaaatctgtccgttctcgcctccccatccctggtaaccaccattccacttctgtctctgtgtgtttgtctattctaggtgacttatgtaagtggactcatacagtatttgtcttttttgtgactggcttgtttca

SEQ ID NO: 71291 - DNA, 601 bp, Human
aaatccactctttaaaaaattgtggtaaaatatacataacataaaattttacattttcattgtttttaagcccacagtttagtggcattaagggcattcacattgtgaatgtcatccccctccactatttttatttttacttttttgagacagagtcttgctctgttgcccaggctggagtgcagtctcagctcactgcaacctccgcctccccagttcaaacagttctcctgcctcagcctccagagtagctgggattacaggtgtgcaccaccacacctggctaatttttttttttttktgtatttttagtagagacggggttttgccatgttggccaggctggtctcaaactcctggcctgaagtgatccacccatcttggcatcacaaagtgctgggattacaggtgtgagccactgctcctggcctccgtctccagacctttttcatcttcccaaactgaaaatctgtccgttctcgcctccccatccctggtaaccaccattccacttctgtctctgtgtgtttgtctattctaggtgacttatgtaagtggactcatacagtatttgtcttttttgtgactggcttgtttcact

SEQ ID NO: 71292 - DNA, 601 bp, Human
aatccactctttaaaaaattgtggtaaaatatacataacataaaattttacattttcattgtttttaagcccacagtttagtggcattaagggcattcacattgtgaatgtcatccccctccactatttttatttttacttttttgagacagagtcttgctctgttgcccaggctggagtgcagtctcagctcactgcaacctccgcctccccagttcaaacagttctcctgcctcagcctccagagtagctgggattacaggtgtgcaccaccacacctggctaatttttttttttttttgtatttttagtagagacggggttttgccatgttggccaggctggtctcaaactcctggcctgaagtgatccacccatcttggcatcacaaagtgctgggattacaggtgtgagccactgctcctggcctccgtctccagacctttttcatcttcccaaactgaaaatctgtccgttctcgcctccccatccctggtaaccaccattccacttctgtctctgtgtgtttgtctattctaggtgacttatgtaagtggactcatacagtatttgtcttttttgtgactggcttgtttcactc

SEQ ID NO: 71293 - DNA, 601 bp, Human
tgcagtctcagctcactgcaacctccgcctccccagttcaaacagttctcctgcctcagcctccagagtagctgggattacaggtgtgcaccaccacacctggctaatttttttttttttttgtatttttagtagagacggggttttgccatgttggccaggctggtctcaaactcctggcctgaagtgatccacccatcttggcatcacaaagtgctgggattacaggtgtgagccactgctcctggcctccgtctccagacctttttcatcttcccaaactgaaaatctgtccgttctygcctccccatccctggtaaccaccattccacttctgtctctgtgtgtttgtctattctaggtgacttatgtaagtggactcatacagtatttgtcttttttgtgactggcttgtttcactcgaataatgtcctccaagttcatccatgttgcagtatgtgtcagaactcccttccttttttttcttttctttttttttttttttttaagacagagtctcactctgtcgcccaggctgcagtgcagtggcacaatctcagctcactgcaagctccacctcccgggttcacaccattcttct

SEQ ID NO: 71294 - DNA, 601 bp, Human
ttttcttttctttttttttttttttttaagacagagtctcactctgtcgcccaggctgcagtgcagtggcacaatctcagctcactgcaagctccacctcccgggttcacaccattcttctgcctcagcctcccaagtagctgggactataggtgcacgccaccatgcctggctaattttttttgtatttttagtagagacggggcttcacgggttagccaggatggtcttgatctcctgacctcatgatccacccgcctcggcctcccaaagtgctgggattacaggcatgagccaccgygcccggcagaactcccttcctttttaagacttactaatgttccattgtaagcatcggtcccattttgcatattcatatatctgtccatgggtacctgggttgctcctaccgtttgtctattttgaataatgctgctatgaggatgggtacacaaatatctttttaagtccctgctttcagttgttttgggtttatactcagaagtgggattgctggatcatatggtgattctatttttaattttttgaagaatcaccataccgttttccataacggctgaaccattttacattcccacca

SEQ ID NO: 71295 - DNA, 601 bp, Human
ggctgcagtgcagtggcacaatctcagctcactgcaagctccacctcccgggttcacaccattcttctgcctcagcctcccaagtagctgggactataggtgcacgccaccatgcctggctaattttttttgtatttttagtagagacggggcttcacgggttagccaggatggtcttgatctcctgacctcatgatccacccgcctcggcctcccaaagtgctgggattacaggcatgagccaccgtgcccggcagaactcccttcctttttaagacttactaatgttccattgtaagcrtcggtcccattttgcatattcatatatctgtccatgggtacctgggttgctcctaccgtttgtctattttgaataatgctgctatgaggatgggtacacaaatatctttttaagtccctgctttcagttgttttgggtttatactcagaagtgggattgctggatcatatggtgattctatttttaattttttgaagaatcaccataccgttttccataacggctgaaccattttacattcccaccagcagtgcgcaagggttctttctgatttgtccacatcctctacaatacttttgt

SEQ ID NO: 71296 - DNA, 601 bp, Human
tgtgtgtgtgtgtgtgtgtgtgtgtgtgtgcctgtgtgcattcacgcagtaatatattgtaggacttgttttttgactcagtataaagttggtaagatttgtgtaggtttctccacaaggccgtaggacaaccaccatcgctgatcagttctcaggtgacaggcatttgagaggtgtccagtttgtccctatctcgagcaccacagcaacgatgccatttctgtccgcatgtccaggaacagtgtgcaagccagctcctcggacatttacccagaagtgagagggctgggttgtaggaccyctgactgttcagctttacaaacgaacgccacattgttttccaaagtggctgcaccaacttggatgcccagtagtggtgagagagagcacctgctgttcttcatcatctccagcacttagcatggtccgattttgtgtctgctgccatccaaatatgtgtttttaaaaaagtatttcactgtggtcttgatttatgctttcctgattactaactagtaagcgtgagcatctgaccctgctttctctgtctctgagatgtgggctcagtttcccttttggggtagtgtgttttttcgtattg

SEQ ID NO: 71297 - DNA, 601 bp, Human
atcgctgatcagttctcaggtgacaggcatttgagaggtgtccagtttgtccctatctcgagcaccacagcaacgatgccatttctgtccgcatgtccaggaacagtgtgcaagccagctcctcggacatttacccagaagtgagagggctgggttgtaggacccctgactgttcagctttacaaacgaacgccacattgttttccaaagtggctgcaccaacttggatgcccagtagtggtgagagagagcacctgctgttcttcatcatctccagcacttagcatggtccgattttgtrtctgctgccatccaaatatgtgtttttaaaaaagtatttcactgtggtcttgatttatgctttcctgattactaactagtaagcgtgagcatctgaccctgctttctctgtctctgagatgtgggctcagtttcccttttggggtagtgtgttttttcgtattgctatgtagagcgttattttattttattattttttacggcatacatttatttactattattttcattattttgtttttaaatagagtcttgctctgtcccccgggctggagtgcagtggcgccatctcggctcactg

SEQ ID NO: 71298 - DNA, 601 bp, Human
caggacattcacttacattgtcctcagttttacatttttcttttcaaagttgagcttgtaactacctggaattgattttgtgtgtagtttcaaggtagggacctttctgtattgacttgccagggctgttgtaacaaagtgccacagactttggcttaaacaacagaaatttattttctcccagtcctggaggctggaagtctgagatcaaggtgttggaggttggtttcttctgagggctcactccttggtgtgcagacagccaccttctccctgtgtctccacatggtcttccttctgygtgtctgtgtcctaatctcctcttataaggacaccaatcaggttggattagggcccatcctaagtacctcattttaagttaattacctcgttaaagaccttgtctccaaacacagccgcattctgaggtactggggattaggactccaacatatgaggatttgtggggggcaaaattcagcccatgacaggatcctttttatttttacctgtgaggaaggaggagccccagtccctgctcccagcccctctcctcccagggttctgccctgcctcctccagcatccatccaagcctcatc

SEQ ID NO: 71299 - DNA, 601 bp, Human
tccacatggtcttccttctgtgtgtctgtgtcctaatctcctcttataaggacaccaatcaggttggattagggcccatcctaagtacctcattttaagttaattacctcgttaaagaccttgtctccaaacacagccgcattctgaggtactggggattaggactccaacatatgaggatttgtggggggcaaaattcagcccatgacaggatcctttttatttttacctgtgaggaaggaggagccccagtccctgctcccagcccctctcctcccagggttctgccctgcctcctccwgcatccatccaagcctcatctgtggccactctgccatctgttttgccaagctttcttttttaatgctcctgtaccaataccactgtgccttaacagccatctccttagatccccttacagccagcaggggaagccctgtggctcactctcagcctgggggtgccaccctgtgggctttgagtgggcagactgggctccaaccccacctctgctcctggctggctgggtcatctccatcaggccttcggcttcctctttgttaggtggggggagtggtgagcatcagtaggatgacgtaca

SEQ ID NO: 71300 - DNA, 601 bp, Human
ccacatggtcttccttctgtgtgtctgtgtcctaatctcctcttataaggacaccaatcaggttggattagggcccatcctaagtacctcattttaagttaattacctcgttaaagaccttgtctccaaacacagccgcattctgaggtactggggattaggactccaacatatgaggatttgtggggggcaaaattcagcccatgacaggatcctttttatttttacctgtgaggaaggaggagccccagtccctgctcccagcccctctcctcccagggttctgccctgcctcctccascatccatccaagcctcatctgtggccactctgccatctgttttgccaagctttcttttttaatgctcctgtaccaataccactgtgccttaacagccatctccttagatccccttacagccagcaggggaagccctgtggctcactctcagcctgggggtgccaccctgtgggctttgagtgggcagactgggctccaaccccacctctgctcctggctggctgggtcatctccatcaggccttcggcttcctctttgttaggtggggggagtggtgagcatcagtaggatgacgtacat

SEQ ID NO: 71301 - DNA, 601 bp, Human
tctgctcctggctggctgggtcatctccatcaggccttcggcttcctctttgttaggtggggggagtggtgagcatcagtaggatgacgtacatcatgtgtctggcaacaatccccggcacatcttaggtgccctaaacccagcccccacaccggatgctcccacacacttgctggagctcagctccagggctccctgcaccctctgctgcactgacccccagcacagagagccaggggtggaacaggcttaggaggagattttgtcccagtgtttggaggccaaggacacagagtgagcrtcagccccactcaggaggcaccacacgtgcacgtggaaggctggtggggtctgcagttcctccactcccacccctgctgaagtaggccttgagttgaagagaaactgaatataacagttctcgggatctagaggaagttggcctcacagagtcagatctgagtttgaatcccggtttggccatttatttgcctggtgacttcaggtgagtcactgagcctctctctgggtctcagtttcctcatctgtaaaatggggacaatgacggctcccctacagggctgagcccagcacaggatga

SEQ ID NO: 71302 - DNA, 601 bp, Human
aggactggctgtgttttgcacggaggagagcgcaaaacaggaggctccccaggctctcacaggctctccaggaggagagccggctgtgacatttgctgctcattcactcactcattctgtctttgctccttcattccttcctcattttgcccgctgggcccagatggaggtgaaggtggtcatggcaaagctgctgcagaggctggagttccggctggtgcccgggcagcgcttcgggctgcaggagcaggccacactcaagccactggaccccgtgctgtgcaccctgcggccccgcggytggcagcccgcacccccaccacccccctgctgagggggcctccaggcaggacgagactcctcgggcaagggccgtgcccgcccacctctgctgcccacggccacccacccttctcccctgccccgtcccctgggccacccttcacgctggcttccagcgggccctctgccgaccgcctgcttcacacccctcagcgctccctgtcgcctgcggactccatggcccttcctggactggcccttgcccaactcccagccaccaccactgtccctaccactgagcccttgcacaggccacttg

SEQ ID NO: 71303 - DNA, 601 bp, Human
atcatgcccagctcacaaacttcttttaatgctgggaaaaaaaaaaaacctgaagtgttttaaaaagtgaacagtagctatcctttataagacaatttatgatttgggaaataactccatattttcttcgaggcctcattttgaagtaggtggtgttaccatccttcctttgtgcctgagaaaacggaggctcgaagagatttggcaactttatcaggccacagaactaggaagggcttggataccagtctaaatctttgtgtgtgtatgtgtgtgtgtgtgtgtgtgtgtgtgtgagagggtaatagctttattgaaatatttacataccataaaaatgtgtttttaaagtgtaccattaagtgcgtgtagtatattcacagaattgtccagttgttaccactctctgattttagaacctttgcatcactccagaagaaaccctagtacctactagcagtcactccatgttcccccatcgccctcacccctggcaaccattaatctactttctgtctttatagattctgggcattttatttaaatggaattatagaatgtttggtattttgttcctggcttctttcacttagcatatgtt

SEQ ID NO: 71304 - DNA, 601 bp, Human
taaaaatgtgtttttaaagtgtaccattaagtgcgtgtagtatattcacagaattgtccagttgttaccactctctgattttagaacctttgcatcactccagaagaaaccctagtacctactagcagtcactccatgttcccccatcgccctcacccctggcaaccattaatctactttctgtctttatagattctgggcattttatttaaatggaattatagaatgtttggtattttgttcctggcttctttcacttagcatatgttttaaggttcatccatgttgtagcctgtgtcakcatgccattcctttttatggccaaattatattcccttgtggagagataccacactgtttaaatctgttacttgttgatgggttatttgggttatttccactttttgactcttatcaataatgctactatgggcactcacatgcacatttttgtgtggacctatgttttcatttctcttgggcagatatctaggagcagaattgctaggtcatatggtaactctgggcttaacatttttaggaaccagtcttaactttttgaaacctaaatattaagcttgttttattatacatttttgat

SEQ ID NO: 71305 - DNA, 601 bp, Human
cgcattttggtggaaaaaaatcacaaaactgtgcttaaaaagtaaccattaattggttattgtccatttctgggatagtgtaaaccttttcacatattctcttaaaaaacattttagttgagtggaggttggataagagaggagaaataacatctttgtttctagtgttacagcttgttcatgctataaaactagtagcgtgaaaaccttcatcatggataacattgaaaacggaacatgaaagcattgctctctctagtaagacagtctctccaaggacttaaaatcagtggcattttgyactccttacaaaaatttctttcaggaacaactattcatccttaaaattttatcaagctcattaatagagggtttctagtattagcaaaatttttaaacaccttcagaagcattactaattacaaacaaaaagtgtgctgtaaactctaaaagctgtataattattattgataccacccgtcacccccagcttcatgtttttctcactagacgtttggcacatagatttcatttctgctgaaggctgcacattcattttaatctggcccaggactgggggtgtgcgaaggtgtcagcagga

SEQ ID NO: 71306 - DNA, 601 bp, Human
cgggcttcctaagagaggcatccgtgagagcgtctttctagtctgctcactgcaggcgggtaggtgggagtggggagagccattcgggccagggaagcgtctaagaagccctgggtgggaaagaacctttagagaactgaaagaaggttgcctgtggtgaaagggaaaggagtagcgtggcttgcagtaggactgggagcgtgttttggggacatggtaaggagtttggtcttcttcctaggagcagtgggaatacaggggagaattttgaggcaagggagcgacttgttcacattttttrttttaaaagatcactctgcttccagggggagggcaggtgggaagggcagtccagggtggaggtaggagggtagaggtggggggccatggcagtaacccagggagaggcaatggtgattcaccctgggcggggtgttgggagcaagacgcaggagatacttagtgggtaacatcctgtatttacattaagagtggggagagggcagaatcaaggctgacgcccaggtctctgatgcctgcaactggagatggcaggacaggccagggggcctgtgcagagatggcagtccaggccacgggg

SEQ ID NO: 71307 - DNA, 601 bp, Human
caccatgccacacatgtgacaggtgcatgccaaataaagcacgcccaccgcttccctgtgtgcttgaaacaacgtgtatcaatgtgtatagtatataccacatgtgcatataactgtatgtatacctgcgtatctacgtgcattatacacacatgcacacatgtgacattgaactctacccttcagcaaagaactggtagacttagacattcagaagagaaggctttccagacgagggaccttattggtagaacccagaaacatatgaatgcaggcccaggagactggcttagtacagagwcaaaacttgccaccacagttgctgctgaatgcctctcgctagacaccgcttcactggaatcaataagtagagacgtttgcaaaaagcatttggtggtttcactggcttaaaacaaattattttcagccaaagtaattgacacaatgaagtggtttttggcaactccagcatttttaacagtaaaaaggatttgacttaaatcgccccccaaaaagttatgtaacatgaattttaccattcttagaaaaatatgttccagttgagaaacgattgaatggaattaggactctcttatactgc

SEQ ID NO: 71308 - DNA, 601 bp, Human
aggagtctctgaacagatttccttgtcttcacctgtttttcttcaaatcctacttcttcagcacttttaaaaatggaaacctcatttatctctgaattgcccagcatcccccggaagttccccatgactcttggggttcagggccgattctgggaaccacttgccacctgcttccctgaccctttcctcccagggccctggatgcagccaccctggacttctggtagcttctgaaggtgccaggctgttgtgtacaggattccacatgctgagcgcccttgccttccctgcagcgtccctycctaccccttcttcacggagccgctcccttgtccttcagaaccctgctcccatgccacgggaaacctcagggcaggtagatgtaggcgcagctcactgggtgccccttaggccccaggccacgtgtctcagggcatagccagctccacttaaccgaccagaccaggaggacctgtaggatgtcattctggctcatgtgactcagtgggctctcagtactagtttgttgaacaaaagagttcagagtggaaatattaaatggtactttgagtcgtgcctacttaggacattttaacttttc

SEQ ID NO: 71309 - DNA, 601 bp, Human
gcccaagcagtcctctagcatcagcctcctaagtagctgggactataggcacatgccaccgtgcccagctaatttttttatttttttgtggaaatggggtctcgatttgttcctcaagctggttttgaactcctgggctgaagtgatcctcctgcctcaacttcccaaagtgttgggattacagccatgagccactacacccagccctagaaccctttttttttcaaaaaaaaatttaatcatggtaaaatacatataaaatttagcatcttacacatttttaagtgtacagttcatggcrctaagtacattcacattgttgtgcagccatcactgccatccatctgcagaacttttcatcttcccaaactgaaatctgtccccattacataattccccactctcccccgccagctcctggtccagcattcgactttcttgtctctgtgcatttgactactttagatatctcatgtaagtggaatcacacaatatttgtctttttaggagtggcttacttcagtttcagaatgtttttttgaaaacaatagtttcatgaagttacagaatcctaaactgaatgtttaactaaaaggttcaa

SEQ ID NO: 71310 - DNA, 601 bp, Human
aaaatacatataaaatttagcatcttacacatttttaagtgtacagttcatggcgctaagtacattcacattgttgtgcagccatcactgccatccatctgcagaacttttcatcttcccaaactgaaatctgtccccattacataattccccactctcccccgccagctcctggtccagcattcgactttcttgtctctgtgcatttgactactttagatatctcatgtaagtggaatcacacaatatttgtctttttaggagtggcttacttcagtttcagaatgtttttttgaaaacmatagtttcatgaagttacagaatcctaaactgaatgtttaactaaaaggttcaaagccctgggcaagaagtgggataattacctgcacatttgaggctgtcagaacgcctgaagatgtgtcaccggatcacacccacgtgcattacaagcagccctgctcagcctcctgtgtaaagttttggtatccgatctccagaatcttttttttttttttttttttttttgagacattcttgttgcccaggctggagtgcagtggcgttaatctcggctcaccgcaacctctgcctcccgggttca

SEQ ID NO: 71311 - DNA, 601 bp, Human
caccttagtgttgtcttgatggttacagctgggttgacttatcctcattcctgatgcctagtaggtatctcataaatgttagatttgtggtcttaccacacccctctgcttactgtgtgccaagagtttccaggactctgtggtcatgctttatcagtcacgagcccctcctttttccgtatttaaatactgttcatgccttaagacccggcctacagactatccctggggtgaagtcttccctcatctgtcccggattacttggtctttcctctgcgtttctgaattatgatacataccsctctgatcactgctggtttccctctgccctgcaccgtggtcagctgtgagggcctttgttgccaccatcagctagtgagttccttgagggcaggggcgctgtgttgtctttttctttcgtttgcttctttcccctgctctgcacagtgcctcgcagggagtttgtctccagtacattcttgttgaatgaaaaatcagatgctgaaattatgcaaagagctgtgttatctttaaattattataagagacaaggagagaacttctggatcctgagaagcttttcagtaataccagaaacatt

SEQ ID NO: 71312 - DNA, 601 bp, Human
ggtttccctctgccctgcaccgtggtcagctgtgagggcctttgttgccaccatcagctagtgagttccttgagggcaggggcgctgtgttgtctttttctttcgtttgcttctttcccctgctctgcacagtgcctcgcagggagtttgtctccagtacattcttgttgaatgaaaaatcagatgctgaaattatgcaaagagctgtgttatctttaaattattataagagacaaggagagaacttctggatcctgagaagcttttcagtaataccagaaacatttcttcattgtgtacrgtaataaaataacacacagtcataggtggcaaagcctcctaattactgtaggttggagtcagagtgtaagaacttccagcattcatggatcacatatattatatacgtatttagtgaaaaacaatatatattatttaattttgtttatttttctatttttgttcaaaatggtctctaaatgcaggccaaccacggtgtgtatttaactccccaaacaggaatctattccagtcttggagggatttgctgagagatgatacagtttacacaaaaccacgtatgctccacactgtggactat

SEQ ID NO: 71313 - DNA, 601 bp, Human
actgtggactatctggggaatttttcaagagtaatttcaacacactctattttccatccaattcactgcccttagaacataaccccaatataaaatgatctcctttctaatattttacagtttttaaagcaccttcagatctgtttctcacttaattctcacaaccaaactctaaggtaagtaaaatactactttatcatatttatcttacatgtaatcagggaagctgatgggtgctgagtaacttagccaaggccaaatagttcagtgaggaccacatctcgatcctaggtctcccgaraaaaaccccaggtttctttgaactataccaagtggctttctatttgttgtcttcatgttagcatccgtgttgacctggtaatctatacctttataaaaagagaaaatacgctatagataattgaatttttgcaaattttgttatttttttccctgcaccttgaaaattgttatgccctgctttaagaaaccccgacattctgtaacattttctgaacattttcaattcccctatctgcttaaatatcatatttatcaaactttgaccttgttcttcaggccacattgtaggtaaagtggc

SEQ ID NO: 71314 - DNA, 601 bp, Human
ccatccaattcactgcccttagaacataaccccaatataaaatgatctcctttctaatattttacagtttttaaagcaccttcagatctgtttctcacttaattctcacaaccaaactctaaggtaagtaaaatactactttatcatatttatcttacatgtaatcagggaagctgatgggtgctgagtaacttagccaaggccaaatagttcagtgaggaccacatctcgatcctaggtctcccgaaaaaaaccccaggtttctttgaactataccaagtggctttctatttgttgtctycatgttagcatccgtgttgacctggtaatctatacctttataaaaagagaaaatacgctatagataattgaatttttgcaaattttgttatttttttccctgcaccttgaaaattgttatgccctgctttaagaaaccccgacattctgtaacattttctgaacattttcaattcccctatctgcttaaatatcatatttatcaaactttgaccttgttcttcaggccacattgtaggtaaagtggcttgttttttattttatttatttatttatttaattcctcttctccctcaaagca

SEQ ID NO: 71315 - DNA, 601 bp, Human
ttctatttgttgtcttcatgttagcatccgtgttgacctggtaatctatacctttataaaaagagaaaatacgctatagataattgaatttttgcaaattttgttatttttttccctgcaccttgaaaattgttatgccctgctttaagaaaccccgacattctgtaacattttctgaacattttcaattcccctatctgcttaaatatcatatttatcaaactttgaccttgttcttcaggccacattgtaggtaaagtggcttgttttttattttatttatttatttatttaattcctsttctccctcaaagcacaatctgctgtatgttaaaggggcggggaagctgctgactttgcagtagcgcatacttactcacgcaattttccattctggctgaagtaagggatgagacagcatgcccagaagctgtgtccagcacttggacaggcgccctggtcggcaccctgggaacctcggccgtgcactgccagctttctgggtccatcccagccctgggtgtatggcagatgccttgagatttaacagcccttgagtcaggcctgcaacgtcttatctgcgatttcaacatccagaaag

SEQ ID NO: 71316 - DNA, 601 bp, Human
tgggtatgttaattagcttgatgtaatcatccacatacatatacatgtatcaaagcattgcattgtaccccctaaatatatacaattattgtcagttaaagaaaaaactctgatcacatggtaaagtatttctgattcttcttcctcttttcctacatccagatatgtctgtctgggatcccatatggtggttctccccgtctcttatgatgttcacctcatacacggttgacccttgaacaacgcaggggttagggggtgctgagccctagcacagttaaaaattcatgtataatagggkttttttttttgtttttttgggtttttgttttttgaaacagggtctcgctctatcacccaggctagagtgcagtggttgatcacagctcactgcagccttgactcactgggctcaagtgatccacccacgtcggcctcccaaagttctgggattacaggttcgagccactgtgccttgtgttgagtgtaacatttgactcctcaaagtcttaactactaacagcttactattgaccggaaccttaccaataatacaagcagtcgattaacacatattttgtatgttatatgtattgtatac

SEQ ID NO: 71317 - DNA, 601 bp, Human
ggttcgagccactgtgccttgtgttgagtgtaacatttgactcctcaaagtcttaactactaacagcttactattgaccggaaccttaccaataatacaagcagtcgattaacacatattttgtatgttatatgtattgtatactgtattcttacaatacagtgagctagggaaaggaaaatgttactaagaaaatcaagccgagttgggtggctcatgcctgtaatcccaacactttgggtggccaaggcgggaggatcacttgaccctaggagttttagatcagcctgggcaacacgayaaaaccctgtctctaccaaaaaaaaaaaaaaaaaattagccaggctttgtggcacgaacctatagtcccagctacttaagaggctggggtggaggattgcttgaaactggaaggttgaggctgcagtgagccaagatcacatccctgcactccagactaggcaacaggaatgagactatgtctcaaaaagagagagagagagaaaggaaggaaagaaagaaaataaagaaaaatcataaggaagagaaaatacatgtactattcataagtggcagtggatcatcacaaaggtcttcaacc

SEQ ID NO: 71318 - DNA, 601 bp, Human
gggggttagggttgctgatgcagtcagggaggcctgactgtgcatgcccagccccttcatcaccaggcgccatgtgggtgcccaaccaaagacattcatgaggctgtctctctgtgataacgaaacagctggacatacactgagaaaggaagtcagccaaatgaatattttctaacctaactctaaaaaggtagatgccaggcagcatccaggtgacgatgcttttttgaggctgacatagtggtacacagcattgaggtgctgtcagatctcttccctgccgtccacctcccagtgaccmttcctcggctgcacaatgcgcctccccacatgcattgtcccacggccctccctgtacaatcggctcttcactttgcctggctcagaggtgtcttccataccaaagaggctcagagtgtcaggatttaggggaggttggaagcaggtggggtagggaggggagtcagccttcctcctctgcagggttgcagaaagtttcaggggtcaaggaaataataaacacctttgaatagaggctcagaattgtttgtttggagttcccagtgactagtatctcagctgccaacagctttggtgcaat

SEQ ID NO: 71319 - DNA, 601 bp, Human
gtaactcaaaaggaaggtcaaaggaacttattttatttttatttaaatttttttagggaccagatctcgctttgtcactcaggctggagtgcagtttcttggcatgatcctggctcactataatctcgaactcctgggctcaagcaatcctcacaagtagctagactacaaatgtgccccaccaagtccagataattttttttctaaattttgtagtgctgggatcttgctgtgttgcccagaccagtctcaaactcctggtctcaagtgctcttcctgccttggcctgccgaagtgctgrggttacagacatgagccactgtgcctggctggaaagtattttattgtaaagcattttaaaattaataggtcatgaaactataaaacaaagaatagattgcataatggattgtgtgaaaatacaagttaaagctattttacagagcagttagaggcttgtctcatacctcatctgaggctccagtgaatcccaccccaaatggaccagttagcatgcagccaataagacatcttcctgggccacagacaggtcctcttgtgcaggacagctgtcatgcacatggggctcaatggatgttat

SEQ ID NO: 71320 - DNA, 601 bp, Human
gctccacctcccgggttcacacttttctcctgcctcagccttccaagtagctgggactacaggcacctgccaccactcccggctaattttttgtatttttaatagagacggggtttcactgtgttagccaggatggtctcgatctcctgaccttgtgatctgctcgcctcggcttcccaaagtgccaagattacaggtgtgagccactgcgccctgctgaggcttggcttctaagaactgcacaccttctaatagtataatgatatgcccccttgttgtgtcatgactaacattgatttawtttagagaaaattgtaattgatctatttttcttctgcaaacaatggtttctttttgactttgttaaaatgaagatgaatagctttttattttagagagccaaattgtagcagctctttgtaaatactttctgcattctagaaaaacaactttgattggatggcagaactggagattagtagaattaggaaaatttctgagttactctttgttgggtttttgtgagctaaggggatttttagggtgtttgtgatgtttctttatgacttgaaaggtaaattgcgtcggtgacatcagcctt

SEQ ID NO: 71321 - DNA, 601 bp, Human
tctgacccacattgcttcttagtttggtccaactttgaaagttgcatgtttcatttgaaatgaagaaggcctaagccagaatggtacagctgtcacatccaagtgtaagatccatttctaactgccagaggcatggcagatgcctcagagaagggaggagtccatttggatggagctgtgtgtggctgacatcttcctactccatgtccttcactttggcacgtaggttagcagttctcaagctttttggtctgtcttgcgtttaaatggctgttctcccaggcttgattttgtaacaccrtgctttgattccttgagaacattgattctctgagttatgcagaccttccaaatgtgacatatttcattatacaatatcaaaaaagcacatgggttaatatcaacccccaatgtcatcaaaacagcatgtaggtgttggggagctgtcaggcttacagaggctggtacaagttttccaaagttctttcttttttttctggaaagctcaaatttatccttggcagcaaatgctgttgtttttcctggagtgacgggcttactacattcatttttttgagaaaatgattatagaacactcagg

SEQ ID NO: 71322 - DNA, 601 bp, Human
gaggattagaggcaagatgaccatgcgaacttcatgtatcatattcacacacacgtgtgcatcgctctatcttcaggcagaagtgtccagaaggagtcagagctggagcttgagagggttctggccttgaggtgtcagctgaggagtcatcagtgtaggtcgtggttgagggcccccttgttgatgagatcacccagaaggagagtgtggacttgccgactatagtcacagggctcaagtcaggagagaagtcaaagcaagccacgggttttaggaggagggaaacctgaggcctggatcrtcctggtccttcacgtctgcagaggagagcagagaagaattttaaattattaactcctcaactaaactacatatcgtcagaacatgcttttcaaattaatttaattgttgattttatttagttttttagagacagggtctcgctctgtcacccacgcttcagtatagtggtgcaatcatagtttactgcagccttgagaaactcctgagctcaagtgatcctcagcctcctgagtggctgggactgtaggcatgcaccaccctgcttggctaagttttttaaaaagttgttttagagaca

SEQ ID NO: 71323 - DNA, 601 bp, Human
agttcccggctcacagcagcatctgccctgcacgtgggtggtgtcggccttgccctggccgcactgtggctgtgtccccacttagccatcagaaccaggcatttccagtggagtgcagtgttgcaggagggtcaccaggcttagtgtgatgaggcctggattacacttcgggtctggacgtcctctctgagcctgaatttctgtgatctataaaattggataaagtatcaaataataccgatcctaacagtcttgatcattgtagaaacaaatgaaccaatgtctggttagagcctggacygtgaaagtgctagaacgtgttcattcttcctgcgtagattgagtgtctccagggtgccaagcccagttctaggctctgggaaagagcagtgaagacaacaaaccaacaaaacaagtcctcacattctagtgggagagggacagtgggcaagcaagcagataagtgaacaagagagttccctggagggttgagtatggtgaagaactaaaacagtgactgaagggacagagtgtgtagcctggctgtcacttggtatctctctacttaaactggagtcaggcgccatttcctccaggaagc

SEQ ID NO: 71324 - DNA, 601 bp, Human
cttaccactgcaagaaaactttggtgggccgttgtacaacagtaggcaattgtgttggcttaatgtgagttcttgtgaggttgacctttgtatgttttgaaagtctttagcatttaaagtctgcttctgtgcattgatttttttttttttttttttttttttgagatggagtcttgctccgtcacccaggctggagtgcagtggcgtgatctcggctcactgcaacctcctcctcccaggttcaagcaattctcctgcctcagcctctcgagtaactgggattacaggcatgtgccaccaygccctgctaatttttgtatttttagtagacacagggttttgccatgttggccaggctggtttcgaacacctgacctcatgtgatccgcctccctcagcctcccacagtgctgggattacaggcgtgagccactgtgcccagccctatgcattgattttgagcaagaaagggataggactaaattatgtggatgcactgtacaattcccaagaagggttagaattctagtcttgccaactcactcctccaagggcccaagtttgatcaccggaggattattccttaagcagcacgccacag

SEQ ID NO: 71325 - DNA, 601 bp, Human
ggcccagaaggttctcttcattattgctttttgagtgaacacttgaatgaatatatcactttcttgaaagccagtctttcaaaatggttgaattattttgttatttttaaattgtggtaaaatatatgtaacaaaatttgtgattttaaccattttaaatgtataaattcagtgacattaattacattcacaatattgtgcaaccatcaccactctctacttcaaaaattttcatgaccccaaactgaaactcagtactcaatgaagcagcacctccccatccctcccgcctcccagcccstggtaacccacagtctgctttctgtctctgaatttgcctactctgtgtatctcaccttactctgtagtagtgacttagatgaaatataatatttgtctcatacaatactagtctttttgtgactggtttatttcacttagcataatgttttcaagttccatctgcttaccagaactatattcctttatggccaaataatattcgattatatggataggtcccattttgcttatccgttcatccatccatggacatttgggttgtttctaccttctggctattgtgaataatgctgttttg

SEQ ID NO: 71326 - DNA, 601 bp, Human
gctgtttcccaaatgtcccagtagtttttggctattacaaataaagctgcttttaacatttgtgtccatgtctttgtatggatggaggctttcatttctcttggggaaatacttgggcatggaatggccggactcaatagtgggtgtgtgtttagctgtctgccaaagtggttgtaccacctgacatccccacagccatgtcagagatgcaattgctgattcacatgctcaccaaaacttggtgtggtcggtctttttattttcagaccttctaacgggcgtgaggtgataactcatttcrgttttaatttgcatttccctaatgactaatgatgttgagcaccttttgatatgcttatttgccatctgtatatcttccttggccaagtctctgttagatcttttgcttcgttttaaaattgggttattcactttcttgttgagctttgagaatgcttcatatattctggatacaagttctttatcagatatgtgatttgtaaatattttctcttgttctgtggcttatcttttcactctcctaacagtgtcttttgaaaagcagaagttcttaaatctaatttaccatttttttcttttt

SEQ ID NO: 71327 - DNA, 601 bp, Human
ctgaaatatttggtagaattcaccagtgaggttatcagtgatttgtggaaagattttgtttttgtttttgttttgttttgagaaagggtgtgactctgtcgcctaggctggagtgcagtggagtgatcttggctcactgcaacctctatctcccggcttcaagcaatcctcccacctcagcctccctagtagctgggactagaggtgtgcaccaccatacccagctaatttttgtatttttttttgtagagatggggttttcatttgttacccaggcaagtctcaaactcctgagctcaarcaatccacctgcctcagcctcccaaagtgctgggattacaggcgtgagccaccgtgcccagactgtggaaaggtttttaactacaaattctattctttaataggactctttagatctatttcttcttgcatgagctttggtacttttttttctttcaagaatgtgtatattttatctaagttactgaatttattggcataaagtttttaaaaatatttctttatccttttgatatctatcgatctgtagtaatgtcagttctcttatttctgatattgatattttatgtcctttctcttt

SEQ ID NO: 71328 - DNA, 601 bp, Human
aacctctatctcccggcttcaagcaatcctcccacctcagcctccctagtagctgggactagaggtgtgcaccaccatacccagctaatttttgtatttttttttgtagagatggggttttcatttgttacccaggcaagtctcaaactcctgagctcaagcaatccacctgcctcagcctcccaaagtgctgggattacaggcgtgagccaccgtgcccagactgtggaaaggtttttaactacaaattctattctttaataggactctttagatctatttcttcttgcatgagctttgktacttttttttctttcaagaatgtgtatattttatctaagttactgaatttattggcataaagtttttaaaaatatttctttatccttttgatatctatcgatctgtagtaatgtcagttctcttatttctgatattgatattttatgtcctttctctttttttccttgatcaatttggctataggtttgcaaattttattttctcagtgaactagcttttcattccattgattttctccagtgtttttcctgtttcattgatttttgctctaatgtatattgcttcctttttttctgca

SEQ ID NO: 71329 - DNA, 601 bp, Human
tttcatttgttacccaggcaagtctcaaactcctgagctcaagcaatccacctgcctcagcctcccaaagtgctgggattacaggcgtgagccaccgtgcccagactgtggaaaggtttttaactacaaattctattctttaataggactctttagatctatttcttcttgcatgagctttggtacttttttttctttcaagaatgtgtatattttatctaagttactgaatttattggcataaagtttttaaaaatatttctttatccttttgatatctatcgatctgtagtaatgtcarttctcttatttctgatattgatattttatgtcctttctctttttttccttgatcaatttggctataggtttgcaaattttattttctcagtgaactagcttttcattccattgattttctccagtgtttttcctgtttcattgatttttgctctaatgtatattgcttcctttttttctgcatactttgggttcctgaaggtttggttttcttaagtggatgctgagatcattccttccccatcccctacttccttctcctttcttcgtttctaatgtcgatgttgggtgacataaattt

SEQ ID NO: 71330 - DNA, 601 bp, Human
gcatgagctttggtacttttttttctttcaagaatgtgtatattttatctaagttactgaatttattggcataaagtttttaaaaatatttctttatccttttgatatctatcgatctgtagtaatgtcagttctcttatttctgatattgatattttatgtcctttctctttttttccttgatcaatttggctataggtttgcaaattttattttctcagtgaactagcttttcattccattgattttctccagtgtttttcctgtttcattgatttttgctctaatgtatattgcttcstttttttctgcatactttgggttcctgaaggtttggttttcttaagtggatgctgagatcattccttccccatcccctacttccttctcctttcttcgtttctaatgtcgatgttgggtgacataaatttctttctaagcgacagctcacaaattttgatatgctgtgtttttatgtgcattcagttagaaatactttctaattttcctttctgtctaatttgagttagtatttgtgaaagttttgtgtctagatgcattattttgcatgtggacattcaatatttccaacaccatttgc

SEQ ID NO: 71331 - DNA, 601 bp, Human
ttcttgagcttcatttgaaacaggtttattttgaggtgggatcgattcttgtcattttctatgaagtgatgaacgtcagagctggagctcttgtggcaggtccagcttggaggtgagcaggacacagggttcctaactgacccagatgatccaaggagaactgggagtctgagaacagaaataaagctggagcccagccaggagtggtacgcagggctgcgaatctgacagcaaggccgaaatccaggcccgcaagtggcagagcaatgacagttaattgcttctctgtactgattgcttttttcttttgctattggatactaataggatgactccgaatatgacaatagagtataactattccgtgaacaacgtataatatggaaagtctgctttatgtgaaatgtttatctgcaaattattgagcaaagggttattatttgttactgcttaaatgattggttttaaactactaaatctggtaagttttttttctaaatagcatttgtgtaatattttggaaaaggcaaaatgatgtaaaaattctatgtgtattttacttagtaccacagaaatctcactggaattaatacctgtcatt

SEQ ID NO: 71332 - DNA, 601 bp, Human
gacaatagagtataactattccgtgaacaacgtataatatggaaagtctgctttatgtgaaatgtttatctgcaaattattgagcaaagggttattatttgttactgcttaaatgattggttttaaactactaaatctggtaagttttttttctaaatagcatttgtgtaatattttggaaaaggcaaaatgatgtaaaaattctatgtgtattttacttagtaccacagaaatctcactggaattaatacctgtcatttggatggagaactcatatggtgaaaagagcctaggctcacakctcaccctcggctggccacattctagccgtgcaaccttaggcaaggtggaccagaaactcaggttctcctacttcatctgtggcatgagggtggcacctctgtgggagggcgctgtgtggcgtggggacactgggcatggggacactgcaccacaaagcttaggccctgacatacagcggctggtgaatcaagggtggctattattgttttggtgctatcattatcttaaataattaaagaaaataagaacatctcacgataaagggaacagattctaagttaaccttttaaaattacta

SEQ ID NO: 71333 - DNA, 601 bp, Human
ttttttttctaaatagcatttgtgtaatattttggaaaaggcaaaatgatgtaaaaattctatgtgtattttacttagtaccacagaaatctcactggaattaatacctgtcatttggatggagaactcatatggtgaaaagagcctaggctcacagctcaccctcggctggccacattctagccgtgcaaccttaggcaaggtggaccagaaactcaggttctcctacttcatctgtggcatgagggtggcacctctgtgggagggcgctgtgtggcgtggggacactgggcatggggayactgcaccacaaagcttaggccctgacatacagcggctggtgaatcaagggtggctattattgttttggtgctatcattatcttaaataattaaagaaaataagaacatctcacgataaagggaacagattctaagttaaccttttaaaattactaggccactttaacctccgggaatagcactcagataacaatgtcttagtattactggaagatttacagagtcaagagcctgctcttatccctggatagtgagataatcacatgaatggagaaaaaagcatgcttctctcacctttt

SEQ ID NO: 71334 - DNA, 601 bp, Human
ccactttaacctccgggaatagcactcagataacaatgtcttagtattactggaagatttacagagtcaagagcctgctcttatccctggatagtgagataatcacatgaatggagaaaaaagcatgcttctctcaccttttaatagagtgaaacacatcatgttaccggaaacccttttgttctgttttttacagtaagagaaaaagtaattaaacttcaaagtcagatctgtaaatagctacatgaggacctatggtaaaagcagagctacaaggtcttctttttgcttctgaaactgsgggtgatgtaggggctgcccagacccatggcatcccttgaaactcagaaagaagccagtgcttggctgggttctcatgagagtcaagttggagctggaggctatgagaggtaacacttggcctgtccttttgccactggtcgtgtgctgccaagtgagagggctcgtgtggcatcaaaccatgccttatcttaaggctaacatcacatttcctcaacttggccagaggtgctgcagagagagacctgcacagtatttgcagaatttgttcaataattattgttaatcgttgatttcactg

SEQ ID NO: 71335 - DNA, 601 bp, Human
agaatgtcttctcctaccttagtagaactctccctgccttccgcctgaggccagagaccttcccaggtaggtgtgtgttgacccagcgtcctacacaatggttgttacaccaacctgactctgccttcttttattcacacattagaagatttcactgaactgtttaattactcctcagagggaagacagatataaaataccttcttatcttccccacttctctctcccagtggcatgacattttgaagtgagattttctttccctcctatccaaagtcaaaggagaaatggagaaattccmcagaactactgtccattcacaagaagttacatagcacttaaggacagtctctttcccttgagcaataagtacttagttttcattgaaatatttctctgctgagctctcatagtataatagcaaccaatcccaacaagcaaaaataacttgtaaatttgcaaaaccaggccaggcgcagtggctcacacctgtaatcccagcactttgggaggccgaggcgggcggatcacaaggtcaggggttcaagaccaacctggcccacatagcgaaaccccgtctctactgaaaatacaaaaatta

SEQ ID NO: 71336 - DNA, 601 bp, Human
agggtgaagcaggatcacttgaggccatggattcaagaccagcctgggcaacacagtgagaccctgcctctataaaaaatttaaaaattagccaagcgtggtggggtgcgcctgtagtcccagatcctcagaaggctgaggtgggaggatcacttgagcctagggagtgaaggctgcagtgagctgtgatcacacccactgtactgcagcctgggcaacagagtaagaccctgtcaaaaaaaaaaaaataataaaacttaaggtttcataataacataaaaggaaaaaggaaaaaaatgartctttgaactgatgcaggtatttatcatttccagtgctcttcatttttttctgagggtctgagtttgatcttatataatttttctttagcctgaagaactttcattagcatttcttgcagtgcaggtcttttgatgattaattctttctggttttgttactctgaaaatgtctttattttgcttgctttcttggaagatattttgctggatgtaaaattctgaatttagttttttctcacgtggtactttaaagatgtagttccgctctcttctggtctccttagttcatgataagtcag

SEQ ID NO: 71337 - DNA, 601 bp, Human
tttgctggatgtaaaattctgaatttagttttttctcacgtggtactttaaagatgtagttccgctctcttctggtctccttagttcatgataagtcagctgttaatcagactgcaggtcttttgtatttaatatgtcatttttctcttgctgcttttggtatttgttctttatctttggttttcaacagtttgactataatgtaccttgaggtgggctgttttgcatttattttgcttagtctttgattagtatctcataattgtgtgtgtgtatttgtgtgtgtgtgtgtgtgtgtgtrtgtgtatatttatttatttatttatttgtttattttgagacagagtattgctctgttgcccaggctggagtgcagtggtgcaatcttggctcactgcaacttctgcctcctgggttcaagtgatgctcccacctgagcctcccaagtagctgggactatagacgcgcaccaccacacccagctaatttttgaatttttagtagagatggggtttcaccctattggccaggctggtctcgaacacctgaccttaggtgatccgtttgccttggcctcccaaagtgatgggattacagacat

SEQ ID NO: 71338 - DNA, 601 bp, Human
ctggatgtaaaattctgaatttagttttttctcacgtggtactttaaagatgtagttccgctctcttctggtctccttagttcatgataagtcagctgttaatcagactgcaggtcttttgtatttaatatgtcatttttctcttgctgcttttggtatttgttctttatctttggttttcaacagtttgactataatgtaccttgaggtgggctgttttgcatttattttgcttagtctttgattagtatctcataattgtgtgtgtgtatttgtgtgtgtgtgtgtgtgtgtgtgtgtrtatatttatttatttatttatttgtttattttgagacagagtattgctctgttgcccaggctggagtgcagtggtgcaatcttggctcactgcaacttctgcctcctgggttcaagtgatgctcccacctgagcctcccaagtagctgggactatagacgcgcaccaccacacccagctaatttttgaatttttagtagagatggggtttcaccctattggccaggctggtctcgaacacctgaccttaggtgatccgtttgccttggcctcccaaagtgatgggattacagacatgagc

SEQ ID NO: 71339 - DNA, 601 bp, Human
attctgaatttagttttttctcacgtggtactttaaagatgtagttccgctctcttctggtctccttagttcatgataagtcagctgttaatcagactgcaggtcttttgtatttaatatgtcatttttctcttgctgcttttggtatttgttctttatctttggttttcaacagtttgactataatgtaccttgaggtgggctgttttgcatttattttgcttagtctttgattagtatctcataattgtgtgtgtgtatttgtgtgtgtgtgtgtgtgtgtgtgtgtgtatatttatttatttatttatttgtttattttgagacagagtattgctctgttgcccaggctggagtgcagtggtgcaatcttggctcactgcaacttctgcctcctgggttcaagtgatgctcccacctgagcctcccaagtagctgggactatagacgcgcaccaccacacccagctaatttttgaatttttagtagagatggggtttcaccctattggccaggctggtctcgaacacctgaccttaggtgatccgtttgccttggcctcccaaagtgatgggattacagacatgagccacggcacctg

SEQ ID NO: 71340 - DNA, 601 bp, Human
tttgcatttattttgcttagtctttgattagtatctcataattgtgtgtgtgtatttgtgtgtgtgtgtgtgtgtgtgtgtgtgtatatttatttatttatttatttgtttattttgagacagagtattgctctgttgcccaggctggagtgcagtggtgcaatcttggctcactgcaacttctgcctcctgggttcaagtgatgctcccacctgagcctcccaagtagctgggactatagacgcgcaccaccacacccagctaatttttgaatttttagtagagatggggtttcaccctrttggccaggctggtctcgaacacctgaccttaggtgatccgtttgccttggcctcccaaagtgatgggattacagacatgagccacggcacctggcctgtaattgtgtatttgtgttcattaaatttgtgctatttcagccatttatttgtttgttttgtttttgcgccactgcgctccagcctgggcgaccctgtcacccggggtcttgctctgtcacccaggctggagtgcagtggtgcaatctcagctcactgcagccttgacctctcgggccccaagaaactgccccacctcagcc

SEQ ID NO: 71341 - DNA, 601 bp, Human
tgtggcccactgtaatgtgctgggcctgtggataggtattctgtagagagggagctgtcacttgttcccctgtccctgcggttggcctgcttgcaccagttacccaggtcttctttcccttgaggatactgctctgggtcttaggatttcctcagtctctgtgagctccccagactctgctttctccttttcctttgatattttttaaaataggaagaaccggctaccatatcacacaccttcactgtggtgaacctcagcccataaagctggcttggttcatgttggatttactcttggmtagaatgacttggaatgtttccactttgctgagcttggattaccatgtagtggagaaaagagaatcaaatcgttcacgaagggctgtattaaaattcttgctaatacggaagtgtttcagagttgtggttggagtggggcaatactctggtagcagaatacagtgaacagaccccttagatattgctgttgtgaccgtaaatacagacaaatgatggatgagtaagggaattcattgcagcactgtgcgcaacggagaaaaactggataggaaacaataagggagcagcaagcagtaggg

SEQ ID NO: 71342 - DNA, 601 bp, Human
gtgaacctcagcccataaagctggcttggttcatgttggatttactcttggatagaatgacttggaatgtttccactttgctgagcttggattaccatgtagtggagaaaagagaatcaaatcgttcacgaagggctgtattaaaattcttgctaatacggaagtgtttcagagttgtggttggagtggggcaatactctggtagcagaatacagtgaacagaccccttagatattgctgttgtgaccgtaaatacagacaaatgatggatgagtaagggaattcattgcagcactgtgcrcaacggagaaaaactggataggaaacaataagggagcagcaagcagtaggggcatggccaggagatgatggtgcctccatatgattaaatgctgtgtggtctttaaaaatgtttgtgttactggtacaagagggaaaatgcttacgcattacattgagtcaaatgcaggctataaaactgtatatactgtatcatttcaactaaatagacaaaatttatgcaaagaagactggaatgaagtactgtatagcaaaagtaattcacgggttttttcctgagtaataggattatgaattttta

SEQ ID NO: 71343 - DNA, 601 bp, Human
catttcaactaaatagacaaaatttatgcaaagaagactggaatgaagtactgtatagcaaaagtaattcacgggttttttcctgagtaataggattatgaatttttaaatacttttagttagtttctaaatgttctgtggtgtgtatttcttaataagcagaagaaatttgtgttctaaaaaatcacttctttctttgcattgaatctgaggtcaacagcagggctcatggcaaatgtcaggaggccaggggtttactcacatgtgttttcaagaagacagggagtagtttggagttcartcaatccattgtatacacacacagctgattttcattttagtgcagggatttttaaaatgtaaaatgtagatgaaaatatagtcattgtgccatgtatctgggattgtctattttgttatgcattaaccagtgagtagctcatatttcccatttgaaattttgcttgtttgttcagactagttaggcagcttcccttttaaagtactttaatatgaaatactttaatatgcctttgcaacttttacaatcagttataccaactagtggatctatgaattagaatatcaaagaattataata

SEQ ID NO: 71344 - DNA, 601 bp, Human
aagaaatttgtgttctaaaaaatcacttctttctttgcattgaatctgaggtcaacagcagggctcatggcaaatgtcaggaggccaggggtttactcacatgtgttttcaagaagacagggagtagtttggagttcagtcaatccattgtatacacacacagctgattttcattttagtgcagggatttttaaaatgtaaaatgtagatgaaaatatagtcattgtgccatgtatctgggattgtctattttgttatgcattaaccagtgagtagctcatatttcccatttgaaattttkcttgtttgttcagactagttaggcagcttcccttttaaagtactttaatatgaaatactttaatatgcctttgcaacttttacaatcagttataccaactagtggatctatgaattagaatatcaaagaattataataattattggcttcattaattaatggatcagagaattactaaatataaccagaaggcttctgttggggaggttaataagcaagtcagtcctgtcattccaagacatcaaaaccctctagcctcagtacatagcctctgcaaccactgtcaaaagccaactacag

SEQ ID NO: 71345 - DNA, 601 bp, Human
ctttgcattgaatctgaggtcaacagcagggctcatggcaaatgtcaggaggccaggggtttactcacatgtgttttcaagaagacagggagtagtttggagttcagtcaatccattgtatacacacacagctgattttcattttagtgcagggatttttaaaatgtaaaatgtagatgaaaatatagtcattgtgccatgtatctgggattgtctattttgttatgcattaaccagtgagtagctcatatttcccatttgaaattttgcttgtttgttcagactagttaggcagcttccyttttaaagtactttaatatgaaatactttaatatgcctttgcaacttttacaatcagttataccaactagtggatctatgaattagaatatcaaagaattataataattattggcttcattaattaatggatcagagaattactaaatataaccagaaggcttctgttggggaggttaataagcaagtcagtcctgtcattccaagacatcaaaaccctctagcctcagtacatagcctctgcaaccactgtcaaaagccaactacagatttttagctgtgagaagcctgtgctacactg

SEQ ID NO: 71346 - DNA, 601 bp, Human
gacggtggccagggcaaggcgctgtgggagcatggaggaggccccactttcttttacattaaagagagaaggaagattggccctcagctttagggactggaaagttccagcaagttaaaaatttggcataatacacagttttgttgttggtaatattttaagagcctaaatggaggcagatttaattctatgatgaacaaaatctgctagcttttttgtttgattggagatggagtatcactctgttgcccaggctggagtgcagtgacaggatctcagctcactgcaacctctgcctccygggttcaagcaattctcctgcctcagcatccttagtagctgggatgacaggcgcatgtcaccacgcctggctaatttttctgtttttagtagagacgaggtttcaccatgttggccaggctggtctcaaactcctgtcctcaggttatccacctgcctcagcctcccaaagtgctgagattacaggagtgagccaccatgcctggcctctgctagcatttttaaatgaactttttattttaggatagttttagatttctagaaaagttgtaagcacagaaggttcccatagacccagtac

SEQ ID NO: 71347 - DNA, 601 bp, Human
ggggctattcaagcatggtacatttattgtgtaccttctttcttattatttattgtgtaccttctttcttactattacattttaatatataatgaaataattatacagctcaccataacgtagaatcagtggcagtcctgagcttgttttcctgcaaccagatagtcccatctagggttgatgggagacagcgacagatcatcaggcattagattctcataaggaatgctcaacctagatccctcgcatgcacagttcacaagagtttgcactcctatgagaatctaatctgatctgacargaggcagagctcaggtggtaacatgagtgatgggtagcaaccgtaaatagagatgaagagttgctcactcgctcactgctcacctcctcctgctgtgtggcctcatcttcctaacaggcagttgaggacccctgctgtaaaatgttacctttgcaaaggggaactttctgatattattttctgcttgtcttacagcaagaccactgatgcagaccctgcctttaagaaccacggtcaacaatggcactgtgttaccaaagaaacctactggctctctaccatccccctccggggtcagga

SEQ ID NO: 71348 - DNA, 601 bp, Human
aggaatgctcaacctagatccctcgcatgcacagttcacaagagtttgcactcctatgagaatctaatctgatctgacaggaggcagagctcaggtggtaacatgagtgatgggtagcaaccgtaaatagagatgaagagttgctcactcgctcactgctcacctcctcctgctgtgtggcctcatcttcctaacaggcagttgaggacccctgctgtaaaatgttacctttgcaaaggggaactttctgatattattttctgcttgtcttacagcaagaccactgatgcagaccctgccyttaagaaccacggtcaacaatggcactgtgttaccaaagaaacctactggctctctaccatccccctccggggtcaggaaagaaactgctgtgccagcaaccaaaaggtgagccagaagcagggccttaaatgaactctcaaagcagttctctcttagattccaacatgagtattactttttaaaatgacattgtacaatttcttctgtgagttaaagcttataaaagtccaacattttatatggtgccataacaagaactagttaagtttattattattcttgttttagatttacttgt

SEQ ID NO: 71349 - DNA, 601 bp, Human
gtgatcccagctacttgggaggctgaggcaggagaatcgcttgaacctggaaggccaaggttgcagtgagtcaagattgcaccattgcaccccagcctgggtgacaagagcaaaactccatctcaaaaaaaaaaaaaaaaaaaaaaaaaagagttcagtagtgttaagtatattcacgcatctattgttgtgcaacagatctctagaactttttcatcaggcaaaatagaaactctagacccattaaatagtaactcccctctactctccccactgcccttggcaaccacctctctacttyttgttgctatgattctgactacattaggtatttcctaggagtgggatcatctaagtagtgcttgtccttttgtgactggcttactttgtttagcatgatgtcctcgacatgcatccatattgtagcatgtgactgattttaaggctggataatattgcattgtgtgtatatatcatattttgctttttatcttaattttaggttcagggggtatgtgtgcaggtttgttacaagggtatatttgtgatactgaggtttgggcttctgttgatcctgttacccagatagtgaagatagtac

SEQ ID NO: 71350 - DNA, 601 bp, Human
agggtatatttgtgatactgaggtttgggcttctgttgatcctgttacccagatagtgaagatagtaccaaataggaagtttttcaacccttacccacctctctcccaccctccttttggagtccccagtgtctcttatccccatctttatcatattttgtctatacattcatccatcagtggctattctgtaccatttatctgcacatctgtccttatggccaataccctaccatcttgattactattgctttttagtatgttttaaaatcaggaaatgggaggcccccaactgtattcytctttttcatgattgttttggctatttagggtcccttgatattccatatgaattttaggatagtttttttctatttctgcaaaaaaatgcctttgggattttgatagagattgcattaaatctgcatatcactttgagtagcatggagattttagcaatattaagtcttccaatccataaacataggatgtctttctcttttttgtattttcttttagcaaagttttgtagttctcagtgtatgagtcttctaactccttggttaaagttattcctaagtattttatcctttttgatgct

SEQ ID NO: 71351 - DNA, 601 bp, Human
ggttttctaaatataagattctgtcatctgtagaccgatagttttactttggatcctttcctatttggatgcctttcatttctttctcttgtctgattgctctgggtaggactttgagtactatgttgaataatagtggcaagagtgggtatcttgccttcttcctaattttagaggaaaagctttcagtcttttaccattgagtattatttgagctgtggccactcaaatatggcgtttattacattgaggtagtttccttctattcctagtttgttgtgtttttttatcatgaaaaggmgttgaattttgtcaaatgctttttctgcatcagttgaaatgatcatgtggtttttgtcctttattctgtgaatattgtatcacattgattgatttttatgtgttgaatcattcttgcattccaaatataaatcctaatttgtcatggtatataatccatttaatgtgctgttgttttcagtttactagtattttgttgaggattttttcatcagcattcatcagggatattggtctatagttttcttttcttgtgtctttgtctggttttggtattagaataatgctggcctcatgcaat

SEQ ID NO: 71352 - DNA, 601 bp, Human
gtggcaagagtgggtatcttgccttcttcctaattttagaggaaaagctttcagtcttttaccattgagtattatttgagctgtggccactcaaatatggcgtttattacattgaggtagtttccttctattcctagtttgttgtgtttttttatcatgaaaaggagttgaattttgtcaaatgctttttctgcatcagttgaaatgatcatgtggtttttgtcctttattctgtgaatattgtatcacattgattgatttttatgtgttgaatcattcttgcattccaaatataaatccyaatttgtcatggtatataatccatttaatgtgctgttgttttcagtttactagtattttgttgaggattttttcatcagcattcatcagggatattggtctatagttttcttttcttgtgtctttgtctggttttggtattagaataatgctggcctcatgcaatgatttggaagtgttccctcctcctcaattctttggaagagtttaaggagcattggaatttatccttttttaaatgtttgatagaattctccgctgcagccattgggtcctggacttttctttgttgggaggtttt

SEQ ID NO: 71353 - DNA, 601 bp, Human
atggatgactctgaggcaattcaagacttcactggagaaagtcactgcaaatgtggtagaaatagcaagagaactagaattcgaaatgcagcctgaggataggactgagttgctacgatctcctgataaaactttaatgggcgaggaattactgccaaaatagtagtttcttgcgataggatctactccgagagaagatgctgtgaacactgttcacatttcatgacaataaagggtttagagtagcacacaaaccctgatgaagcagtggcagggtcgtgtggctggagcgtggggaacrtggcccgggctgtctggctccaaagcctgtgcgccttccattgtgctcggctgcttcccgcacagatttccaggtcagccctgacatctgctcaggaaaaacgcttgatataatgactgcttgcaaatcatccttcttttatgccccatcctgtctgtgtactatttgtgggagcaggagcagcagtcaggagtgagggtgactctcagcaaagatttctcagattgcaggtctgatgttgttaaggggatgtcggggccaaacaccaagtaaggaaacaagtcctggctatgaacagag

SEQ ID NO: 71354 - DNA, 601 bp, Human
atgtgacactctgaaaagctttttgatctccgtcgctaggcctgtcttttgaatatccatgtggaagtatgacgttctatgtatatatttgtatgcttagcaataaaataaagtcacgatattaaggagttcactgtcacttccattccacccttagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaaggtaaggacrtcttatctctcagttcctgctgttcagatatgttagtacggcttgtccccagagaggagtcagaagatcccctcatattccaacaagctgggagtactcttggagaagaagaccttctcctcaggtatttataggactaatcaaacagccatttgagggcagctgccaggcacagttcacacaaactaccgtccaggtggaaaaactgtcactcagattcccagcactctcatgtagacataagtagttcctgagaatttcttagtaccaagtacctagaactggggaagccattctgaa

SEQ ID NO: 71355 - DNA, 601 bp, Human
tttgtatgcttagcaataaaataaagtcacgatattaaggagttcactgtcacttccattccacccttagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaaggtaaggacgtcttatctctcagttcctgctgttcagatatgttagtacggcttgtccccagagaggagtcagaagatcccctcatattccaacaasctgggagtactcttggagaagaagaccttctcctcaggtatttataggactaatcaaacagccatttgagggcagctgccaggcacagttcacacaaactaccgtccaggtggaaaaactgtcactcagattcccagcactctcatgtagacataagtagttcctgagaatttcttagtaccaagtacctagaactggggaagccattctgaatttctacctgagcgccttcgatttctagtacactctcctgacctttttaagttcattttaatggactgctttaagtttgtcagcagt

SEQ ID NO: 71356 - DNA, 601 bp, Human
agctaagactcggtagaagtgaaggttaagctggtaattcagtggctgcctgaccccttcccgcctttcttcctctgtattcccacgtgcgcagccccatgctcaggctgccttgaccccagcaccaaagcagatctggagtcttgctgagaaatgccaccctcgaggatgggacacagggaaggaaaggagtagggaggtggcccccatgtaatttctgtttttaaacattactgcgttcagtggactcaagatggcatgcctcgtccccatcgctcactcgacatgtccattgttcctrcaggctgtcctgtgatttaaaaaattgcccttgttgggttcctgtaggcagcaagacatggtggaaagggcagaggctctgcagtaaaagaaagatctgggtgtgtatccagttctgccttaatgtctccaagcctcagttttttcctctacaaattagagattttatacctaatgcccttgaatcttataaatgagctaacttgtaggaaattatccagcgtagggcttggcactcagtaaatgatcgtcatccctgtgatagttcttataaagacaggcttgtgtggagcagaggaaa

SEQ ID NO: 71357 - DNA, 601 bp, Human
tcctctacaaattagagattttatacctaatgcccttgaatcttataaatgagctaacttgtaggaaattatccagcgtagggcttggcactcagtaaatgatcgtcatccctgtgatagttcttataaagacaggcttgtgtggagcagaggaaagtaatcagtgagattttctacaattcctcactttttattttcctcatttgtaagatgaaagtgttagattttgtcacaatccgcgttgcacttgtgtctaacgtagttgggggaaataaagtattataaatccttgtgaagctcmcagttcttaaataaggcatcgggcgggagctggtctgtgggctgcttgcgatcccagcctgcccgctgttccagagccccattctcttccactcaggaaggctagttagggtgcatgtgagtgagagtgctgacgtcatagggatggcttccaccctgtgctgctttgtagaagaagcaaatcattcacacaggcagtgctttaacttgcagccacaacagattattagccataaagctcacagcttctcacacgccatgtgcaaagctgtcgttagcacatatggcacttaggcgcaaa

SEQ ID NO: 71358 - DNA, 601 bp, Human
aggcagtgctttaacttgcagccacaacagattattagccataaagctcacagcttctcacacgccatgtgcaaagctgtcgttagcacatatggcacttaggcgcaaattagaaaaaggctccctttacttcagaaaaacagttccatctcagcactatttctcaataataatacttacagcagatagaaaaccattctgtataaattatacaaatcttactattgaacacaaaataatagtgtttgtggagtcctaaatattaaccttttctgagatactttattttaaagtaattacmtgttttgctttcataaaactatattctttttctttttcctttttttttttttgagatggagtctcgctctgtcaccaggctggagtgcagtggcacaatctcgggtcactgcagcctctgcctcttgggttcaagagattctcctgcctcagcctcccgagaagctgggactacaggtgcgtgccaccatgcccagctaagttttatatttttagtagagacggggtttcaccacattggccaggatggtctcgatctcttgaccttgtgatccgcccacctcggcctcccaaagtgctg

SEQ ID NO: 71359 - DNA, 601 bp, Human
caattatcaaactggttccccttttgtaagtcttaagggaatgagctatgtcagctctataagcaagacactgtttcagctttactgaaagttgttgaaatgagttgattttgttagaataaggatgtttcagtcatgtgctagaaactttgttgtcacatatgtataaatcaggggtgtccctggacttcggcctccctggacttttggcttccccagattaaaagaattgtcttgggccacacacaaaatacacgaacaataatgatagctgatgagctaaaaaaaaaaaaaaaaagaraaaagaaaattgccaaaaaaatctcatgtttaagaaagtttacaaatttgtgttgggccacattcaaagtcgtcctgggccgcatgtggcctgtgggctgtgggttggacaagtttgatataaactgcccatctttggagtcaacaaacatgaaaaaaaaaaaacccacctcaaaatagtgaagacgttggcatgttaggtgtggtgcccttttgtgttgtgccccctcaaccccgggatcagacagccccgtagtacagctgtcaggtcgagaaccactgggctggacaccttgagcgc

SEQ ID NO: 71360 - DNA, 601 bp, Human
tgagctaaaaaaaaaaaaaaaaagaaaaaagaaaattgccaaaaaaatctcatgtttaagaaagtttacaaatttgtgttgggccacattcaaagtcgtcctgggccgcatgtggcctgtgggctgtgggttggacaagtttgatataaactgcccatctttggagtcaacaaacatgaaaaaaaaaaaacccacctcaaaatagtgaagacgttggcatgttaggtgtggtgcccttttgtgttgtgccccctcaaccccgggatcagacagccccgtagtacagctgtcaggtcgagamccactgggctggacaccttgagcgcctgtcctttctaaagctctagcatttggtgactatttcatctcagggctcttcagggcgcaaagttgtttttcctttacgatagcatcactgctgccgtcggctcaacagtactccttggctggggctccgggcccttcatccaccagctcctcattcccttttgtgccctgacacgcatgcctctccaacacattgcgcacttttccccagcacaacttttttccttttttgaggccatttatttattatacaagtaacttgttttagaaaatc

SEQ ID NO: 71361 - DNA, 601 bp, Human
ctggggctccgggcccttcatccaccagctcctcattcccttttgtgccctgacacgcatgcctctccaacacattgcgcacttttccccagcacaacttttttccttttttgaggccatttatttattatacaagtaacttgttttagaaaatctaggccgggcgtggtggcccactcctgtaatcctagcacttcagcaggccgaagcgggtggatcacttgagcccaggaattcaagaccagcctggacaacatggcaagaccccatctctacaaaaaatacaaaaattagctgagcrtgttggcacatacctgtagtcccacctacttgagaggctgatgtgggaggattgctcgagcctgggaggctgagactacagtgagctgcgatcataccactgtactccggactgagcaatgggaatgagacccttcctcaaaaaaaaaaaaaaaaaaatctagatgcactaaaaagaagaaacaacaatcacctgcagtctcaccactcagcgaactcacagccaacagtcattacatttccacgtggacttttatttgcagggtgctgtatgagtgtagtgtataattttgacataaat

SEQ ID NO: 71362 - DNA, 601 bp, Human
acacgcatgcctctccaacacattgcgcacttttccccagcacaacttttttccttttttgaggccatttatttattatacaagtaacttgttttagaaaatctaggccgggcgtggtggcccactcctgtaatcctagcacttcagcaggccgaagcgggtggatcacttgagcccaggaattcaagaccagcctggacaacatggcaagaccccatctctacaaaaaatacaaaaattagctgagcgtgttggcacatacctgtagtcccacctacttgagaggctgatgtgggaggaytgctcgagcctgggaggctgagactacagtgagctgcgatcataccactgtactccggactgagcaatgggaatgagacccttcctcaaaaaaaaaaaaaaaaaaatctagatgcactaaaaagaagaaacaacaatcacctgcagtctcaccactcagcgaactcacagccaacagtcattacatttccacgtggacttttatttgcagggtgctgtatgagtgtagtgtataattttgacataaatgccattcttgtgcatattttgtgatcccttcttcatttgctaaatgagcatg

SEQ ID NO: 71363 - DNA, 601 bp, Human
aattagctgagcgtgttggcacatacctgtagtcccacctacttgagaggctgatgtgggaggattgctcgagcctgggaggctgagactacagtgagctgcgatcataccactgtactccggactgagcaatgggaatgagacccttcctcaaaaaaaaaaaaaaaaaaatctagatgcactaaaaagaagaaacaacaatcacctgcagtctcaccactcagcgaactcacagccaacagtcattacatttccacgtggacttttatttgcagggtgctgtatgagtgtagtgtataaytttgacataaatgccattcttgtgcatattttgtgatcccttcttcatttgctaaatgagcatgtctttgtgtgaataaatgcactcttgcaatgttattttagatgtggttcatcatgtttccagcccgaagtacttcagttggacgtttaagtaccaaacaagtttcactaatccactcagaccaggccaccatctagaacaatgcccagcacacagtaggtgctcaacaagcattagtcgaatgaatctttttgccctgatcactataacaaaagaaggttaaaatgatgggccttt

SEQ ID NO: 71364 - DNA, 601 bp, Human
tgttaatcccagctctgctgctttgctttgtcattgtgaacaagtgacttaatctctttggggttttcctcagtagcagtaaaagtggtacctgcctcacagggtgcctaagatcccatgcataggagcctcagtgcagagctggtctgcggtcggctcgccacagtggcagctgtgagtgtcatgtctgcatcccagactgttggagttgaggcctgcacacttgtgtccctcccactcccctgcttgcagggctttttttcttggggatgtcttggaattccccagcgcctgtttctgyctttatcccagcctgaaaagcgaggaatcagaaattctgaaaattgttctcaccttgctctttcagtttcactgctgtgctggacttatggagcacctgctgtgtacagaacgtagtccaaggcatggcagggagtgggaaggagcagcacagaaagactcattctcctaacaaatgtcagtggcacaatgcctgcagggctgctttgcttaattcccaaaggactcacaaatgggagaacaagataatccacggaatagaaaaatggtaaagggtctgcacaggcgctcactgagaagg

SEQ ID NO: 71365 - DNA, 601 bp, Human
attctgaaaattgttctcaccttgctctttcagtttcactgctgtgctggacttatggagcacctgctgtgtacagaacgtagtccaaggcatggcagggagtgggaaggagcagcacagaaagactcattctcctaacaaatgtcagtggcacaatgcctgcagggctgctttgcttaattcccaaaggactcacaaatgggagaacaagataatccacggaatagaaaaatggtaaagggtctgcacaggcgctcactgagaaggaaataccagtggcccttaactcatgaataggcartcaagcccagacctaattaaagacatgccgatctaagtaagaagataacatatttagaaaattctttttactttactataaaataaagcacagatgcagaaaaccacacaagcaaattcgtagcttaatgaattgttctaaggcaaacaccttctagcacctaggaggaggaggggttttcccctctcccaagtgacaggtggatgtatctggaactgggggtgggggcagggaaggtgactgtttttgatgaactccagctcatccttcgagacccaactcaggatcccctttttctgg

SEQ ID NO: 71366 - DNA, 601 bp, Human
ggcaaacaccttctagcacctaggaggaggaggggttttcccctctcccaagtgacaggtggatgtatctggaactgggggtgggggcagggaaggtgactgtttttgatgaactccagctcatccttcgagacccaactcaggatcccctttttctgggagcctcccctggctctctagtctgagagcagtgcttttcagatggtgtcgtaactgcctgttaactttatctgtgactctgtagctctcctcccttcaccatgctgcacacaccgcttgccctcccttaggctctggaggmccaggccgtgccattcttattctttgtatctctagtactttacacagcacttggtgaacatgagtgctcaataactatttgttgaatggatggaaggatattgtatacgatcaggcatcacttaatgacaggcacattctgagaaatgcattgttaggtgttttctcattgtgtgaacatcatggagtgtgtgtttacagaaaccttcatggtccagcctgatggtctagcctgctgctcctgggctacagacctgtacagcacatgactatagggaatactgcaggcagtggtaacaca

SEQ ID NO: 71367 - DNA, 601 bp, Human
catcacttaatgacaggcacattctgagaaatgcattgttaggtgttttctcattgtgtgaacatcatggagtgtgtgtttacagaaaccttcatggtccagcctgatggtctagcctgctgctcctgggctacagacctgtacagcacatgactatagggaatactgcaggcagtggtaacacagtgttaaatattggtgtatctaaacatagaaaagataccataaaaatacagtattataattttgtgggaccacagacatctatgtggtccatcattgacagaaacacccgtgtctrgcccatgactgcatttcatttgaaagccacagccattcaagaactatgtaaacagcaccacctatgggtagacaattttaacaccacattttacactggaagatgagacttaagcattttttactgaaaaaaatgtttcactcttcaagccatggggtcatttatgttttaataaatttcaaaatgataagtgctaatattcttcatattgttttagttttgagactgttagctgaggagtctggaaatacaaaggtttttgcagtgaaaggaggaggaagagggaagccatattaatta

SEQ ID NO: 71368 - DNA, 601 bp, Human
tgaggtgagaggatggcttgagccaggaggtggaggttgccgtgagccgagatcacaccactgcacttcagcctgcgcgacagagccagaccctgtctcaaacaaaaagaagtcatgttattccaagagccaaagttgttctggattaataaattgtagggaaatcacatgtttaactttggaatggactcctcctctatcaagccttattaatcactttcaaaagcaagtatctctgctcaaacagcacgtggctcctattagttccactctgatcctagttgcccaggacttcttacamatgtcaccacgtgtcgaagacctgcaagatctggccccagagccccctttcaggaacatggggttaggttagttaatgtagatgaaagagataagagcagatccccgctctgaggtacagtgaatatctgttgagttgcagcctggacacgtcgtccactggactctcctccttataaatgccagtctatggtgcagcaaataggagctttatcagatgagtaaaaaccaaccactcttagaccatccctgtgcccaaagtccacagtgaacacattcagggatttggacttagacatac

SEQ ID NO: 71369 - DNA, 601 bp, Human
gttattccaagagccaaagttgttctggattaataaattgtagggaaatcacatgtttaactttggaatggactcctcctctatcaagccttattaatcactttcaaaagcaagtatctctgctcaaacagcacgtggctcctattagttccactctgatcctagttgcccaggacttcttacacatgtcaccacgtgtcgaagacctgcaagatctggccccagagccccctttcaggaacatggggttaggttagttaatgtagatgaaagagataagagcagatccccgctctgaggyacagtgaatatctgttgagttgcagcctggacacgtcgtccactggactctcctccttataaatgccagtctatggtgcagcaaataggagctttatcagatgagtaaaaaccaaccactcttagaccatccctgtgcccaaagtccacagtgaacacattcagggatttggacttagacatacgtgttcacagctgcctctgcggtgttgaccgcactggtgtctgttggtgtgagcctcccagctcagactgcactgctgtctgttggttgactgcactgctgtctgttggtgtgagt

SEQ ID NO: 71370 - DNA, 601 bp, Human
tgcggtgttgaccgcactggtgtctgttggtgtgagcctcccagctcagactgcactgctgtctgttggttgactgcactgctgtctgttggtgtgagtttttccttggggcagatgtctagtgttctcctgccatctccccatacagctgctggtctggtgaagattcaaatgtacctcatcctccgttgagtctccacgactgcttatatcttatatcagctctcgaaccattcagctcaagggagcatacagccgagctctttcagcaaatctccttcttataagcaataagaactgygctggagttcgtcttggagatattggccacaacttaacaccagaatagccaagcgctgagagtttgttcaccgggggggcaaatcctttctctcctccaggcttagttctgtcatgggcttcaggggcaggtgcaggacatcttgattgactccacactgggcaagggatgaatggagcctcattctgcagctggtgctccttcacccttcctaggacaggactgggcattctcccccgcaccccgccaccgccatggagccacaccccagctgctgaggggatgttaagtcacccactt

SEQ ID NO: 71371 - DNA, 601 bp, Human
ctgttggtgtgagcctcccagctcagactgcactgctgtctgttggttgactgcactgctgtctgttggtgtgagtttttccttggggcagatgtctagtgttctcctgccatctccccatacagctgctggtctggtgaagattcaaatgtacctcatcctccgttgagtctccacgactgcttatatcttatatcagctctcgaaccattcagctcaagggagcatacagccgagctctttcagcaaatctccttcttataagcaataagaactgcgctggagttcgtcttggagataytggccacaacttaacaccagaatagccaagcgctgagagtttgttcaccgggggggcaaatcctttctctcctccaggcttagttctgtcatgggcttcaggggcaggtgcaggacatcttgattgactccacactgggcaagggatgaatggagcctcattctgcagctggtgctccttcacccttcctaggacaggactgggcattctcccccgcaccccgccaccgccatggagccacaccccagctgctgaggggatgttaagtcacccacttaattttttccaccgagctcacat

SEQ ID NO: 71372 - DNA, 601 bp, Human
cattcagctcaagggagcatacagccgagctctttcagcaaatctccttcttataagcaataagaactgcgctggagttcgtcttggagatattggccacaacttaacaccagaatagccaagcgctgagagtttgttcaccgggggggcaaatcctttctctcctccaggcttagttctgtcatgggcttcaggggcaggtgcaggacatcttgattgactccacactgggcaagggatgaatggagcctcattctgcagctggtgctccttcacccttcctaggacaggactgggcattctcccccgcaccccgccaccgccatggagccacaccccagctgctgaggggatgttaagtcacccacttaattttttccaccgagctcacatcaagaaatggggaatcagagatgaattacgtaacaccttgagaagcgatcatctcccactccaagtgaattcaccgcccaagcatgtttcaaaatagtgctgggtctgaaggacccactctcaatttgagtggctgtgcgttctggagagatgcactttctgcattcagctcccgtcaacagactttgttgagaggccacggtggctt

SEQ ID NO: 71373 - DNA, 601 bp, Human
cagctggtgctccttcacccttcctaggacaggactgggcattctcccccgcaccccgccaccgccatggagccacaccccagctgctgaggggatgttaagtcacccacttaattttttccaccgagctcacatcaagaaatggggaatcagagatgaattacgtaacaccttgagaagcgatcatctcccactccaagtgaattcaccgcccaagcatgtttcaaaatagtgctgggtctgaaggacccactctcaatttgagtggctgtgcgttctggagagatgcactttctgcatwcagctcccgtcaacagactttgttgagaggccacggtggcttcaatgttctcttctggttatcactgcacatctgtgtgtttgcctttctgtcagttgttcagaagatttgtcatcattttgtgggcttatatgccaagatttgcatgcaagagtgaaattacctcctcccaggcttgccttttagaaaaggtggtggtgcattggcaggagtaatgggttctaaacaaataagctgggtttttttcaataaaaactcaactttctaaaataataaaatgtagcagtagtatattttcta

SEQ ID NO: 71374 - DNA, 601 bp, Human
gtgagtgtgcatggtggattgggagccggacaggcggctgagagagacccacggaggcagaggcatgccaggaggaaagccgagagacgttctccacgctcagggcctggaactaagtgccaggcagcagctggccacccccgaaggaaggatgaggaaagctgagagagagccctttgaggggtgggtgtgtagtgaggtctggggacctggaggatggagagaaactccatctgcacaccaagccccacaccaggttcttggcagcagctgtgtgtgccccggggagaggcaggattgmtgagagccgaccccaccaccacccaccaggcacagatccttggggcctgctgaaggctgaagacggagaaccaagaggaattccacaggagctccaggcctcacaccagggcagccgctgtctattgtccaaggccctgggaatatagccatgaacagaaagatccctgcccctgtggaattgcctcctggtgggagaaacaaaatgaaggcagggggcaaataagtgctatagagaaaaataaagcaggaggggcgggggctgtggcgagcagggcgtgaggagggtttcagtatggag

SEQ ID NO: 71375 - DNA, 601 bp, Human; identical to SEQ ID NO: 30079

SEQ ID NO: 71376 - DNA, 601 bp, Human; identical to SEQ ID NO: 30080

SEQ ID NO: 71377 - DNA, 601 bp, Human; identical to SEQ ID NO: 30081

SEQ ID NO: 71378 - DNA, 601 bp, Human; identical to SEQ ID NO: 30082

SEQ ID NO: 71379 - DNA, 601 bp, Human; identical to SEQ ID NO: 30083

SEQ ID NO: 71380 - DNA, 601 bp, Human; identical to SEQ ID NO: 30084

SEQ ID NO: 71381 - DNA, 601 bp, Human; identical to SEQ ID NO: 30085

SEQ ID NO: 71382 - DNA, 601 bp, Human; identical to SEQ ID NO: 30086

SEQ ID NO: 71383 - DNA, 601 bp, Human; identical to SEQ ID NO: 30087

SEQ ID NO: 71384 - DNA, 601 bp, Human; identical to SEQ ID NO: 30088

SEQ ID NO: 71385 - DNA, 601 bp, Human; identical to SEQ ID NO: 30089

SEQ ID NO: 71386 - DNA, 601 bp, Human; identical to SEQ ID NO: 30090

SEQ ID NO: 71387 - DNA, 601 bp, Human; identical to SEQ ID NO: 30091

SEQ ID NO: 71388 - DNA, 601 bp, Human; identical to SEQ ID NO: 30092

SEQ ID NO: 71389 - DNA, 601 bp, Human; identical to SEQ ID NO: 30093

SEQ ID NO: 71390 - DNA, 601 bp, Human; identical to SEQ ID NO: 30094

SEQ ID NO: 71391 - DNA, 601 bp, Human; identical to SEQ ID NO: 30095

SEQ ID NO: 71392 - DNA, 601 bp, Human; identical to SEQ ID NO: 30096

SEQ ID NO: 71393 - DNA, 601 bp, Human; identical to SEQ ID NO: 30097

SEQ ID NO: 71394 - DNA, 601 bp, Human; identical to SEQ ID NO: 30098

SEQ ID NO: 71395 - DNA, 601 bp, Human; identical to SEQ ID NO: 30099

SEQ ID NO: 71396 - DNA, 601 bp, Human; identical to SEQ ID NO: 30100

SEQ ID NO: 71397 - DNA, 601 bp, Human; identical to SEQ ID NO: 30101

SEQ ID NO: 71398 - DNA, 601 bp, Human; identical to SEQ ID NO: 30102

SEQ ID NO: 71399 - DNA, 601 bp, Human; identical to SEQ ID NO: 30103

SEQ ID NO: 71400 - DNA, 601 bp, Human; identical to SEQ ID NO: 30104

SEQ ID NO: 71401 - DNA, 601 bp, Human; identical to SEQ ID NO: 30105

SEQ ID NO: 71402 - DNA, 601 bp, Human; identical to SEQ ID NO: 30106

SEQ ID NO: 71403 - DNA, 601 bp, Human; identical to SEQ ID NO: 30107

SEQ ID NO: 71404 - DNA, 601 bp, Human; identical to SEQ ID NO: 30108

SEQ ID NO: 71405 - DNA, 601 bp, Human; identical to SEQ ID NO: 30109

SEQ ID NO: 71406 - DNA, 601 bp, Human; identical to SEQ ID NO: 30110

SEQ ID NO: 71407 - DNA, 601 bp, Human; identical to SEQ ID NO: 30111

SEQ ID NO: 71408 - DNA, 601 bp, Human
ccttctaattgctgggtagttttccattttatggatatataccacatcttgtttatccatgcatcagttaatgatggattttttttttttgagacagagcctcactgcaacctctgcctcccaggttcaagcgattcttctgcctcagcctcccgagtagctgggattacaggtgcatgccaccacacctggctaatttttgtatttttagtagtgatgggatttcgccatattggccaggctggtctcaaactcctgacctcaggtgatccacccacctcggcctcccaaagtgctgggwttacaggcgtgagccaccgcaccctggccttatggatttagattgtttctggttttttattattattaataatgctatgaacattcatgtatatgcctttttgtgtttgttttcatttctcgggtaaattcttaggagtgaaattgacggattgtatggtaaacttatgtttaacattttatgaaactgccagactgcctgtcctattttacattctcgtcagccatgtgctagggttctagtatcatcacatcctcccaatacttgttattgtccttttgattatagtcattctaaaga

SEQ ID NO: 71409 - DNA, 601 bp, Human
tcatggctcattgcagccttgacctcaggtccaagcaatcctctcacctcagcctcccaagtagctgggaacacaggcacacaccaccacgtctggctaatttttgtatttttgttagagacagggtttcgccatgttgcccaggctggtcttgaactcctgggcccaagtgatctgcctgcctcggcctcccaaaactgctgggattataggtgtgagccaccatgcccagccttcattttcttaatggggttttttaaagcacaaaagctttcaattctgatgaagttcagtttatcartttttccttttgtggatcatgcctttggggtcgtatccaagatcatgaatatttccttgtatgctttcttttagaagagttgttttagcccttgcattcgagtctatgatccatttgagttaattacacaagagttacaagagtacactagacttgtttcttgtggatggtgagaaggaagagcctgtttgctctgcatagaggtatctagttgtcccaagcactttttgttgaaaacacagtctttccctgttgaattatcaatgacacttttgtcaaaaatcaatcgatcaaaaatgt

SEQ ID NO: 71410 - DNA, 601 bp, Human
gatcatgcctttggggtcgtatccaagatcatgaatatttccttgtatgctttcttttagaagagttgttttagcccttgcattcgagtctatgatccatttgagttaattacacaagagttacaagagtacactagacttgtttcttgtggatggtgagaaggaagagcctgtttgctctgcatagaggtatctagttgtcccaagcactttttgttgaaaacacagtctttccctgttgaattatcaatgacacttttgtcaaaaatcaatcgatcaaaaatgtaaaggtttatttccrgatactcagttctgccccttcacctgtgtttatccccgattactgtgaccctagaggaaattttcaaattgagtagtgtcactgctgcaaatttgttgtttttttcaaaatagtgttggctattttaggttcctactatatgtaaaattgtatataaattttaggatcagcttgtctttttttattattttgttttttgaaatttttttgtagacacagggtcttactttgtggcccaggccggtctcaaacgcctggtctccagagatcgtctcacttcggcctcccaaagtgttggga

SEQ ID NO: 71411 - DNA, 601 bp, Human
gtatccaagatcatgaatatttccttgtatgctttcttttagaagagttgttttagcccttgcattcgagtctatgatccatttgagttaattacacaagagttacaagagtacactagacttgtttcttgtggatggtgagaaggaagagcctgtttgctctgcatagaggtatctagttgtcccaagcactttttgttgaaaacacagtctttccctgttgaattatcaatgacacttttgtcaaaaatcaatcgatcaaaaatgtaaaggtttatttccagatactcagttctgccccttcacctgtgtttatccccgattactgtgaccctagaggaaattttcaaattgagtagtgtcactgctgcaaatttgttgtttttttcaaaatagtgttggctattttaggttcctactatatgtaaaattgtatataaattttaggatcagcttgtctttttttattattttgttttttgaaatttttttgtagacacagggtcttactttgtggcccaggccggtctcaaacgcctggtctccagagatcgtctcacttcggcctcccaaagtgttgggattacaggtgtgaggcacc

SEQ ID NO: 71412 - DNA, 601 bp, Human
ctttccctgttgaattatcaatgacacttttgtcaaaaatcaatcgatcaaaaatgtaaaggtttatttccagatactcagttctgccccttcacctgtgtttatccccgattactgtgaccctagaggaaattttcaaattgagtagtgtcactgctgcaaatttgttgtttttttcaaaatagtgttggctattttaggttcctactatatgtaaaattgtatataaattttaggatcagcttgtctttttttattattttgttttttgaaatttttttgtagacacagggtcttactytgtggcccaggccggtctcaaacgcctggtctccagagatcgtctcacttcggcctcccaaagtgttgggattacaggtgtgaggcaccacactaggccagctcgtcaatttctaactttgaaaagcctgttaggattgtaagagggattatgtttaatttacagatcaatatgggggaaattgccacctggacaatagtggctcttatcatgagcaaagactgtctctccatttatttaggtctttactttttctcagcaatgctttatagttgtaggtgtacaagtcttgcacttcct

SEQ ID NO: 71413 - DNA, 601 bp, Human
ttctgccccttcacctgtgtttatccccgattactgtgaccctagaggaaattttcaaattgagtagtgtcactgctgcaaatttgttgtttttttcaaaatagtgttggctattttaggttcctactatatgtaaaattgtatataaattttaggatcagcttgtctttttttattattttgttttttgaaatttttttgtagacacagggtcttactttgtggcccaggccggtctcaaacgcctggtctccagagatcgtctcacttcggcctcccaaagtgttgggattacaggtgwgaggcaccacactaggccagctcgtcaatttctaactttgaaaagcctgttaggattgtaagagggattatgtttaatttacagatcaatatgggggaaattgccacctggacaatagtggctcttatcatgagcaaagactgtctctccatttatttaggtctttactttttctcagcaatgctttatagttgtaggtgtacaagtcttgcacttcctttgttaaatttattccaaaataagtgttttttttatgccattgtgaatggaattgttttctgaattttgttttcagttggt

SEQ ID NO: 71414 - DNA, 601 bp, Human
ttctgaattttgttttcagttggttggctgctagtatgtaaaaataggattgaattttgcacgtagatcttatatcctatgacctttctaaacttctttgattagttttagtataatagtccctcccaatccacaggggctaccttccaagaccccacacaggtgcctgaaactatggataacaacaaatgctaagtgtactatgtttcttcctatatatacttgcctatggcaaagttaaatgtataaatcaggtacagtaagagattaatgacaataataataaagtagaacaatatamcaatatattgtaataagagttatgtgaatatggtttctctttcagaatactgtattatacgtaatatttgcagaccacaattgaccacaggttactgaaaccacagaaagttgtttcagtcttattatattatattaatatcactacattttattaagtttcttctgtttttctgaggagaaaaagcattcagtctttcatcatgagggataaagatgccctttatcatagtgagaaagttcccttctatttctaatttgtttggaggttttagcatgaatggggttggagtttatcaga

SEQ ID NO: 71415 - DNA, 601 bp, Human
aggccgtttccatgtcggcctggcttttactttccactcacccttttacatctcctctatgcacatgtacagattcagattggccggaagggtgtctgaataggcaggatcctttcctgcctccactgtgcatgcaccagcctcccgtcagccaggaatgcgctcacccatccaataaccgtaacctcaagccagtagaaaccttggccctccccacccaactgccctagagatggtcacttccatcccagtgctactattgcccagggctccatatggagtgagcccttttaccacagcygcgtggtcctcagagcctgttcttccctgccaggaccgctgtgctggcccagctgctgcgaaggagtgagggcagcccagggaagaacatgatggattcaccctgtttttacctgaagttgagaagattttcaaataaacaacacttctcagattttcatgtcttgttcaatttacagagtctggaaatggttgtttttgtcagttttatagaatttcataattgctttatggggagaggattggccaaccttctcatttggccacagctagaagaactgccctcttattttttgtgttt

SEQ ID NO: 71416 - DNA, 601 bp, Human
atggggagaggattggccaaccttctcatttggccacagctagaagaactgccctcttattttttgtgttttttggggttttttttttctttttttgagatggagtcttgcactgttgttcaggctggagtgcagtggcatgatttcagctcactgtaacctctgcctcccagattcaagcaattctcctgcctcggcctcctgagtagctggaactacaggcttacgccaccacacctggctaatttttgtatttttagtagagacagggttttgccagattggccaggctggtctcaarctcctagcctcaagtgatctgcccgcctcggcctcccaaagtgctgcgattataggcataagccaccgcccctggcagctcttattttttttaatgactgctttttattgttagagatgaggtcttgctatgttgcaggctggagtgcagtgggtactcacaggtgtgatcacagtacactacagcctcagccccttgaataggtgggactacaggcgtgtgccactgcacccagctctgcctttttttttttttagacagagcctcactctgtcacccaggttggagtgcagtggcgtg

SEQ ID NO: 71417 - DNA, 601 bp, Human
gttttttggggttttttttttctttttttgagatggagtcttgcactgttgttcaggctggagtgcagtggcatgatttcagctcactgtaacctctgcctcccagattcaagcaattctcctgcctcggcctcctgagtagctggaactacaggcttacgccaccacacctggctaatttttgtatttttagtagagacagggttttgccagattggccaggctggtctcaagctcctagcctcaagtgatctgcccgcctcggcctcccaaagtgctgcgattataggcataagccacygcccctggcagctcttattttttttaatgactgctttttattgttagagatgaggtcttgctatgttgcaggctggagtgcagtgggtactcacaggtgtgatcacagtacactacagcctcagccccttgaataggtgggactacaggcgtgtgccactgcacccagctctgcctttttttttttttagacagagcctcactctgtcacccaggttggagtgcagtggcgtgatctcagctcactgcaacctctatccctcaagctcaagcaatcctcccacctcagcctcccgagtag

SEQ ID NO: 71418 - DNA, 601 bp, Human
ggagtcttgcactgttgttcaggctggagtgcagtggcatgatttcagctcactgtaacctctgcctcccagattcaagcaattctcctgcctcggcctcctgagtagctggaactacaggcttacgccaccacacctggctaatttttgtatttttagtagagacagggttttgccagattggccaggctggtctcaagctcctagcctcaagtgatctgcccgcctcggcctcccaaagtgctgcgattataggcataagccaccgcccctggcagctcttattttttttaatgactgytttttattgttagagatgaggtcttgctatgttgcaggctggagtgcagtgggtactcacaggtgtgatcacagtacactacagcctcagccccttgaataggtgggactacaggcgtgtgccactgcacccagctctgcctttttttttttttagacagagcctcactctgtcacccaggttggagtgcagtggcgtgatctcagctcactgcaacctctatccctcaagctcaagcaatcctcccacctcagcctcccgagtagctgggactacaggcatgcaccaccatacctggct

SEQ ID NO: 71419 - DNA, 601 bp, Human
atctagtgttctcccttagttagccaggtgaccttttcagagcagacagtgagttaccatgaggcccaactgaaagaagtgtgaatgagttctctgcagagcattgtgcagatgtcacaggggatgtgatatcatcatcagtaacagcagcagtgatggcccctggaacagcacccagatggtggactcagacccctggggagtgacccacagttccatgatgggagggaccctattttgttcagcactgtgtgcccagctagctcctagcatagggtttatgacgggttagttgcatgcrtgaatgtagctataactaactacagtgcaacagacacaaagcaaaatgtgatcagcagtatgagttttctggttacacaagatttttccagcatataggctatactgttgtggattactatctcatttttggatttaagtatttacagacctaagactaaagagagagagagagaaagcattcgatgcccaaacacagattgtcattgacatggaatttcagaaacctgctgccaagatcccggccgagatctgtagcccatctccaaggtagcagcaccctgcgctgccatgtgctaag

SEQ ID NO: 71420 - DNA, 601 bp, Human
tgccaagatcccggccgagatctgtagcccatctccaaggtagcagcaccctgcgctgccatgtgctaagaagggaaaccatgatgaaatgatgagggctttttctcattccgtcagtctcaggaaagctatgagggttctgctgatggccagaggaaaagctagtagcggttcttgagctttataggtggagctggccctcctgggccttcccaggatgtgggaaggaccaacgagcccccagccagaggccccctgcccaaagataaatgccaccttcacactcagtgaggcaggtggrcactgaccctttgccacagactggggttgtggagaggagctttaggaggaactggggctattttgcgaatcaaggttcaaggttgatgttaactgtgcaggggtgcgggtctgaggggttacctcataaactggacagtcgaaactttagcagcagttgagaactaaatgtttctggcaatttctcgcttctcgcacaacaggcaggcccaggtttcagttgttggtctatacctcaccgtgggtggaagagggaggttcagaaagtcagcactggaactctgggcacacgcctggaacg

SEQ ID NO: 71421 - DNA, 601 bp, Human
aagaagggaaaccatgatgaaatgatgagggctttttctcattccgtcagtctcaggaaagctatgagggttctgctgatggccagaggaaaagctagtagcggttcttgagctttataggtggagctggccctcctgggccttcccaggatgtgggaaggaccaacgagcccccagccagaggccccctgcccaaagataaatgccaccttcacactcagtgaggcaggtggacactgaccctttgccacagactggggttgtggagaggagctttaggaggaactggggctattttgcraatcaaggttcaaggttgatgttaactgtgcaggggtgcgggtctgaggggttacctcataaactggacagtcgaaactttagcagcagttgagaactaaatgtttctggcaatttctcgcttctcgcacaacaggcaggcccaggtttcagttgttggtctatacctcaccgtgggtggaagagggaggttcagaaagtcagcactggaactctgggcacacgcctggaacgcaaccacgaagccaagccctccaggagtgcatgtggatcacccagagcgggtgggggttctttggca

SEQ ID NO: 71422 - DNA, 601 bp, Human
tctgtgggacccaagaaacaggctgtgctaggtttcttctggcctctggttagcatattgacaaacgctggttggttttgatttcttaggcaattgtttttatatatttatggatgaatgtaggtaaaagagctaggatttgaacccaggtttttctgcctcgaaggccacattctaatcctcacactctgccgtcttgccgggcagtcgtcgcggtcaacgggagagtcattttgaggtttttcgtggtggttatgtcgggggccaggggctgggaggcacctcctctgaggaagggaaygtttctcctggttctgcctttgtctctgagccactgcctgcatttccacatcacgcactggtgggtgcgtgctaaggacgtggaaacctgggtggggtggggtggtcagagttgtttacaaggaagattagggcctcctgggccatcttttcgtgcctgtgcagaggcctggggttgtggatggtacgatcagccggttcccctctgcagggaggacttccccaggcagaggtgagcttcaactcctgcatgaagaccgtggattagaataggaaaaaggaattacaatctgattaagcc

SEQ ID NO: 71423 - DNA, 601 bp, Human
ttttcgtggtggttatgtcgggggccaggggctgggaggcacctcctctgaggaagggaacgtttctcctggttctgcctttgtctctgagccactgcctgcatttccacatcacgcactggtgggtgcgtgctaaggacgtggaaacctgggtggggtggggtggtcagagttgtttacaaggaagattagggcctcctgggccatcttttcgtgcctgtgcagaggcctggggttgtggatggtacgatcagccggttcccctctgcagggaggacttccccaggcagaggtgagcttmaactcctgcatgaagaccgtggattagaataggaaaaaggaattacaatctgattaagcctgtcagagatagaagtggattgctgagagagattgtgaagtcctgtttcattcatctttaaaaacagatatgggggccgggcgcggtggctcacatctgtaatcccagcactttgggaggccgaggcaagtggattacctgaggtcaggagtttgagaccagcctagcctacatggtgaaacccatctctactaaaaatacgaaataattagccagacgcggtggcaggcgcctgtaatc

SEQ ID NO: 71424 - DNA, 601 bp, Human
gcatgaagaccgtggattagaataggaaaaaggaattacaatctgattaagcctgtcagagatagaagtggattgctgagagagattgtgaagtcctgtttcattcatctttaaaaacagatatgggggccgggcgcggtggctcacatctgtaatcccagcactttgggaggccgaggcaagtggattacctgaggtcaggagtttgagaccagcctagcctacatggtgaaacccatctctactaaaaatacgaaataattagccagacgcggtggcaggcgcctgtaatcccagctayctggaaggctgaggcaggagaatcgcttgaactcaggaggcagaggggcagatgttgcagtgagctgagattgcaccattgcactccagcctgggcaacagagcaagactccatcttaaaaaaaaaaaaaaaaagatatggcgatggtgattatgcaggtgtagttgtcaaaactcctcgaaccatgcacttgaaatgtgtgcattttactgcccgaaaattgtgggatgatgttgtaacatgacttttttccttaaatagccaattgcgttaaacctgtttgttaaataacaaatagtt

SEQ ID NO: 71425 - DNA, 601 bp, Human
cgcggtggctcacatctgtaatcccagcactttgggaggccgaggcaagtggattacctgaggtcaggagtttgagaccagcctagcctacatggtgaaacccatctctactaaaaatacgaaataattagccagacgcggtggcaggcgcctgtaatcccagctatctggaaggctgaggcaggagaatcgcttgaactcaggaggcagaggggcagatgttgcagtgagctgagattgcaccattgcactccagcctgggcaacagagcaagactccatcttaaaaaaaaaaaaaaaaagatatggcgatggtgattatgcaggtgtagttgtcaaaactcctcgaaccatgcacttgaaatgtgtgcattttactgcccgaaaattgtgggatgatgttgtaacatgacttttttccttaaatagccaattgcgttaaacctgtttgttaaataacaaatagttccattatggccgggcacagtggctcacacctgtaatcccagcactttgggaggccaaggatgttttgcttgagcacaggagttcgagaccagcttgggcaacatagtgagacccccgtctcaacaaaaaaataa

SEQ ID NO: 71426 - DNA, 601 bp, Human
ttttttccttaaatagccaattgcgttaaacctgtttgttaaataacaaatagttccattatggccgggcacagtggctcacacctgtaatcccagcactttgggaggccaaggatgttttgcttgagcacaggagttcgagaccagcttgggcaacatagtgagacccccgtctcaacaaaaaaataaaaaaattagctgggcatagtagcgcacatctgtagtcccagctactcgggagaccatggcaggagtcgaggaggtcaaggctgtagtaagctgggattgtactactgcactycagcctgggtgacacagcgagaccccatcccaagaaacaaaacaaaactaatggttccattatgaaagacacctcattatgttttgagttcacaaatgatcaggtagttcttttttttgagatggcgtgtcgctctgtcgcccaggctagagtgcagtggcgcaatctcggctcactgcaacctctgcctcccgagttcaagtgattctccagccttaccctcccgagtagctggggctacaggtgtgtgccactgcctccagctaatttttgtatttttagtagagacagggtttcacc

SEQ ID NO: 71427 - DNA, 601 bp, Human
tttcaggaaacctgtgtgaccttggatgagttagtttattgtacacgcctcactgtcctctcttgaaaaatggggataattatatctacttcacgaggttgttacgaagatacgaaaattaaataagttaacacaggaagagtttagaattggacctagcacatagtaggctctcaaacatattggccaggccgggcacggtggctcacgcctgtaatcccagcacttcggggaggccaaggcgggtggatcacctgaggtcaggagatcgagaccatcctggccaacatggtaaaacccygtctctactaaaaatacaaaaattagccaggcgcagtggcatgtgcctgtaatcccagctacttgggaggctgaggcaggagaatcacttgaactcaggaggtggaggttgcagtgagccgagatcgtgccattacactccagcctgatcaacaagagtgaaactccgtctcaaaaaaaaacatattgtccatttaataattgtaattggtatcattaagtggccattgttagtagcattttgtgtttattgcggtcatcgtcactgttgctgtccaggcatggccagttgcaggcattg

SEQ ID NO: 71428 - DNA, 601 bp, Human
aggagaatcacttgaactcaggaggtggaggttgcagtgagccgagatcgtgccattacactccagcctgatcaacaagagtgaaactccgtctcaaaaaaaaacatattgtccatttaataattgtaattggtatcattaagtggccattgttagtagcattttgtgtttattgcggtcatcgtcactgttgctgtccaggcatggccagttgcaggcattgagtgcagagacggttggtttctggcgtggtcacctggccttctcaagcctcatcagcagccgatgacagcctgtctcyggcttcagcagtccttttgtttttctcagcaaaaaatatgtatttgccccattccttcagaattcttgatttggacaggctgccttggtcttacatcgcccctattttgtcctggcctaggccaacacttcctaaaataccattccctgaggcgccaggccaccctgggtcctgcaggattcctgcctggcagaaggaaaatcacaggaaagaaggaggggagaaacaacccttacctgatgctttacgcgcctgtgagcgcaaggccctgtacaaatattgtccaagtggagcctcccg

SEQ ID NO: 71429 - DNA, 601 bp, Human; identical to SEQ ID NO: 30112

SEQ ID NO: 71430 - DNA, 601 bp, Human; identical to SEQ ID NO: 30113

SEQ ID NO: 71431 - DNA, 601 bp, Human; identical to SEQ ID NO: 30114

SEQ ID NO: 71432 - DNA, 601 bp, Human; identical to SEQ ID NO: 30115

SEQ ID NO: 71433 - DNA, 601 bp, Human; identical to SEQ ID NO: 30116

SEQ ID NO: 71434 - DNA, 601 bp, Human; identical to SEQ ID NO: 30117

SEQ ID NO: 71435 - DNA, 601 bp, Human; identical to SEQ ID NO: 30118

SEQ ID NO: 71436 - DNA, 601 bp, Human; identical to SEQ ID NO: 30119

SEQ ID NO: 71437 - DNA, 601 bp, Human; identical to SEQ ID NO: 30120

SEQ ID NO: 71438 - DNA, 601 bp, Human; identical to SEQ ID NO: 30121

SEQ ID NO: 71439 - DNA, 601 bp, Human; identical to SEQ ID NO: 30122

SEQ ID NO: 71440 - DNA, 601 bp, Human
gcagctagcatctgtggtgggcgaggatgactagccagcttaccacaggcacccagatgtggccttgaccacatttttccaaagagtggtcctagtggggttcttagaaagagagatgctaggtaaagatgtattcactgttaagacagctctgtccagggatgacagacatcacactgagtgagatgtaatcagagcccaggcaaggaggcgatagaagcatttggaccacctagattggttcactcactaatccactcaccttgaacagcaattattcttgttgtttttctaacttctrtgtaagctcttcactgatctcaaatagatgaagagaaaacaagcaaaatccagaaacaaatggtattagaaccttgacataagtgatggttctggattaaactgttaaggggcttgcaatgaaggagtaatgatttatgcagttgaccgctttgactgtgcaagaaataaattgaccacaaattttcaggcaaaactataaaaattttatgtgaaaggacattttgattgtataaatagtctttgatatttgaaaataaaactgacaagcatgtcatgcagaagaaatgtcagcttccaa

SEQ ID NO: 71441 - DNA, 601 bp, Human
tgaagagaaaacaagcaaaatccagaaacaaatggtattagaaccttgacataagtgatggttctggattaaactgttaaggggcttgcaatgaaggagtaatgatttatgcagttgaccgctttgactgtgcaagaaataaattgaccacaaattttcaggcaaaactataaaaattttatgtgaaaggacattttgattgtataaatagtctttgatatttgaaaataaaactgacaagcatgtcatgcagaagaaatgtcagcttccaagtgttgaggagacatatttcaaaagtcarttttcagatatgttaatgttcgcaacaccctgattcatatgacattgacttttcattcattttttgctaaaatgccccattcagaaattcctgaatttcctatggcccttcttccacctgatttctctttgcaaggtctccttttctctcttgctgcctctttgtaacctcctacagccactctgaatctcattttctaacatcctttccaagaaaatcctagatttcatctaactgttaagcctgcctgatattacagacttacatagaaggctagagttggagaagacaggaagatta

SEQ ID NO: 71442 - DNA, 601 bp, Human
atgcagttgaccgctttgactgtgcaagaaataaattgaccacaaattttcaggcaaaactataaaaattttatgtgaaaggacattttgattgtataaatagtctttgatatttgaaaataaaactgacaagcatgtcatgcagaagaaatgtcagcttccaagtgttgaggagacatatttcaaaagtcagttttcagatatgttaatgttcgcaacaccctgattcatatgacattgacttttcattcattttttgctaaaatgccccattcagaaattcctgaatttcctatggccyttcttccacctgatttctctttgcaaggtctccttttctctcttgctgcctctttgtaacctcctacagccactctgaatctcattttctaacatcctttccaagaaaatcctagatttcatctaactgttaagcctgcctgatattacagacttacatagaaggctagagttggagaagacaggaagattatataggtaaagaagccaaaaaaatagatttttttttttttttttttgagacagagtcttgctctgttgcccgggttggagtgcagtggcacaatctcggctcactgca

SEQ ID NO: 71443 - DNA, 601 bp, Human
ctgcctctttgtaacctcctacagccactctgaatctcattttctaacatcctttccaagaaaatcctagatttcatctaactgttaagcctgcctgatattacagacttacatagaaggctagagttggagaagacaggaagattatataggtaaagaagccaaaaaaatagatttttttttttttttttttgagacagagtcttgctctgttgcccgggttggagtgcagtggcacaatctcggctcactgcaacctccgcctcccaggtgcaagtgattctcctgcctcagcctcccragtagctgggactacggacacgcgccaccacaatcagctaatttttgtgtttttagtagagacggggtttcactatgttgaccaggatggtctctatctcctgactttgtaatccgcctgccttggcctcccaaagtgctgggattacaggcatgagccaccacgtctggccaaaaatagattttttggaaaagaaattaaaagccttagcaaatatggaactgcttttcatggtaaagaaatttgacaagggttaggcaggaaggaaagaaccagaagcaccacttactggaaagctct

SEQ ID NO: 71444 - DNA, 601 bp, Human
ttttgagacagagtcttgctctgttgcccgggttggagtgcagtggcacaatctcggctcactgcaacctccgcctcccaggtgcaagtgattctcctgcctcagcctcccaagtagctgggactacggacacgcgccaccacaatcagctaatttttgtgtttttagtagagacggggtttcactatgttgaccaggatggtctctatctcctgactttgtaatccgcctgccttggcctcccaaagtgctgggattacaggcatgagccaccacgtctggccaaaaatagattttttgraaaagaaattaaaagccttagcaaatatggaactgcttttcatggtaaagaaatttgacaagggttaggcaggaaggaaagaaccagaagcaccacttactggaaagctctccattgaaacgtccaagcttccagcaaggacccgctgatttattatagacacagcaatgaatacatacaaggcggctgaggcaggcactcagggagatgatgggaggtaagtttcttctgttggcaggacagctgaagaggcagctacatgccccagatgcctgctgccagggaccaagcccagctgct

SEQ ID NO: 71445 - DNA, 601 bp, Human
gctgccagggaccaagcccagctgctcaggcggcggaggaagctcactggtgcatggtgagcaaactgccgctgtgcatgtgatgatggcaaagttcccaggctggtagctcagaagacacattaaatacaaatgtgctctatggcgcaaaaataaaccacaggaagtagaagtcctaggtctcaaacggaatttctgtgcatagatatatagactttaattggatagagaaataaaaattattgtaggggacaaatctctagatacgaaatttagaaacctcaaatcctggctctgagcytccccagccatggggtatgggacaaggtcccctctctcccgactgattttaatatcctgataaatggcctatctgatgtgatcaccaaatgagataatgcatgtcaatgtgctttgataaattaaaacagttagacaaatgtaaagtgtaattattttcttgtgaattgctggatccattgacctttacagcaaaaccctaaggaatgggctctccctccacaatatgaacaaggtcaaatgatatcaacaaatagaacaaagacaggaaagaaacccgtcaacatgttataactggttt

SEQ ID NO: 71446 - DNA, 601 bp, Human
acattcttaaaggtggggagaattacaaagaaccttcttaagggtgggggagattacaaaatacattcgttagggtgaggcagaaacaaatcacaatggtggaatgtcatcagttaaggctattttcacttcttttgtgtatcttcagttgcttcaggccatctggatgtatacgtgcaggtcacaggggatatgatggcctggcctgggctcagaggcctgacaattagttaagcttactctctgtgtcttgacccaaatcattgatgctgaggaagaaaatgcacgaccaggaaggttrgctctccacctttgcatctacctagccgtttaacacttgccaagttccattgttcaagcagcttgacacccaccagaggatactgtcatccttcctagacttccatagtttatctacaaggatgccactggaaggcattgtcttcagtgaaagcaagatgcagcatcatgtcatcaccaataaagggctttgttagtacctactctgtgcagtatttgtcaggttgtggagacacaaaatagtggaagacatgagtcctgcaaacaaggagtttacagtcagacaggaaagtcaggaatt

SEQ ID NO: 71447 - DNA, 601 bp, Human
ttgcatctacctagccgtttaacacttgccaagttccattgttcaagcagcttgacacccaccagaggatactgtcatccttcctagacttccatagtttatctacaaggatgccactggaaggcattgtcttcagtgaaagcaagatgcagcatcatgtcatcaccaataaagggctttgttagtacctactctgtgcagtatttgtcaggttgtggagacacaaaatagtggaagacatgagtcctgcaaacaaggagtttacagtcagacaggaaagtcaggaattgtacctttgtcrtcacctggaattaaaaaagtagcatagcatatattccaagtttgaacaagttttctttaaaaaaaaaaaaaagttagcatttgcctgctcattttttacttttagtcttctagtattattttggtctagttttatctaaactggctgcttgccctttccattcagtcattatataatgtttgacatgtggattctgtctcactcattatcccaaaaccatcgcctccaaaagtccctggcaatctcatggtagtaaaatgcattatttttttccacctgaatgttggtaaagactctctc

SEQ ID NO: 71448 - DNA, 601 bp, Human
aaagcaagatgcagcatcatgtcatcaccaataaagggctttgttagtacctactctgtgcagtatttgtcaggttgtggagacacaaaatagtggaagacatgagtcctgcaaacaaggagtttacagtcagacaggaaagtcaggaattgtacctttgtcatcacctggaattaaaaaagtagcatagcatatattccaagtttgaacaagttttctttaaaaaaaaaaaaaagttagcatttgcctgctcattttttacttttagtcttctagtattattttggtctagttttatctmaactggctgcttgccctttccattcagtcattatataatgtttgacatgtggattctgtctcactcattatcccaaaaccatcgcctccaaaagtccctggcaatctcatggtagtaaaatgcattatttttttccacctgaatgttggtaaagactctctccttgactaaactgtagcatggcttctagcagttaaggccatgtccctaggatggccccctttaaaatgcctgcctgagaaagttcatcactgccaggagaatgtcctgtttattctagccaaaggcaggcaacaggga

SEQ ID NO: 71449 - DNA, 601 bp, Human
tggcgcctcctcttagaccacataaagttgcttgggtccccagtccctagttgcactgagcccagctttccagccatcctcaccaaggtggcagaatgtagaaccacggggaacatcagcacctcagcagaagaatacagggcagagagatcacccagccaagcctgcctgaagtgctgacccacgaaattgtgagatataataaaatagttgcctttttaagtcattacattttgggatcactggttatgcaacagtagataacgaaaacagactgactatatcagaatcaccaatggarcttgtcaaaatgcatattcctgggcctcaggtgcaattctccaggaattctgaagtctcataatgggacccagtaatctgaattttaacctagcttcctggatgtctctggtagacactagagtttgagagacattcctttagagctattcattcattcattcatctatccagtctaccgtcatctttttaccattactataaatctggccatgtgctgggctccaggcataacccagagaccatgccactgtccctgctctcagggacaccaaggaccaagctgggcacctgacagtca

SEQ ID NO: 71450 - DNA, 601 bp, Human
agtctcataatgggacccagtaatctgaattttaacctagcttcctggatgtctctggtagacactagagtttgagagacattcctttagagctattcattcattcattcatctatccagtctaccgtcatctttttaccattactataaatctggccatgtgctgggctccaggcataacccagagaccatgccactgtccctgctctcagggacaccaaggaccaagctgggcacctgacagtcaagcactagttgaaggaggagaccctgaatcttcttccctgtaggagactgaggkaccaatgccagttctctcagaattgctataatttgttcaagacctcccaaacttagtccaaagcactaacaatcggtcatggccaagaaattaggagaagattgaattcactgatattttggaaatagccatctcagcagaaccttgggatctctgaggttgaggttggctgccggagggtttctgtcaccttttattataagaaggaagccaaggtctctgtgggcaaggcagaaacaacttcagcctcaatcacagattcatttgcccttgaaaatgacattcatgtatattttcccc

SEQ ID NO: 71451 - DNA, 601 bp, Human
tacataaaatagcaaaacacaaattctatgtggcagcagcaaggcaatacgtttactgctgttatataggaggtgctattccatctgtatttctgcccttgggaggaaatcgattttcttattattatgatacccatccagatgttactccctctgcaacaagaggaagtgagcagctccctccttttccaaagaacacaaagtcatggatggccaagcacatagactttgatgagaacagccataggatcaaatccctgctccacctactaattattcgctgggtgaaatttttaacatytccaaggctatctcttccctttttttttttttttttttttttttttgagatggagtttcgctctgtcgcccaggctggagtgtagtggcacaatctcaactcactgcaacctccgcctcccaggttcaagtgattcttctgcctcagcctcccgagtagctgggactacaggcgcgttccaccacgcccagctaattttttgtatttttagtagagacagggtttcaccgtgttagccaggatggtcttgatctcctgacctcatgatctgcccccctcagcctcccaaagtgctgggat

SEQ ID NO: 71452 - DNA, 601 bp, Human
ttcttctgcctcagcctcccgagtagctgggactacaggcgcgttccaccacgcccagctaattttttgtatttttagtagagacagggtttcaccgtgttagccaggatggtcttgatctcctgacctcatgatctgcccccctcagcctcccaaagtgctgggattacaggcatgagccaccgcgcccagcctctcttcccatttttagatggggatgatcatatctatctcatggcattattgataattaaatgaagtgatgtataaagtgtgcctaccagagtgtctagcatatagkaatattctaatattgttaacatttccagtattggagtgttcagagcagagagaaaaccactgtaccagcaaatagacaaacagctgccacaagatagtgataagaaagtatcagcagagcacactagaggccatgggtctccttagtaatactgctcggtaagggctcggagctgaaagtgaacaacacacagagactgtgaattgcctgtgaggggctgatggcaaccccgacacgaggaagcacatcacagcccagatctagctggccacatgcagaggatcagccgaactcaggcaa

SEQ ID NO: 71453 - DNA, 601 bp, Human
ttgttttgtttgctagttgcttattgaacaggaagtgggagtttaaatcagagccttccttcatatgacgtacagcctgtcatccacaaatttgtttgtattaattaagaaatgcatatggttctcacccaacaatgtgagcgcagacattctcacactgtctcagagaatcccaggagaagaggcagtagggggagtggtaagagtgtaggtggttaggggtcccagggttcctctttaacatacccttctccctctcagggttaggtaaaactctatttattgtaataatattataatwaataataatgtatcataagtataataatataataataatttttccctccaaaaggcagaaatatagatggaaaatatagatggaataacacttcctattaatccttgatccaaagaatccttcaggaattttattataaataaattttgaaataatatggatctacaatagggaagtggttatccatcttcctttaattcttgtagaatgttgctttgccatgacttatttctgtttaggcacatcctgccatccagatggtctcagctctgaccccagcccacacctctctctgagcac

SEQ ID NO: 71454 - DNA, 601 bp, Human
ggttaggtaaaactctatttattgtaataatattataataaataataatgtatcataagtataataatataataataatttttccctccaaaaggcagaaatatagatggaaaatatagatggaataacacttcctattaatccttgatccaaagaatccttcaggaattttattataaataaattttgaaataatatggatctacaatagggaagtggttatccatcttcctttaattcttgtagaatgttgctttgccatgacttatttctgtttaggcacatcctgccatccagatgrtctcagctctgaccccagcccacacctctctctgagcaccaacctcagatcccaactgtcaaccagatattttaatttggatctcctgctgtccttcaaatgcggcatgcctgaaataaacttcagttccaccgctccaccccttcccccaaagagacgcaacttcctaaatctgatttctaccaaaagtgccattactttactgtgattaatatgctggagtaatatttgactccctccctgaattcatctttcataggtgagctgatgcagatgtctaccatatttctcctctgcttt

SEQ ID NO: 71455 - DNA, 601 bp, Human
gcacatcctgccatccagatggtctcagctctgaccccagcccacacctctctctgagcaccaacctcagatcccaactgtcaaccagatattttaatttggatctcctgctgtccttcaaatgcggcatgcctgaaataaacttcagttccaccgctccaccccttcccccaaagagacgcaacttcctaaatctgatttctaccaaaagtgccattactttactgtgattaatatgctggagtaatatttgactccctccctgaattcatctttcataggtgagctgatgcagatgtcyaccatatttctcctctgcttttctgtgccagactgggttaaaatcatctcacacttacacaatcatttcatcttcctaagtagttccgcaaccctccctaccccattacgctcccctccaaatcactgtatgtaccagactcgtcttttaaaataacactgtagtgctatcaatgttctgctcacaaaagccttcactggctccacaaccccagaaaataagatcaaacctcctcaacaggcttctaagaccttctagaatgtagttgtccctacgaattcagccacatctacaattact

SEQ ID NO: 71456 - DNA, 601 bp, Human
tgcttgggtatgctgtgtgctcatgctattgctcagatttatagactatttgaactgaaaggatcttaaaaatcactgggtccaataatataatgctgaatgtgaagacttattaaaaactagaaataacatatctggcccagaaaaaacaataaaagaaagatgagtatcatttaccagctgtgtgacttttagaatgtcacttgacctctctgttcctcagtttcctcatttttgaagtgtgaatgatgtaacacttattgaggagctaaatgagatgatgtaggtaaagcacatggcyaatgccttaaacatggtaagtgcttagtacctgttaagaaaaagatccctgtccatgcttcgaaaacatgtaaatcaaaatttcttgaaggctggttataaataattaatttattgttaataataaactgtgagatcatttaatggggtgtttctatggtctgaatatttgtgtcaccccaaaattcataaattgaaacctaatccccaaagcgatgatattagaaggtggggcctttgggaggtgagtaggttatgagggctccacctagtgaatgagaaattaatgtccttaaaaaag

SEQ ID NO: 71457 - DNA, 601 bp, Human
tttgaactgaaaggatcttaaaaatcactgggtccaataatataatgctgaatgtgaagacttattaaaaactagaaataacatatctggcccagaaaaaacaataaaagaaagatgagtatcatttaccagctgtgtgacttttagaatgtcacttgacctctctgttcctcagtttcctcatttttgaagtgtgaatgatgtaacacttattgaggagctaaatgagatgatgtaggtaaagcacatggccaatgccttaaacatggtaagtgcttagtacctgttaagaaaaagatcyctgtccatgcttcgaaaacatgtaaatcaaaatttcttgaaggctggttataaataattaatttattgttaataataaactgtgagatcatttaatggggtgtttctatggtctgaatatttgtgtcaccccaaaattcataaattgaaacctaatccccaaagcgatgatattagaaggtggggcctttgggaggtgagtaggttatgagggctccacctagtgaatgagaaattaatgtccttaaaaaagaggcccgagagagctgccttccccttctgctatgtgaggacacacagt

SEQ ID NO: 71458 - DNA, 601 bp, Human
aaactagaaataacatatctggcccagaaaaaacaataaaagaaagatgagtatcatttaccagctgtgtgacttttagaatgtcacttgacctctctgttcctcagtttcctcatttttgaagtgtgaatgatgtaacacttattgaggagctaaatgagatgatgtaggtaaagcacatggccaatgccttaaacatggtaagtgcttagtacctgttaagaaaaagatccctgtccatgcttcgaaaacatgtaaatcaaaatttcttgaaggctggttataaataattaatttattrttaataataaactgtgagatcatttaatggggtgtttctatggtctgaatatttgtgtcaccccaaaattcataaattgaaacctaatccccaaagcgatgatattagaaggtggggcctttgggaggtgagtaggttatgagggctccacctagtgaatgagaaattaatgtccttaaaaaagaggcccgagagagctgccttccccttctgctatgtgaggacacacagtgggtgccatctatgaagaatgggccttcactggacaccatatctgccgaccccttgatcatgggcttt

SEQ ID NO: 71459 - DNA, 601 bp, Human
aatacgttagtggtggcaggtgtcagagttaccgatagtgaatccgttcgggtctgcagcaaccccaattattgcttccgcagaagaaagaattcgactggggggcataaggcagaaaaagagactgaggcaagtttcagagcaggagtggaagtttattaaaaagctttagagcaggaaagaaaggaaagtacacttggaagagacccaagtgggcaacttggaggacaagtgcagcgtttgaccttttgacttggggtatatgttggcatacttctggggtcctgcgtcacttttcccrtgattcttcccttagggtgagccacccgcatgcacagtgccctccttgtgcttgggaggggagcatgtgcagtgtgtctactggagttgtatgcatgctcacctgaggcattcttcccttttccggtggaatgctccggaaagtcatactctgccattttgtctcttaatgtgcatgctcatgcccactcgcccaattcctgagattttaatggaagctgctgattaccaatttcaagtgtttttatctattgggaaattgcctctccctggcgccagttgtgactaatcattttatagg

SEQ ID NO: 71460 - DNA, 601 bp, Human
ctgctcacatggtgagagagagacagagagaacaagcaatctttctggtgtcacaaagacactaatcctgggccgggcaccatagctcatgcctgtaatccaagcactttgggaggccaaggcgggtgcacttgaagccaggaattcgaccagcttggccaacatggtgaaaccccatcattttacaaaaatacaaaaattaggtgtggtgaggcatgcctgtaattccagctacttgggagattgagacatgagaatcacttgagtctgggaggcagaggttgcagtgagctgagatcaygccactgtactccagcctgggtgatagagtgagactgtctcaaaaacaagacaaacaaaaagacactaatcccatcatgagagccccactctcatgacctcaaaggccctgtcttaaatacggtcatactggggattaggacttcaacatacaaatgggttgggagggggaattccgtccatagctttggtctaggaagaaaatgcctaaataaattcaggtgcccagattattgccatgctgtcgtgatgtacaaattgccttaccctccaagagtctgtcactcatgggtacaaacat

SEQ ID NO: 71461 - DNA, 601 bp, Human
ttcttcattgcctgagacctagaaagggtcatgactcggatgttataatgattatcttagagactgatggcatgcctttccctccattttagctctttacttctgtatttggagtggggctgaagacttctgagaagtggttcaggatgggtttcagaactctgagtaaagtaaggtcggacaaaagcctgaaatttacacgaatgcagaaagcaggtaaattgtctctcctaaaagtcattgttgctatgggctggtcgggtcgtggtggagctctaagtcagttacactgcaactccartctgggagagctgggacacttctttgatgtccattgatgcttggatctaaatcctagctccagcagtttccagctgtgtgatcttgagcaagttggttaaaacctttgaaccttagttacctaatctatgaaagagagataacattgatacttagctgagaagtcaatcagttaatgcaggcaatgcctcagcactgtgtctgacacagagcaaaggcgccctccactgtggctgtttgtggtccttcacccaaatgtcaagccaggttgtgctgctgatctggtccttactgactcttc

SEQ ID NO: 71462 - DNA, 601 bp, Human
aaggtcggacaaaagcctgaaatttacacgaatgcagaaagcaggtaaattgtctctcctaaaagtcattgttgctatgggctggtcgggtcgtggtggagctctaagtcagttacactgcaactccaatctgggagagctgggacacttctttgatgtccattgatgcttggatctaaatcctagctccagcagtttccagctgtgtgatcttgagcaagttggttaaaacctttgaaccttagttacctaatctatgaaagagagataacattgatacttagctgagaagtcaatcagwtaatgcaggcaatgcctcagcactgtgtctgacacagagcaaaggcgccctccactgtggctgtttgtggtccttcacccaaatgtcaagccaggttgtgctgctgatctggtccttactgactcttccggacattgggtcctggctgtctccctgggtaagagttgtgggtgaagagtcaaagacagaagggttggctgctaagaatacttgaacagagttgttgcctggcacaaatgtgaagatgccctagaaactgtaaaacaccaggaaaatagaagggaactggtggaaatctag

SEQ ID NO: 71463 - DNA, 601 bp, Human
atgcctcagcactgtgtctgacacagagcaaaggcgccctccactgtggctgtttgtggtccttcacccaaatgtcaagccaggttgtgctgctgatctggtccttactgactcttccggacattgggtcctggctgtctccctgggtaagagttgtgggtgaagagtcaaagacagaagggttggctgctaagaatacttgaacagagttgttgcctggcacaaatgtgaagatgccctagaaactgtaaaacaccaggaaaatagaagggaactggtggaaatctaggcacagggttgrtatacccaaccaggactctttagcctaagacaagaccgtggtgggacatgagtgctgtcatcacccacctgaaagcctggcagggcctctcagaggttgaaggtagcctggtcacttccatttatgaggctcccagtaagttttttaaaaatgaaggaatggcaatacagtgtgaaaaaaactgtgtgtttaaaaaaatgtttacttttaacaagcaataaaaatacaatacagttgtgattcaaaaaggagtcacagccatagtccctactcattttttgtaaagttgctaatctttga

SEQ ID NO: 71464 - DNA, 601 bp, Human
agcaaaggcgccctccactgtggctgtttgtggtccttcacccaaatgtcaagccaggttgtgctgctgatctggtccttactgactcttccggacattgggtcctggctgtctccctgggtaagagttgtgggtgaagagtcaaagacagaagggttggctgctaagaatacttgaacagagttgttgcctggcacaaatgtgaagatgccctagaaactgtaaaacaccaggaaaatagaagggaactggtggaaatctaggcacagggttggtatacccaaccaggactctttagccwaagacaagaccgtggtgggacatgagtgctgtcatcacccacctgaaagcctggcagggcctctcagaggttgaaggtagcctggtcacttccatttatgaggctcccagtaagttttttaaaaatgaaggaatggcaatacagtgtgaaaaaaactgtgtgtttaaaaaaatgtttacttttaacaagcaataaaaatacaatacagttgtgattcaaaaaggagtcacagccatagtccctactcattttttgtaaagttgctaatctttgaaagattgctaataatacaatgccaca

SEQ ID NO: 71465 - DNA, 601 bp, Human
ctgtgaagggtaagctaattgaacatattgaaaggacagttcatggtcagatggataacctgatccagttttactcatatttgcacttgattgcagttccctgaggcttgagcgtgcacatgccacgtttgccttgaaaagtcagtttatgaactatagcagcacatatttaaccttatactgtgtgataagtttcctgtaataagttagtcgccttgccataccaaaaaggaaagccaattaaattactttcatggatgtcaacaaatcatcatagtcttacatgttcattcctgatagstgcacatcttcttaaagaaatagttgtgaatcctgacttttggatcgtgtatatcactgcataagcacaggtgtttgtggttacccagtgagttgtactttgaatattagtcatgatgacagtttctgtattacagcctaatagagcattgcttcttagatcaaactcctcatgctcacaaaaatggccatgttgcaataatttttagaaatgtggctttttaataaaaataaaaaataagtatcatattgaaataaagaaagtagtgttccacaagtggcgtggtttggtattggacac

SEQ ID NO: 71466 - DNA, 601 bp, Human
ttgcacattacttgccttataattgtgtaatgaccatctaatcaattctcaattatttgtggcagcttatacaaagccatatgacctacaataagactttcctgttttgggtcctagagtacatgttatgaatatgtcctgtatcttgtttattatacttaccctattgccaacagggccaagggtggctatgcatttgtgtttgacatgcagaggcattaaagcacccaatcaaagtgaaaagtatgcactatgaagacctgggaaatgtaagctggaaagctgcaagcttgggtgaggkggcaggactgcaaagactgggataaaatcagtctaagaggtgttgatagtgcctcgatagattcgaggcacttcgtgctgagatggaatgaaggaaactaatgagggcaagctgagccctgcagaggtcatggctcagaagcccccatacattgcagagatcagacttgtgacaggcctattgcctggtggaggaaaccaaagtaagctaagctaaccctgcagccagagccacatgcaagccctgactcctgtccaactctagtgagagcctcacttcctagagagaccagagggtcct

SEQ ID NO: 71467 - DNA, 601 bp, Human
aagcatgattcctaacaataatcaatttaccaatgatgctcaaagtgtggtccctggtccgggaacaccagcattgcctgggaacctgtcagaaatgccctccctgcccctcctgcatcactctggggacagagccctgcaaactgagctttagcaaaccttccaattgcttctgatgatagcgcttttaaacatctaacctaaagagtacatggtaacaaatcacacatcccagtagcttgatgacattatttgagggttacttgctgtttttgttgccagatttagtggttgctagcaygtttctctctcctgtccccacatctgccctgtgccatcaggaactcccaccaagaatggcaactcgattgggcacatcttagaatcacttgtccactttctggataggcaactttaagtgaaacatgtgtcattaactttatcccactttctccaaggcaggtggactaacactctcatgagaaagagtctcccaagtgctacctagaaatagcaagtcatcttgccccaaagttagactcagcctccagccacaacgcttttggctggttaaacctggtcatcagtataatatgaaggg

SEQ ID NO: 71468 - DNA, 601 bp, Human
gctagcacgtttctctctcctgtccccacatctgccctgtgccatcaggaactcccaccaagaatggcaactcgattgggcacatcttagaatcacttgtccactttctggataggcaactttaagtgaaacatgtgtcattaactttatcccactttctccaaggcaggtggactaacactctcatgagaaagagtctcccaagtgctacctagaaatagcaagtcatcttgccccaaagttagactcagcctccagccacaacgcttttggctggttaaacctggtcatcagtataatrtgaagggacactgtctttgtccatttaccttgctataaaggaacacctgaggctcggtaatttataaagaaaagacgtttacttggcccatggttctgcaggatgtataagaagcacgacaccaagcatctgcttctggtgcggcctcagggggcttacactcatggcagaaggcaaggaagagctggcaggtgccgaggtcacagggtgagagagaaagcaagacagagtggggaggggccaggctctttgtaacccccagctttcacgggagctaacaaagtgagaactcactcatta

SEQ ID NO: 71469 - DNA, 601 bp, Human
caccaagaatggcaactcgattgggcacatcttagaatcacttgtccactttctggataggcaactttaagtgaaacatgtgtcattaactttatcccactttctccaaggcaggtggactaacactctcatgagaaagagtctcccaagtgctacctagaaatagcaagtcatcttgccccaaagttagactcagcctccagccacaacgcttttggctggttaaacctggtcatcagtataatatgaagggacactgtctttgtccatttaccttgctataaaggaacacctgaggctsggtaatttataaagaaaagacgtttacttggcccatggttctgcaggatgtataagaagcacgacaccaagcatctgcttctggtgcggcctcagggggcttacactcatggcagaaggcaaggaagagctggcaggtgccgaggtcacagggtgagagagaaagcaagacagagtggggaggggccaggctctttgtaacccccagctttcacgggagctaacaaagtgagaactcactcattaccatgaggatgaggacggcacaagtcattcatgagagatcttcccctatgaccca

SEQ ID NO: 71470 - DNA, 601 bp, Human
atggccaagtatgacagattaatttagaacagttattcccagtgtgtggtccccaacaccagcagcagcaaccttacccaggaacaggttagacatggaaattcttcaccccactccaaacctatggaatcaaatcagcatctctggggatttcagcccagaaatttgtttggaaaaggcttctaggtgtttctgatgcagctcaagtaggagaaccactgaagtacagaaaccagcaaggggattgaaataggaaacaattaataaagtggagaggcaactcacagattgggaaaaaatrtctgcacatcatacatcacataagggccattatccagcatatacaaggaaaccaaaagactcaataacaagaaaacaaataatcctatttaaaaatgggcaaaggacttgaatagatatttctcaaaagaagacatataaatggcaagcagatattgccatcttgcttaacatctctaatcatcagagaaatgcaaattaaaaccacaataagatgttatctcacatccgtcagattggctattatcaaaaacatgaaagacagcaggtgttagtgaggctgtggagaaaagggaaccct

SEQ ID NO: 71471 - DNA, 601 bp, Human
cattcgcatgtgttccaccctcccaactaaacacctcaccctgtttctcctgttttcccaggtagctggttgttgctttgagtgaaatgggttcgtagagggttttttatacagatgaatgacacaacacaaattaattgttctcagccgtgggttaaatgtcaggtgtctttgctttggactggaattaattcagcacagcatcttagcactgggatttcttactctaatcacaaatgttgactgacaactaaatgcttttttcattcctaaaaaaaggggaagaaaagaaaaaatataycataaatgcaacttgtctgatagacataaatctttgggaacacatagttgattgagaaaggggaacgttccagaaagaagtccttggttatgcaatgtcatgccagttaagcatcactggctgaagtggttgacatttgcccattttatttttaagatggacatgttttcaacacattctagtctgtttcctcagagtactcagaaattgttgctgttggttctgcaaggcactggcagagcactaagctcttttgctttttagctgggtgactttaaacaaataaaggacttctgattg

SEQ ID NO: 71472 - DNA, 601 bp, Human
aagtggcataaacaaaaaagggaacttgggttatatactgcaatgtcgaagcgttcaggggcagccgaatatgggtgctcaggcaggcttccctcagtattgcctttattctcaggcaggtttccccataagtcccactcttccagctacttcaacagagaagagcctgtttcctaatagttcccccaagaatcctacctgatgctcattggccaggcctgggtcatgtgcctatccctgaacccattactgtggctctgattggccagacttgggtcatgtgctgcttcttggaattggragcagctgcacctaaccctcctggactgagagtcaagaggagtggtttcccatagaaaaatccaggtgctgctcacagaagagggggctgtggatgctggcaggaaagcctcggatgctaagcatgtgggtgaaggcagattcacatagtacaatgaaggaacacttacaaattaatacattctaaatagttcaatgtaagcaagtaccttctatgtgcctagcaccgtgctatgtacaagaagggatggaggagaagagctgcttggtcttaaagagatcacagagtgggatcctgctg

SEQ ID NO: 71473 - DNA, 601 bp, Human
aatgtcgaagcgttcaggggcagccgaatatgggtgctcaggcaggcttccctcagtattgcctttattctcaggcaggtttccccataagtcccactcttccagctacttcaacagagaagagcctgtttcctaatagttcccccaagaatcctacctgatgctcattggccaggcctgggtcatgtgcctatccctgaacccattactgtggctctgattggccagacttgggtcatgtgctgcttcttggaattgggagcagctgcacctaaccctcctggactgagagtcaagaggrgtggtttcccatagaaaaatccaggtgctgctcacagaagagggggctgtggatgctggcaggaaagcctcggatgctaagcatgtgggtgaaggcagattcacatagtacaatgaaggaacacttacaaattaatacattctaaatagttcaatgtaagcaagtaccttctatgtgcctagcaccgtgctatgtacaagaagggatggaggagaagagctgcttggtcttaaagagatcacagagtgggatcctgctggggttagaggcaagcatggaaagctaaggaaaacccaacac

SEQ ID NO: 71474 - DNA, 601 bp, Human
tttaccacaacaggatgattctataaagacaactgagtaatcaagtggaaaaaaagttacttttatgtaagcagatgagtgtagtgtatgattatccatggtataattttggttttctatcccataatctatggttgtatattgcccatcaactactctgtgatcaagctggactttgtcccaaagggaggaatcataaaatgatttaagttctagcacctttacttaaattcccacctggattccctgaaagagaatgcatttctgtatagttctacattatggaatatgtctgaaaacaaaaaaaaaaaaacatttggaatcctcctgttcattcagaggaaggtgcctagttagtttctttgccatgtctttctgccctctctttccctcttccttctcactgccatgtcccaagtccaggcctacaaccctggatgcttgggttacttaagcgctcctccctcccaccagatccctgcctccagtgtccctcccactccaacgcatcctaccaggctcctttaagcctactgtcatgacattgctaacagctaacagcataacctgttctccaactccctatggtcagggcactcac

SEQ ID NO: 71475 - DNA, 601 bp, Human
ccactagatgctgtgcctcctgcctgcagctcccctgaagtttgccaccccagttaaaaggagttggaaccacaaatatgaagagcaagagagacagcaaatgccactcagcttgggtggtttgaggtactggtggttgtgtttgctttttattgacttggtatactgactaagtggcaaatactcttctgggaacttcagtccatgttgtctcacttggtcttcacacaagcctgtgaggaaggcatctctagcttcgtttggcagctgggaaaactgaggtgtagagaaactgaatggyttcagctagtaactggccattagaatcagccctgttgggccccaatggcatggtccttctaaatatatcaagaaatatttcctgagagtcctgagataaaatggtagcctttgagaatgtaacatatgtcaaatgtggtctctgtgcttaaaggatcacagcatcagagctgagagggactttgggaaatgttctcattttgtagtttgaaccaaacaaacataggggacatgggggagctaataacctatccgggatgttgtggaagaaaaggaaagaaaagccatatatggaagagaa

SEQ ID NO: 71476 - DNA, 601 bp, Human
gggatgggaaaccagacggtccaggaagtggatctaatctccaccactagatgctgtgcctcctgcctgcagctcccctgaagtttgccaccccagttaaaaggagttggaaccacaaatatgaagagcaagagagacagcaaatgccactcagcttgggtggtttgaggtactggtggttgtgtttgctttttattgacttggtatactgactaagtggcaaatactcttctgggaacttcagtccatgttgtctcacttggtcttcacacaagcctgtgaggaaggcatctctagcttygtttggcagctgggaaaactgaggtgtagagaaactgaatggcttcagctagtaactggccattagaatcagccctgttgggccccaatggcatggtccttctaaatatatcaagaaatatttcctgagagtcctgagataaaatggtagcctttgagaatgtaacatatgtcaaatgtggtctctgtgcttaaaggatcacagcatcagagctgagagggactttgggaaatgttctcattttgtagtttgaaccaaacaaacataggggacatgggggagctaataacctatccggga

SEQ ID NO: 71477 - DNA, 601 bp, Human
accaagaagattaaaggatggacaagcaaacgcatttcatctctcctccaccagctgctttgtcttttatccaatgtccttaggcaacatattctgctctaggataagcacagtgtgtgcacctctgtccagaatttggccttattattattattatttttgagacatggtctcattctttcaccaggctggagtgcagtggcatgatcttggctcgttgcagcctcaacctcctgggcgatcctcccatttcagcctcctaagtagctgggactgcagacgcatgccaccacaccagacttatttatttatttatttatttatttatttatttatttatttatttttgtagagatgggtgtctcattatgttgacccggctggtcttgaacttctggctccaaacaatcctcctgcctcagcctcccaaagtgctgggattgcaggaatgactctctacacccagccagaatttggccattggatcagactcacaagcccttgaacttcttaatggctgtgttatgacataatatgctttttacctcaacattaagaatttccactcaagatttgctcagtctacttgaagaagtagaaa

SEQ ID NO: 71478 - DNA, 601 bp, Human
tgaggctctgtctacagtggacaagagcaccacagccctgcaagcctgggggcaggattacccaagagccttgagcatctgacattacaagagacagcgctcttctgagcacaggaccctgggtccttcacatagacctcctctcatcattcctaatatgcagaacaatcacacaaagcatttcctgagatccagattcaatcgaaaccaatttaaagagttattttggaggggggcggggagacatagaaatgcttaatagagctggaaaaaagtctttaatgaaaaagattgaaccctkaaagcctacccatcggtttcaaaaaaatatatacacactggccacagggagaccagacaagacagggtgaatcctgctccagaaactctcccagctcatggaaggattattccaaatacatgcctcttggacactgccacagaattttcatatataaccaagaagattaaaggatggacaagcaaacgcatttcatctctcctccaccagctgctttgtcttttatccaatgtccttaggcaacatattctgctctaggataagcacagtgtgtgcacctctgtccagaatttggcctta

SEQ ID NO: 71479 - DNA, 601 bp, Human
cctaggggcctaggaaacccagcataaacgtggaatgaaaaaactaaggctgcctttgagcgcttaaacctcaacatctgacagagcaaacacagagaagcaaggtcaccctcaagaagcagaatggccccaagtctgtgagatttaagggggacctgatggaatgtaatcaccaatccagagacacagggtgtccaatgggaggcagtagcggtacctctctgacctccaatctgcagagacggagtcttggttaggtggacttaaaaggcctccttagtgaggctctgtctacagtggrcaagagcaccacagccctgcaagcctgggggcaggattacccaagagccttgagcatctgacattacaagagacagcgctcttctgagcacaggaccctgggtccttcacatagacctcctctcatcattcctaatatgcagaacaatcacacaaagcatttcctgagatccagattcaatcgaaaccaatttaaagagttattttggaggggggcggggagacatagaaatgcttaatagagctggaaaaaagtctttaatgaaaaagattgaacccttaaagcctacccatcggtttc

SEQ ID NO: 71480 - DNA, 601 bp, Human
tgaaatactgacagcaggaatcctcagaaggctttctgactagtaagtgactgcttttttaattttaaaacaaacgtctatgaaaagtgaagaacaaagcctgaatgttacattggccagtaaattacacaggcagacatggaggggtcgtctagagcttgaacaggtgacctggcctctctgggcctcacctttctcacctgtggaataaaggggctggagaggtgtcctttcagtcctcgcaaggcgaatctctgtgcttctccatggaagcctgtgtctctgcacattgtagaagcargcaaggcccgagtcctcatggaacccccgaccagcactggctgcataatttctggggcccaatgtaaaatgaaaatgcagggccccttggtcgaaattgttaagaatttcaggactgcaacagcagagcattaaaccaggcacaagctccgagcacaggaccctgtgcgactgtatggccacacgcccaggaagctagggacctgtgctgcgtgttccctacaatgtgtgaaggaagggaatctggagtaggtctggggcccccagccagcatgggaggcagggatgctcctggggtaat

SEQ ID NO: 71481 - DNA, 601 bp, Human
tcctggcatccatttctgcaggtaaaagcaaagatattttcaggaagtaaagagtgattttgagggatggcattcaagaactcatatattgaaaaagtttgacccagttaaattcttcttagctctgagaaaacaaagatattgggaatgtcttgtatgtaggggtaggggtgaaaggaagcattgtaattcattaaaaacatctacaaatgtttgtcaataatacatttaaataaaaattttgaagcaatatctttttttttttttgagacagggtctcactctgtcacccaggctgggrtatagtggcgttatctcggctcactaaagcctcaacctccctggctcaagtgatcctcccacctcagcctcctgagtagctggaactacaggcatgtgccatcatgcccagctaattttttgtattttttgtagagacagggtttcgccatgttgcccagactggtctcaaactcctgagctcaagggctttgtccacgtcggcctcccaaagtactgggattacaggtatgagctactgtgcctggccaacaatatctagtgggtcaaaaaaatatataatcgtgggtccccaaaatac

SEQ ID NO: 71482 - DNA, 601 bp, Human
aaaaccctggtaggacttaccctatcagaggcagttatgcatcaggcacaccaccctgagactgatgagatggcaaggaaatgatgctatacctgccttaagaagttcttagaagttttgtcacttgatttgacagctgaaattggcatggcccttcccctctctgactttaggggccagtggtccttggggcctccaggaatacaacacttctctttcctttagcacattggaatgcttgctggactctgctctcaccacccacctggcagaggtcttgaataaaggaaaacttcctcayaaaactacataaaagcagattgcaaaaaccaaaaaagttaagggagactcctgtgttcatagatgacacagactcttgggtttggaagaacactaagaggtcatgtcatttagtcccttcactgtgtctgactctgatgtgctcattgttctgatgaggtgctgacagctgcaccgtgcatgtgttcactgtctgtcctctaccagcataaaaatgcaaaactgacgtctcttaaatcgaaccagctgccaataggtttgtaaaaccaagcgactgagaagtagttctagtcatgtttct

SEQ ID NO: 71483 - DNA, 601 bp, Human
ggaaatgggaaggagagggggtaaggcacgtgggaggcaggagggaatgcggtagcggccctctggggtctggaatatgctcagaagtagggtggctgaacagagcagctggaaggacgccaccataatccatgcatcctttctcaacacccgaggcagaaaggccccctgagggtcctggagtggaggggctgtgttcccttacacacaagcatcttgctgccagggctgtttcttactctccacttattaaccgtataaagtaatttataagtttctccaaacagttcacaccctaccytttttttttttttttttttttttttgcttgtttcttttttttcctactgagatctgcaaatattttgtggtagtctttggcatgtctgaacggctgagcttggttataagcagtcagaaattgggctgacttggcacaagcaggagtagggatgattccactaataccctgtgtccttcaaaaaccctggtaggacttaccctatcagaggcagttatgcatcaggcacaccaccctgagactgatgagatggcaaggaaatgatgctatacctgccttaagaagttcttagaagttttg

SEQ ID NO: 71484 - DNA, 601 bp, Human
tagttgaggactcctccaactcttttagtcatacctgttccttccccttccacataaggcttgagccccctgctagagaaggtggggggtacctccatggccagaggtaacccccaccttcttatgccatagttcagagctgtgattatagtacaagcccagtaagccattgctgagagaagcatcatgcatgccagtgatcagacttggaaaatcaataacggtaaaagccagcatttattgagcatgtactacgtgctaggtactttgtgtgcattatctcattaaccctcacaactascctgtgagggaggtcctattatccccatgtttatattatgataaaaaacacataacaaaaaatttaccatcttaaccatttttaagtatccagttcaatagcattaatatattcacatagttgtagttatccctgtttttatagatgagaaaatttgactcagagaggttaaataatttgcccagatcctacagcaaataagtgatagagctggaattcaaaatcaggtctgattccggagcctatgctctcaacccactctggatgatacaggctaacttgtttcaacttggcccctca

SEQ ID NO: 71485 - DNA, 601 bp, Human
agcctgggcgacagagtgagactccatctcaaaaaaaaaaaaaaaaaaaagcagcagaagaagaagcaaatggaatttataagctggcatccttggatcttcaggcttgaaacttctgaatgttctttaaccctttctctctctctttgactcttcatctcacatctctagtcacatcaaaagggtgaggaacagcagccaggtatcaggaacagcagccaggtatcaggaacagcaagtgcaaaggctcagaggtgaaactgtctgagatgtttcgggtccagtgagcagctgagagtgkcaggaaagtaggtgttgagaggatgtttacaagacaaggatgagaccgctgggagcagagacagatagtcaagggacctgttaggccaaggagatggggggttacaggcttcctgctggaagcccttggagacctttcctcggggtgtgtcatgatgagggtggaagaatggaggaggatctcggcctgggacagtggtggctgggacaccagtatggaggcaactgtgccaggcccaagcctcgagctcgtgacagcgtggtaccaaaggcaatggaataacactaggagtgccctgtg

SEQ ID NO: 71486 - DNA, 601 bp, Human
agttcaagtactgcaagaacccctgggggctgctggctcagccctttgctttatccacgtatacttgggtatccttagaacatctgtgctggtgcaattgacctggtatctccaatttatatgtttctaaaatcaatttggagtagaaatctctgtaatgttttccttggcatatatagaaacaaaaatgcatccatgaatactttttactatgaatggatttttaaaaacacttttttaaacttaaaatttaaatacatttaaatgcatttaatttaaaaataaaaaaattaatgttcawcattaggtctgctgattctctagttgacttcctccttttttaggtgtttaatgtaattgactctgggtttctttttaagatgctactaatatagtatattttatttttgttactaaattttaaaacagctatatgatagaaaattgaaaactgacaataagaaaaagaaaaagggccgggtatggtggctcatgcctgtaatcccagcactttgggaagccaaggagggtggatcacttgaggtcaggagttcaagaccagcctggccaacatggtgaaacctttgctctactaaaaata

SEQ ID NO: 71487 - DNA, 601 bp, Human
taataatcttgacacccaggccttgcccccgaccatttaaaccagagtcattgactctcaggggatccaatgtgcagccaaggttaagaaccactgacagtgttctcaggataggagaactttgtacataccccagggaagttcgtctggccaagagagcacaaggagaggaatccatagtgagaatccacagaagggtatctgcagactgagaacagccccaggcacatagaaggataaacaagttcaggaaggatggagtttaaggacagcgagctcttccagggccaagagggcacgrggagggcagctgcatgcagatatttcggccagatcaccagaggtgtccaagaaattacatatttgacaaaaacacttttccaataatttttattaaatacaggagatgatttaacagatgatattatctgtaagaagtacttttttaaaaagtttagtagaaataagatcataaaacatcttgttttccttgtagctctttagtgctgtcacagaggacaatgataggcaggtttcaggattttttttttttcatttgtctttcagaaagggtggaatgcaaagtattgctaatcagaga

SEQ ID NO: 71488 - DNA, 601 bp, Human
gagccaccacacctggcccttcaatgagtcttttatgaattgaagtttagaccttacatcaattggcagtctttctacatctccttcttggatgaaaaggtaggttaaagaaatcgtcttgactttggctgcacattagaatcacttaggggacttttaataatcttgacacccaggccttgcccccgaccatttaaaccagagtcattgactctcaggggatccaatgtgcagccaaggttaagaaccactgacagtgttctcaggataggagaactttgtacataccccagggaagttygtctggccaagagagcacaaggagaggaatccatagtgagaatccacagaagggtatctgcagactgagaacagccccaggcacatagaaggataaacaagttcaggaaggatggagtttaaggacagcgagctcttccagggccaagagggcacggggagggcagctgcatgcagatatttcggccagatcaccagaggtgtccaagaaattacatatttgacaaaaacacttttccaataatttttattaaatacaggagatgatttaacagatgatattatctgtaagaagtacttt

SEQ ID NO: 71489 - DNA, 601 bp, Human
tttctccataatgagtggccaaaggcttacccaggcattctccccaggaaaggaaagacactggcaatggaattttagtcaatggtatgatgtctgctttcaacaaggggaagacagcagaaggaatcggctgtggttgccaatggccaggcattcacctttacctggactcagattaatacaagtcgggcacagtgatgcttccagcctgcctgccttctcttcccaggcagcctggtgtcagagcagggactctaacccgaggagctgactgtgtacagctcagccttcttcaatgagttttttttttgttttgttttgtttttttgagatgaagtctcgctcttgtcccccaggctggagtgcaatagcacgatctcagctcactgcaacctccgcctcccaggttcaagtgattctcctacctcagcctcccgagtagctgggattacaggcgcctgccaccacgcctggctaacttttgtatttttagtagagacggggtttcaccatgttggccaggctggtctcgaacttctgacctcaggtaatccgcccacctcggcctcccaaattgctgggattacaggcatgagccacc

SEQ ID NO: 71490 - DNA, 601 bp, Human
ccccttctaggctaagtttaaatggaaagagcaaaagagacgacttcccaacctccagagtatcttcccccatccaccatagcctggaatagctttaacagcaaatcttactattttctccataatgagtggccaaaggcttacccaggcattctccccaggaaaggaaagacactggcaatggaattttagtcaatggtatgatgtctgctttcaacaaggggaagacagcagaaggaatcggctgtggttgccaatggccaggcattcacctttacctggactcagattaatacaagtygggcacagtgatgcttccagcctgcctgccttctcttcccaggcagcctggtgtcagagcagggactctaacccgaggagctgactgtgtacagctcagccttcttcaatgagttttttttttgttttgttttgtttttttgagatgaagtctcgctcttgtcccccaggctggagtgcaatagcacgatctcagctcactgcaacctccgcctcccaggttcaagtgattctcctacctcagcctcccgagtagctgggattacaggcgcctgccaccacgcctggctaacttttgtat

SEQ ID NO: 71491 - DNA, 601 bp, Human
tggtgctgatgctaccagttgggagaccatcctttgtgcatgtctatgatagatcatgcctttttctattgtgggccttttagttgtgcccaagtaaagcaaatacctgtttgggggaaaaactaagttctcattaactcaagtgcaaagtttcagacaaataaattgggtggtcaattggaagcataatttgggtgtgcgcttttcagtctgtagcttctttgcaggactgttgacttttctctgtatgaattcagactaacctctgcttatatattttaatttattttatagtcatgtrctttcttcttgagccacagtttgcaaaactgtagaatggagatgaagtgactgcaggcagaacatgcccctctccttgcgtgacaatggaaaagggactggcccttcttggagcagagtgccatggtcgggaccattttgccattgctattataatatggtgctctaagtgactaacagaatgcagtggcggtggcactaagactcgacctcatccctgttggtgggggataggctgtctttgctgtcactcatcctgcaaagactccaacctagaaaaaggatgtaagaaaatgaggat

SEQ ID NO: 71492 - DNA, 601 bp, Human
tgaccctgggtaagtctgaatctcgagagatttaaattccaggaagcactgagagtagaaaagtcaccatttgaaagttacagcagtttcttccctttaaagtgccttactttagaatccgatagatctcaagagggctattggaccacaactggctgggcctcacccctggagattctcattgggttgtctgtggtgcgtcagaaaatctgcatttatgtttttatttttattattattattattttgagacggagtctcactcttgttgcccaggctggggtgcaatggcgtgatctcrgctcactgcaacctctgcctcccagattcaagcgattctcctgcctcagcctcccgagtagctgagaatacaggcacctgccaccatgccgggctaattttttgtatttttagtagagacagggtttcattatgttggccaggctggtcttgaactcctgacctcgtgatctgcctgccccgggctcccaaagtgctgggattacaggcatgagccaccatgcccagctcctgcatttctaacaaattcccaggtggtgctgatgctaccagttgggagaccatcctttgtgcatgtcta

SEQ ID NO: 71493 - DNA, 601 bp, Human
acatctgggagaaatactccttggccctttgtgaatttagaatgcccgtgcggtggaagggttactttttggtgcagcagtggagcagtttagagggtaagaggacagcttctcagaagaactctgcctgggcaggcctgtgggtgtcctctaccaagtgttaatttaaagctaaacaatgcagccatgctggtgctctgctgggtctgctctattgagggcaggccctctagcccttagggagtggagtgaaatttacaggatagggaattgggaaaagggagattgctcaaacgtaaawtgggaacttaggctgcagattttggggagatctctctccttctagggctaatggctgttaggcgctagagtgctgaagagcgcagacaaacctgagggattttcagtggtgggggtttgggcgatggcagggcgtggtagccctgaatctgaggctgggtctgggcctctgctctgagaaaagccatagccagagccatcgctagctattttcaaccacataatccctctctgctgtccctgaatcttcagtaagatcttgtagtagctgcagcccggcctcagctgggccttggggaag

SEQ ID NO: 71494 - DNA, 601 bp, Human
taggccttgggttaggtaatagaaatagtttagcataggtctaggaaactgttggttgaggacatctgggagaaatactccttggccctttgtgaatttagaatgcccgtgcggtggaagggttactttttggtgcagcagtggagcagtttagagggtaagaggacagcttctcagaagaactctgcctgggcaggcctgtgggtgtcctctaccaagtgttaatttaaagctaaacaatgcagccatgctggtgctctgctgggtctgctctattgagggcaggccctctagcccttagggagtggagtgaaatttacaggatagggaattgggaaaagggagattgctcaaacgtaaattgggaacttaggctgcagattttggggagatctctctccttctagggctaatggctgttaggcgctagagtgctgaagagcgcagacaaacctgagggattttcagtggtgggggtttgggcgatggcagggcgtggtagccctgaatctgaggctgggtctgggcctctgctctgagaaaagccatagccagagccatcgctagctattttcaaccacataatccctctctgctgtcc

SEQ ID NO: 71495 - DNA, 601 bp, Human
cctttgcactgcgttatagatgagaaatggaaagtgcctctgattgatcccctcctgtaaccaatcagactggtcccaggccaagtcttcctgtgtaactttgtaccttaacttcagcgtctgattgatcaccttctgcaaccaatcagactggtcgtgggccactccttcatttacataggatgtaaccaagtaaccaatgggaaacccctagaaggaaaattctgtaaccagtgctcttgagccacttggtcaagcccattcctactctgtggagtgtactttcatttcagtaaatctrtgctttcattgtttcattcttctgttactttgtgcattttgtccaattctgtgttcaaaaggccaagaacctggaagactcatagtcaagaccctccactggtaacaatatgtatcaagaccctccactggtaagaatatgtacaaaatcaaaagataaatgacatgctgaaagaaatatttgcaacatatagtaataataataaaaactacataatagtttgctgcaaaagtaatcacggtttttgccactggaagtaatggcaaaaactacgattatttttgcaccagcctttctcga

SEQ ID NO: 71496 - DNA, 601 bp, Human
aaatgactattaaatctggctgatatttgaaacttctgtagaacaaaaagtaatattgaggcaggagaatagggtctggagtcagggaacctaaggccaatttgcactgacttcctagaactgaatcaaatggaaaaccccacctctccatgcacaagtaacaaaaggatcagaggctactacctttgcactgcgttatagatgagaaatggaaagtgcctctgattgatcccctcctgtaaccaatcagactggtcccaggccaagtcttcctgtgtaactttgtaccttaacttcagcrtctgattgatcaccttctgcaaccaatcagactggtcgtgggccactccttcatttacataggatgtaaccaagtaaccaatgggaaacccctagaaggaaaattctgtaaccagtgctcttgagccacttggtcaagcccattcctactctgtggagtgtactttcatttcagtaaatctatgctttcattgtttcattcttctgttactttgtgcattttgtccaattctgtgttcaaaaggccaagaacctggaagactcatagtcaagaccctccactggtaacaatatgtatcaa

SEQ ID NO: 71497 - DNA, 601 bp, Human
tgatggtcaaagccgatgctagaagctgatatagacagaatagatagacaactaatagcataatggcttctcttggaccaatcaatggacagatttgatgtattgtaaatgtagtgaagccattagtcaggggttttccacctctccccatctccccagtgcatgcacaatgtggctatgacttggcaaaggtgaagtcaggtggagaagggctcagagaggtcagaatatgatagtaataagcactgagttcagaggttcaaggaagataaatgttgattggttggtaaggtaagtgttsataagaaggtaagataagatggactatattttaatgacttacaaatgtttaacaggaaaaaatcagctacaataagcgttttggttgtaggttgggctaaaattatgtttgcaccattttaaaaacgcaaataagccagacacactggctcatttctgtaatcccagcactttgggaggccaaggcaggaggatcacttgtgcctaggagttcaaaaccagcctgggtaacatagtgagactccatctctacaaaaaaataaacaaaatgagccagccatggtggcatgcacctgtggtc

SEQ ID NO: 71498 - DNA, 601 bp, Human
aggtcagtgagcagaacaatgatggtcaaagccgatgctagaagctgatatagacagaatagatagacaactaatagcataatggcttctcttggaccaatcaatggacagatttgatgtattgtaaatgtagtgaagccattagtcaggggttttccacctctccccatctccccagtgcatgcacaatgtggctatgacttggcaaaggtgaagtcaggtggagaagggctcagagaggtcagaatatgatagtaataagcactgagttcagaggttcaaggaagataaatgttgattkgttggtaaggtaagtgttgataagaaggtaagataagatggactatattttaatgacttacaaatgtttaacaggaaaaaatcagctacaataagcgttttggttgtaggttgggctaaaattatgtttgcaccattttaaaaacgcaaataagccagacacactggctcatttctgtaatcccagcactttgggaggccaaggcaggaggatcacttgtgcctaggagttcaaaaccagcctgggtaacatagtgagactccatctctacaaaaaaataaacaaaatgagccagccatg

SEQ ID NO: 71499 - DNA, 601 bp, Human
cagtgaataagtctcacaaaatctgatgattttatccagggtttcccctttctcttggctcgcattctaccttgcctgccgccatgtaagacatgccttttgccttccactatgattgtgaggtccccccagccatgtggaactgtgagtccattaaacctctttttctttataaattacccagtctcaggtatatctttatcagcagtgtgaaaacagactaatacaataatctatcttcccttctggactataaattcctcaaatgtatagtctatctttaacttttagcactgtattyctgcctcagatctgtgtgtgcctggcacatggaagatgtttaataagtgaccaataaataggtgggtggatggatggataaaaaaactacatctccactgtagtcaaaatgcctaatagatttagtcattcttgaaattagaaaagataccttttgttttcaaatgaggatagcgtatttccctttccataagcctaaatgtaaatatgaacattaaattagtcaagagtcagttaaagtatctgagaaataccttacctgaagcgtagtcccttcgaggaacacttggaggtgctttga

SEQ ID NO: 71500 - DNA, 601 bp, Human
gggagggaccttgtaggagataattgaatcatgagtgcagtttcccccgtaccgttctggtggcagtgaataagtctcacaaaatctgatgattttatccagggtttcccctttctcttggctcgcattctaccttgcctgccgccatgtaagacatgccttttgccttccactatgattgtgaggtccccccagccatgtggaactgtgagtccattaaacctctttttctttataaattacccagtctcaggtatatctttatcagcagtgtgaaaacagactaatacaataatctatyttcccttctggactataaattcctcaaatgtatagtctatctttaacttttagcactgtattcctgcctcagatctgtgtgtgcctggcacatggaagatgtttaataagtgaccaataaataggtgggtggatggatggataaaaaaactacatctccactgtagtcaaaatgcctaatagatttagtcattcttgaaattagaaaagataccttttgttttcaaatgaggatagcgtatttccctttccataagcctaaatgtaaatatgaacattaaattagtcaagagtcagttaa

SEQ ID NO: 71501 - DNA, 601 bp, Human
gccctggctggattgcagtagcatgatcacatctcactgcagccttgacctcagtgatcctcccacctcagcctcctgagtagctgggactacaggtgcatgccaccacacctggataatttgcattttttgtagagacagggttttgccatgttgcccaggctgatctcaaactcctgggctcaagcaatctgccttcctcagcctcccaaaatgctaggattgcaggtgtgagccactgcacctgggcctataattacttttaacataattgatatggtttttctgtgtacccccccawatctcatcttgcattgtagctcccataattcccacatgctgtgggagggaccttgtaggagataattgaatcatgagtgcagtttcccccgtaccgttctggtggcagtgaataagtctcacaaaatctgatgattttatccagggtttcccctttctcttggctcgcattctaccttgcctgccgccatgtaagacatgccttttgccttccactatgattgtgaggtccccccagccatgtggaactgtgagtccattaaacctctttttctttataaattacccagtctcaggtata

SEQ ID NO: 71502 - DNA, 601 bp, Human
acactacaaatctcaaaactaacccttctttcctgccaaagttgatcctagttggaatgaggttgcaggctaaacttggagaggactgagagtcagcaatgtgccagcaataatttattacccccaccccttcaacaatcctcaaatatcaatttaaacagcttttgatggaggaagtagtctcttccccacttaccccacactcccagccacagattagattcattagtgctgctgtggaattccacagaactttgtgcttcccctatcactgaattgtaattacttttcttttctttctttttttttttttgagacagggtctcactctgttgccctggctggattgcagtagcatgatcacatctcactgcagccttgacctcagtgatcctcccacctcagcctcctgagtagctgggactacaggtgcatgccaccacacctggataatttgcattttttgtagagacagggttttgccatgttgcccaggctgatctcaaactcctgggctcaagcaatctgccttcctcagcctcccaaaatgctaggattgcaggtgtgagccactgcacctgggcctataattacttttaac

SEQ ID NO: 71503 - DNA, 601 bp, Human
acccaagactccatgattttataatttgtccatcaaacttatttagttctttaacaggttgagtctgctttggtttcttttctttatttagaacttggaaggaagaatgtgtttgttctcatataactaggaagcttccttgacttattgattaggtagatattaaagcccagaacagggtccctcttttagtgccagactgtactggcatcccctgaccaactgtctaaacttgctgactgattggcagggtgatgccaataactactctgtgaattagtgagtggtccaacaggcctgyaaccagacttgggcaggttggtcagcatttctcagtgtgataagattcccttaggaggaactgcactatctgacttattgctatcttgatcagtggccgaaaaaataaaataaaatagtaagcatcatttaaggttatggtttggttttaggctgttgccctgttgagaatcatcaatgatgtctgtagctctgtggttttcactgagggatattcaggaaatctttataattaatgctatagaaagagattttaaaactatcttccaacgtatttgttctaataaagaaatgtgtattg

SEQ ID NO: 71504 - DNA, 601 bp, Human
aagccctggatcagatattggtctacacgacctctggggttccttttaaacccaagactccatgattttataatttgtccatcaaacttatttagttctttaacaggttgagtctgctttggtttcttttctttatttagaacttggaaggaagaatgtgtttgttctcatataactaggaagcttccttgacttattgattaggtagatattaaagcccagaacagggtccctcttttagtgccagactgtactggcatcccctgaccaactgtctaaacttgctgactgattggcaggrtgatgccaataactactctgtgaattagtgagtggtccaacaggcctgtaaccagacttgggcaggttggtcagcatttctcagtgtgataagattcccttaggaggaactgcactatctgacttattgctatcttgatcagtggccgaaaaaataaaataaaatagtaagcatcatttaaggttatggtttggttttaggctgttgccctgttgagaatcatcaatgatgtctgtagctctgtggttttcactgagggatattcaggaaatctttataattaatgctatagaaagagat

SEQ ID NO: 71505 - DNA, 601 bp, Human
ctaacttcttaattctctcctttgaagttgcacaggacaactctatttttatttttcttaatatttttttcttatattttaagagatgggatctcgctatattgaccaagctggtcttaaactcctggcctcaagcaatcctcccatcttggcctcccaaagtgctgggataacaggtgtgagcccctgtgcctggctctacttttcttcatatttaaaggcttgaactgtgtggccatcaggatagacataggaagtcacaaggaaattgattgtatctatatccagccagggctgcctrtcccttgctagaccatgggaaaccatcacagaaagtgtccaagcagaagctgggccttgtgtgtggaggtgaatggtggtgggataggggttaagccctggatcagatattggtctacacgacctctggggttccttttaaacccaagactccatgattttataatttgtccatcaaacttatttagttctttaacaggttgagtctgctttggtttcttttctttatttagaacttggaaggaagaatgtgtttgttctcatataactaggaagcttccttgacttattgattaggtag

SEQ ID NO: 71506 - DNA, 601 bp, Human
cctaacttcttaattctctcctttgaagttgcacaggacaactctatttttatttttcttaatatttttttcttatattttaagagatgggatctcgctatattgaccaagctggtcttaaactcctggcctcaagcaatcctcccatcttggcctcccaaagtgctgggataacaggtgtgagcccctgtgcctggctctacttttcttcatatttaaaggcttgaactgtgtggccatcaggatagacataggaagtcacaaggaaattgattgtatctatatccagccagggctgccygtcccttgctagaccatgggaaaccatcacagaaagtgtccaagcagaagctgggccttgtgtgtggaggtgaatggtggtgggataggggttaagccctggatcagatattggtctacacgacctctggggttccttttaaacccaagactccatgattttataatttgtccatcaaacttatttagttctttaacaggttgagtctgctttggtttcttttctttatttagaacttggaaggaagaatgtgtttgttctcatataactaggaagcttccttgacttattgattaggta

SEQ ID NO: 71507 - DNA, 601 bp, Human
ctaatttatatttacctgtttgctttcttgtttcttatctgactccccactagtcattcagcactgtaaggtcaggggttgtatgttgttccccactccagatctagcacagtgacagtcacacaggacacactcatgaaacacgtgttgaatgaatcagaaaatgtgcgaaacagctgaagcacctggagatgtttatcccagagaagaaaccactcagatggcctaacttcttaattctctcctttgaagttgcacaggacaactctatttttatttttcttaatatttttttcttatrttttaagagatgggatctcgctatattgaccaagctggtcttaaactcctggcctcaagcaatcctcccatcttggcctcccaaagtgctgggataacaggtgtgagcccctgtgcctggctctacttttcttcatatttaaaggcttgaactgtgtggccatcaggatagacataggaagtcacaaggaaattgattgtatctatatccagccagggctgcctgtcccttgctagaccatgggaaaccatcacagaaagtgtccaagcagaagctgggccttgtgtgtggaggtgaatg

SEQ ID NO: 71508 - DNA, 601 bp, Human
gtaccatgtttgctaatttatatttacctgtttgctttcttgtttcttatctgactccccactagtcattcagcactgtaaggtcaggggttgtatgttgttccccactccagatctagcacagtgacagtcacacaggacacactcatgaaacacgtgttgaatgaatcagaaaatgtgcgaaacagctgaagcacctggagatgtttatcccagagaagaaaccactcagatggcctaacttcttaattctctcctttgaagttgcacaggacaactctatttttatttttcttaatatttttttcttatattttaagagatgggatctcgctatattgaccaagctggtcttaaactcctggcctcaagcaatcctcccatcttggcctcccaaagtgctgggataacaggtgtgagcccctgtgcctggctctacttttcttcatatttaaaggcttgaactgtgtggccatcaggatagacataggaagtcacaaggaaattgattgtatctatatccagccagggctgcctgtcccttgctagaccatgggaaaccatcacagaaagtgtccaagcagaagctgggccttgtgtg

SEQ ID NO: 71509 - DNA, 601 bp, Human
gggtggatcagcaggcagacaggtgagtgtgaggggacaatcaggagggaggtccaccctgaaatcagatatgtcagtccacttaggtttccaacaattgactctgaactcctggaatctgtgtccagcatctctgatgctgttggttcatctaaaagtggcaaatattcctgcacatttgtccccgaatcctcaaattaaatgtcaccttctcagacagatcttcccacaccacctaagctcttctcctaccccacactgattccccaccattgcactcttccatcttccctcacagcargtaccatgtttgctaatttatatttacctgtttgctttcttgtttcttatctgactccccactagtcattcagcactgtaaggtcaggggttgtatgttgttccccactccagatctagcacagtgacagtcacacaggacacactcatgaaacacgtgttgaatgaatcagaaaatgtgcgaaacagctgaagcacctggagatgtttatcccagagaagaaaccactcagatggcctaacttcttaattctctcctttgaagttgcacaggacaactctatttttatttttcttaata

SEQ ID NO: 71510 - DNA, 601 bp, Human
tttcagaacaattttctggtggaagttgagaggaccacatgcaatcaggaattaagcagattacttagagccttctaccctaggacaagcaagagatgatgaaggccttagctgtagcaatgggaatagagagggaaaaaatatttaagaggcatttaagagcaaatcaatgagatttggagattaatttttgtagaaggtgagggaaaaggaggcatcaaggttgatcccaagtgtgtgggttaggcaaaaggatgaataatagatggatgctacctcccttttccccacgcagaaataragggaaaggagagggcctgggtgggtggatcagcaggcagacaggtgagtgtgaggggacaatcaggagggaggtccaccctgaaatcagatatgtcagtccacttaggtttccaacaattgactctgaactcctggaatctgtgtccagcatctctgatgctgttggttcatctaaaagtggcaaatattcctgcacatttgtccccgaatcctcaaattaaatgtcaccttctcagacagatcttcccacaccacctaagctcttctcctaccccacactgattccccaccattgcac

SEQ ID NO: 71511 - DNA, 601 bp, Human
gacctgcatccctggaggagacccagctctccattctttgtgtaattcaagctttgtccttctgtactctaactagggaagagggtatggtgactcttttactgacctcctgtggggcagttgctggtcctttctatcctctgctctctgaaggtcagcatcaccaaggtcaacacactcttggcttagagggttttgggaagccatttgtttccagaactggaaagaggacataaatccaatgtgtggggggaaaatggctggagcatttcaggagcctttggtggatcaagtgctccayagggcacgtgattggcctcccaggctcaggaggtctggtgggctctggcctccacacactacagtttccaagatcctaaagactccccaggttcaggaggagctctcagggctgatttctgaggccctggacgtgcagctgtgcagaaacctcaaggctcaggggaagcagctggaaatgctcctgggatgtgaactggggtgggggagagaacggcaagggaggatgctaactgcaggtggtgatggtggttttggaccatttccggggattgagtgtaagagcaggggaaactgggca

SEQ ID NO: 71512 - DNA, 601 bp, Human
gggagacagaaaaccaggtaaatgctggctccactaggagcaccaggcccatgacaaaagcaatgttaaatctcacttctttagtggacaaaggattgttatgcataccccatacttctgtgtgggcatttacccaagaatccctgtccaagtgccttctttgctctggatttttatttttttccatgtaagtgagtttgccacccctccaccctatatttgctctgatctcctccctgcatgatagcagagccagaggagtcacacgtggacctcccagggatgccaccccatcagagcsctggacatcagagcccaagagtgcaagagaggggctctgttcagttctgactcctcaaggacttgtggggtaaccaatggggcatctgcagtgatcccagcagactctcgggcaccatgactggtctctccctgacctccatccccagccagacctcagacttcaaagataccgaaggctgttcaactgtgaaagctcaggaactgggaagcgagttcttgcattaatgtcaggagctctagtgccttcagaataagaaaaaagttcccccaaaagcatgaacacttgagcttgggtcaa

SEQ ID NO: 71513 - DNA, 601 bp, Human
atgttggatatagctctcccatgtcagcgtaagaccagtacctccaggggaatatggacagggagacagaaaaccaggtaaatgctggctccactaggagcaccaggcccatgacaaaagcaatgttaaatctcacttctttagtggacaaaggattgttatgcataccccatacttctgtgtgggcatttacccaagaatccctgtccaagtgccttctttgctctggatttttatttttttccatgtaagtgagtttgccacccctccaccctatatttgctctgatctcctccctgcrtgatagcagagccagaggagtcacacgtggacctcccagggatgccaccccatcagagccctggacatcagagcccaagagtgcaagagaggggctctgttcagttctgactcctcaaggacttgtggggtaaccaatggggcatctgcagtgatcccagcagactctcgggcaccatgactggtctctccctgacctccatccccagccagacctcagacttcaaagataccgaaggctgttcaactgtgaaagctcaggaactgggaagcgagttcttgcattaatgtcaggagctct

SEQ ID NO: 71514 - DNA, 601 bp, Human
tggggacagacaccgaaaaggaacagaaagcagaactacagaggctgcaggggaggcggtgggtggccagtcccaccagtgccgccctaagaggagaaagggacatgatttaatgtggggaactgaggacaagacccagattcaggctggctgagagaggtgttctgagtctaaatacttaacatcttaggccaggcatggtgggctcacacctgtaatcccagcactttgggaggccagggcaggaggatcactggaggccgggaatttgagaacaccctggacaacatagtgagacatwgtctctacaaaaaagattttagaaaattagccaggcatggtggcacatgcctgtggtcccagctactcaggaggctgaagcaggaggatcacttgagcccaggaggttgaggctgcagtgagccatgattgtacccctggaccccagcctgggtgacagggcgagaccccgtctcaaaaaaagaaaaaagaaatacttatcatcgtagaaactccctttgtctgtatgtctattcatcccttcacaggatcattaacagaggggtgggggtacagcaatgggggacatagtcctggctca

SEQ ID NO: 71515 - DNA, 601 bp, Human
cctgcccatctctcccccaacagagcaggtggtggcatgcagggagccagtgggaagaccgcagcaggacacagaaggaaggaaagagggagggtgggccagttgtggtggtggggacagacaccgaaaaggaacagaaagcagaactacagaggctgcaggggaggcggtgggtggccagtcccaccagtgccgccctaagaggagaaagggacatgatttaatgtggggaactgaggacaagacccagattcaggctggctgagagaggtgttctgagtctaaatacttaacatcttargccaggcatggtgggctcacacctgtaatcccagcactttgggaggccagggcaggaggatcactggaggccgggaatttgagaacaccctggacaacatagtgagacattgtctctacaaaaaagattttagaaaattagccaggcatggtggcacatgcctgtggtcccagctactcaggaggctgaagcaggaggatcacttgagcccaggaggttgaggctgcagtgagccatgattgtacccctggaccccagcctgggtgacagggcgagaccccgtctcaaaaaaagaaaaaa

SEQ ID NO: 71516 - DNA, 601 bp, Human
ggtgtttaggaactcaggcatggaaagacgaaagctgatccagaccagggggtctgggaatgggaagggatggctggaaggacagtacaggactctgtggtggtggctggggcaaagggagtatgaatccagcctctcagttctgagtcaataggagcaccagagcccctggggcagatgctggtggcatcacagcatgtctgacattctgcctcagctgcagccctgatcctgctctggaggctacccggccgccagaccctgcccatctctcccccaacagagcaggtggtggcatgcrgggagccagtgggaagaccgcagcaggacacagaaggaaggaaagagggagggtgggccagttgtggtggtggggacagacaccgaaaaggaacagaaagcagaactacagaggctgcaggggaggcggtgggtggccagtcccaccagtgccgccctaagaggagaaagggacatgatttaatgtggggaactgaggacaagacccagattcaggctggctgagagaggtgttctgagtctaaatacttaacatcttaggccaggcatggtgggctcacacctgtaatcccagcacttt

SEQ ID NO: 71517 - DNA, 601 bp, Human
gcttagaagagtatctgacatagagtaaagggctcaatgaatgttagctattacaatgaatttacagtctctgcaattctcagaacaatctaaaggataggtattcttatccccaggtcagaaattggaggctcactcaaattacaaaactgttccaagttcacacagtgcttagggagcaaagccaggattccatcccaggcctaaaggacctcagagtccaaggtcttctcaccaagccacacttcataatacaaataaagactaagggccagaagaatgaccacatgagactgaggamaactcagggccatgtagttttctgagaaatgtccccacacctggaatcattgccaggagcggggaaagttcagagaaaggtgtgcccagtgacagccaaaaacttgcatgaggccatgtgcccgaggtggggccgaatggggccttgaaggatgagcaggatttgggtgagagaataaggatgaaggagtgtgtcttcctccatcatctgagagaggggcttatgtgtcagccccagaagcagggcttagaggcagatgtgtgcagaatgaatgcgctgggctggagagggacaggagat

SEQ ID NO: 71518 - DNA, 601 bp, Human
aattgcttcacctctgggcctcagcttcccctttgctaaaatggacattattaatcgtgcttagaagagtatctgacatagagtaaagggctcaatgaatgttagctattacaatgaatttacagtctctgcaattctcagaacaatctaaaggataggtattcttatccccaggtcagaaattggaggctcactcaaattacaaaactgttccaagttcacacagtgcttagggagcaaagccaggattccatcccaggcctaaaggacctcagagtccaaggtcttctcaccaagccayacttcataatacaaataaagactaagggccagaagaatgaccacatgagactgaggacaactcagggccatgtagttttctgagaaatgtccccacacctggaatcattgccaggagcggggaaagttcagagaaaggtgtgcccagtgacagccaaaaacttgcatgaggccatgtgcccgaggtggggccgaatggggccttgaaggatgagcaggatttgggtgagagaataaggatgaaggagtgtgtcttcctccatcatctgagagaggggcttatgtgtcagccccagaagca

SEQ ID NO: 71519 - DNA, 601 bp, Human
acttagaatccttattctgccattttctaggagtgagatcttagctgaattgcttcacctctgggcctcagcttcccctttgctaaaatggacattattaatcgtgcttagaagagtatctgacatagagtaaagggctcaatgaatgttagctattacaatgaatttacagtctctgcaattctcagaacaatctaaaggataggtattcttatccccaggtcagaaattggaggctcactcaaattacaaaactgttccaagttcacacagtgcttagggagcaaagccaggattccawcccaggcctaaaggacctcagagtccaaggtcttctcaccaagccacacttcataatacaaataaagactaagggccagaagaatgaccacatgagactgaggacaactcagggccatgtagttttctgagaaatgtccccacacctggaatcattgccaggagcggggaaagttcagagaaaggtgtgcccagtgacagccaaaaacttgcatgaggccatgtgcccgaggtggggccgaatggggccttgaaggatgagcaggatttgggtgagagaataaggatgaaggagtgtgtc

SEQ ID NO: 71520 - DNA, 601 bp, Human
ttcctcacccgtaaagcaaggataagaacagtgcctgtatcatatttttgtgagaatcagataataaaatacatctgaagctcttagcaaagcctggcacacagtaatgctttagtaatgttaccgtcatcttgagcattgcaaagaatgcctcaattaacactcaaaacaccactgattctaatgtactcccacgtcaatcacacactatggctaccacaaaggcatggatccaagaaagcctctattgtagtgagtaaaatttgggggagaagttcaagcttcatgtgggccaggtggwttgattttgtttgtgtgattccatggtctctgccaggaagctgagatcctgggcgggccctcttgtcagttaaagcctttcctatggtgtggtttacctggtttggggcttatgctccatttaccatgtcataatcccatgccacacaatagagggactcctccctttgcctgacccaggttttaagattcatgtagccctccccagcctgtgggcacagcaccagacacaaggagatgtgagaatggccacagcggcccacatttgggcttaagctctggggtcagactgcctaactta

SEQ ID NO: 71521 - DNA, 601 bp, Human
cccaaagtgcacaggtggtagtttagagccaggctttctaggttcaaatcctggctctgacctttacaagctgcttggtcttggaccaataatttaatattgtttaaagcttcatttcctcacccgtaaagcaaggataagaacagtgcctgtatcatatttttgtgagaatcagataataaaatacatctgaagctcttagcaaagcctggcacacagtaatgctttagtaatgttaccgtcatcttgagcattgcaaagaatgcctcaattaacactcaaaacaccactgattctaatktactcccacgtcaatcacacactatggctaccacaaaggcatggatccaagaaagcctctattgtagtgagtaaaatttgggggagaagttcaagcttcatgtgggccaggtggtttgattttgtttgtgtgattccatggtctctgccaggaagctgagatcctgggcgggccctcttgtcagttaaagcctttcctatggtgtggtttacctggtttggggcttatgctccatttaccatgtcataatcccatgccacacaatagagggactcctccctttgcctgacccaggtttta

SEQ ID NO: 71522 - DNA, 601 bp, Human
gtgcaactcacagcatcatattcataaagttacagtcttgcaggcaattgccaagactaaaaagcatgggagtccaaggtattaggtccaaaacagtagtcagttttccagtatctcagggagcttcccaaagtgcacaggtggtagtttagagccaggctttctaggttcaaatcctggctctgacctttacaagctgcttggtcttggaccaataatttaatattgtttaaagcttcatttcctcacccgtaaagcaaggataagaacagtgcctgtatcatatttttgtgagaatcarataataaaatacatctgaagctcttagcaaagcctggcacacagtaatgctttagtaatgttaccgtcatcttgagcattgcaaagaatgcctcaattaacactcaaaacaccactgattctaatgtactcccacgtcaatcacacactatggctaccacaaaggcatggatccaagaaagcctctattgtagtgagtaaaatttgggggagaagttcaagcttcatgtgggccaggtggtttgattttgtttgtgtgattccatggtctctgccaggaagctgagatcctgggcgggcc

SEQ ID NO: 71523 - DNA, 601 bp, Human
ttgttggtgccccatcgattcctagctagactatctacttcaggtcccaagtgcaactcacagcatcatattcataaagttacagtcttgcaggcaattgccaagactaaaaagcatgggagtccaaggtattaggtccaaaacagtagtcagttttccagtatctcagggagcttcccaaagtgcacaggtggtagtttagagccaggctttctaggttcaaatcctggctctgacctttacaagctgcttggtcttggaccaataatttaatattgtttaaagcttcatttcctcaccygtaaagcaaggataagaacagtgcctgtatcatatttttgtgagaatcagataataaaatacatctgaagctcttagcaaagcctggcacacagtaatgctttagtaatgttaccgtcatcttgagcattgcaaagaatgcctcaattaacactcaaaacaccactgattctaatgtactcccacgtcaatcacacactatggctaccacaaaggcatggatccaagaaagcctctattgtagtgagtaaaatttgggggagaagttcaagcttcatgtgggccaggtggtttgattttg

SEQ ID NO: 71524 - DNA, 601 bp, Human
ggttggaagccaggctgtgttggctcctgcagctgaaatctcatctgagccacttagccctctgctgagcacttagataaaaccttggtgaaacgagaatgacccaatccagacatcttggcacatggagacagaaaagagagaaaagcatcatacagtatgggatagaggttgtttgttggtgccccatcgattcctagctagactatctacttcaggtcccaagtgcaactcacagcatcatattcataaagttacagtcttgcaggcaattgccaagactaaaaagcatgggagtccraggtattaggtccaaaacagtagtcagttttccagtatctcagggagcttcccaaagtgcacaggtggtagtttagagccaggctttctaggttcaaatcctggctctgacctttacaagctgcttggtcttggaccaataatttaatattgtttaaagcttcatttcctcacccgtaaagcaaggataagaacagtgcctgtatcatatttttgtgagaatcagataataaaatacatctgaagctcttagcaaagcctggcacacagtaatgctttagtaatgttaccgtcatcttga

SEQ ID NO: 71525 - DNA, 601 bp, Human
ggctaagtgttataaaagtgtattcttataacagcactatgtggtaggtgttatttttatctctattttacagtggagaaacttggttttgaaagaggttgtaaaacctgcctgaggctacttggctagtgagtttgggagctgggttggaagccaggctgtgttggctcctgcagctgaaatctcatctgagccacttagccctctgctgagcacttagataaaaccttggtgaaacgagaatgacccaatccagacatcttggcacatggagacagaaaagagagaaaagcatcatacrgtatgggatagaggttgtttgttggtgccccatcgattcctagctagactatctacttcaggtcccaagtgcaactcacagcatcatattcataaagttacagtcttgcaggcaattgccaagactaaaaagcatgggagtccaaggtattaggtccaaaacagtagtcagttttccagtatctcagggagcttcccaaagtgcacaggtggtagtttagagccaggctttctaggttcaaatcctggctctgacctttacaagctgcttggtcttggaccaataatttaatattgttta

SEQ ID NO: 71526 - DNA, 601 bp, Human
actcaaacaaaggaacattaggatagcaacaatagattccatttactgaacacttcctatgtgctgggtgccaggctaagtgttataaaagtgtattcttataacagcactatgtggtaggtgttatttttatctctattttacagtggagaaacttggttttgaaagaggttgtaaaacctgcctgaggctacttggctagtgagtttgggagctgggttggaagccaggctgtgttggctcctgcagctgaaatctcatctgagccacttagccctctgctgagcacttagataaaacyttggtgaaacgagaatgacccaatccagacatcttggcacatggagacagaaaagagagaaaagcatcatacagtatgggatagaggttgtttgttggtgccccatcgattcctagctagactatctacttcaggtcccaagtgcaactcacagcatcatattcataaagttacagtcttgcaggcaattgccaagactaaaaagcatgggagtccaaggtattaggtccaaaacagtagtcagttttccagtatctcagggagcttcccaaagtgcacaggtggtagtttagagccagg

SEQ ID NO: 71527 - DNA, 601 bp, Human
ttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgactccctatggaatcaagtagaggttctgtggcaacacattccaatgcctccgccttctgtcccaccaccgayttcttgcggcaggctcccacgctcactaacagtaacaccagacagcttcctcctcccgttgtgcactttgctgattctctgctctgctcgtgccgttcctgcagcccatcttctttcttccatggaaatccctatcactcctcctccacaaagtctaccacagtctcttgtcataatcaatcacttctttttctgggccctcttggaagctggtggcaccgtgatgtcacatgtacttcgttctgtcctgtgctgtgattaagttgttcatgtctctctgtactgaaaataaggcctatc

SEQ ID NO: 71528 - DNA, 601 bp, Human
gcatttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgactccctatggaatcaagtagaggttctgtggcaacacattccaatgcctccgccttctgtcccaccaccgatttcttgcggcaggctcccacgctcactaacagtaacaccagacagcttcctcctcccgttgtgcactttgctgattctctgctctgctcgtgccgttcctgcagcccatcttctttcttccatggaaatccctatcactcctcctccacaaagtctaccacagtctcttgtcataatcaatcacttctttttctgggccctcttggaagctggtggcaccgtgatgtcacatgtacttcgttctgtcctgtgctgtgattaagttgttcatgtctctctgtactgaaaataaggcc

SEQ ID NO: 71529 - DNA, 601 bp, Human
caacacttaagatggcaagagtttttgtaacaaccatttaaatagaaacccttataaaatgcatttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgactccctayggaatcaagtagaggttctgtggcaacacattccaatgcctccgccttctgtcccaccaccgatttcttgcggcaggctcccacgctcactaacagtaacaccagacagcttcctcctcccgttgtgcactttgctgattctctgctctgctcgtgccgttcctgcagcccatcttctttcttccatggaaatccctatcactcctcctccacaaagtctaccacagtctcttgtcataatcaatcacttctttttctgggccctcttggaagctggtggcaccgtgatgtcacatgtac

SEQ ID NO: 71530 - DNA, 601 bp, Human
ctgaagatcaacacttaagatggcaagagtttttgtaacaaccatttaaatagaaacccttataaaatgcatttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgrctccctatggaatcaagtagaggttctgtggcaacacattccaatgcctccgccttctgtcccaccaccgatttcttgcggcaggctcccacgctcactaacagtaacaccagacagcttcctcctcccgttgtgcactttgctgattctctgctctgctcgtgccgttcctgcagcccatcttctttcttccatggaaatccctatcactcctcctccacaaagtctaccacagtctcttgtcataatcaatcacttctttttctgggccctcttggaagctggtggcaccgtgatgtc

SEQ ID NO: 71531 - DNA, 601 bp, Human
ttgcccaggctggtcttgaactcctgggttcaaataactcacctgcctctgccttcaaaagtgctgggattacaggcataagccactgcatctggtcaatgtgtttctaataccttaagtctggggatcactgaagatcaacacttaagatggcaagagtttttgtaacaaccatttaaatagaaacccttataaaatgcatttatgaaacccacttccctgcctggataactgcatttgctccaccctttctcagtgagtgggggcctattttatgatcagtcactggtgaaagtagtgyattagccatctaactagtgtccctgtctccattatctttcttctccaatccatccatcctaccgtttgtagttattttattaaaataaagtttggattatgctgttcctttccttaagagtcatcagtgactccctatggaatcaagtagaggttctgtggcaacacattccaatgcctccgccttctgtcccaccaccgatttcttgcggcaggctcccacgctcactaacagtaacaccagacagcttcctcctcccgttgtgcactttgctgattctctgctctgctcgtgccgttc

SEQ ID NO: 71532 - DNA, 601 bp, Human
ggtgcaagcgatcctgctacctcagcctcctgagtaactggcacgtgccaccatgcccagctaacttttgtattttttgtagagatggggttttgccatgttgcccaggctggtcttgaactcctgggttcaaataactcacctgcctctgccttcaaaagtgctgggattacaggcataagccactgcatctggtcaatgtgtttctaataccttaagtctggggatcactgaagatcaacacttaagatggcaagagtttttgtaacaaccatttaaatagaaacccttataaaatgcmtttatgaaacccacttccctgcctggataactgcatttgctccaccctttctcagtgagtgggggcctattttatgatcagtcactggtgaaagtagtgcattagccatctaactagtgtccctgtctccattatctttcttctccaatccatccatcctaccgtttgtagttattttattaaaataaagtttggattatgctgttcctttccttaagagtcatcagtgactccctatggaatcaagtagaggttctgtggcaacacattccaatgcctccgccttctgtcccaccaccg

SEQ ID NO: 71533 - DNA, 601 bp, Human
ttgggtgaataaatcctcttcccaatatgattacctggcacaatgggggagtatgtttctttttcttttctagtcttttttttttttttgagacagagtctcactctgttgcccaggtgggagtgcagtggcacaatcatggcttactgcagcctcaacctccttggtgcaagcgatcctgctacctcagcctcctgagtaactggcacgtgccaccatgcccagctaacttttgtattttttgtagagatggggttttgccatgttgcccaggctggtcttgaactcctgggttcaaatractcacctgcctctgccttcaaaagtgctgggattacaggcataagccactgcatctggtcaatgtgtttctaataccttaagtctggggatcactgaagatcaacacttaagatggcaagagtttttgtaacaaccatttaaatagaaacccttataaaatgcatttatgaaacccacttccctgcctggataactgcatttgctccaccctttctcagtgagtgggggcctattttatgatcagtcactggtgaaagtagtgcattagccatctaactagtgtccctgtctccattat

SEQ ID NO: 71534 - DNA, 601 bp, Human
ctacaagccaaacatgggtcacactttgacgtgaacagaaaagaattcttacattattctttgggttgactaatgctgaattagagtgtactgcaatcactggggttggccaagaaactctagaagattgggtgaataaatcctcttcccaatatgattacctggcacaatgggggagtatgtttctttttcttttctagtcttttttttttttttgagacagagtctcactctgttgcccaggtgggagtgcagtggcacaatcatggcttactgcagcctcaacctccttggtgcaagygatcctgctacctcagcctcctgagtaactggcacgtgccaccatgcccagctaacttttgtattttttgtagagatggggttttgccatgttgcccaggctggtcttgaactcctgggttcaaataactcacctgcctctgccttcaaaagtgctgggattacaggcataagccactgcatctggtcaatgtgtttctaataccttaagtctggggatcactgaagatcaacacttaagatggcaagagtttttgtaacaaccatttaaatagaaacccttataaaatgcatttatgaa

SEQ ID NO: 71535 - DNA, 601 bp, Human
ttaagcaatggcggcagcagcaccctcttttgggaaaaacatgataggtgctaagaaagagcctcactctacaagccaaacatgggtcacactttgacgtgaacagaaaagaattcttacattattctttgggttgactaatgctgaattagagtgtactgcaatcactggggttggccaagaaactctagaagattgggtgaataaatcctcttcccaatatgattacctggcacaatgggggagtatgtttctttttcttttctagtcttttttttttttttgagacagagtctcactstgttgcccaggtgggagtgcagtggcacaatcatggcttactgcagcctcaacctccttggtgcaagcgatcctgctacctcagcctcctgagtaactggcacgtgccaccatgcccagctaacttttgtattttttgtagagatggggttttgccatgttgcccaggctggtcttgaactcctgggttcaaataactcacctgcctctgccttcaaaagtgctgggattacaggcataagccactgcatctggtcaatgtgtttctaataccttaagtctggggatcactgaagatcaa

SEQ ID NO: 71536 - DNA, 601 bp, Human
tgtggcccttaagtagtttatgagcttgtagaataaaataagtctgaattatgacagcccaggcgaatatttgacccctttccctccaaaacacatttagagtatgagaaacttagcatctagcctatcacataaactgaccttagaggttaaatgggattcactctgctgtgtaggaatcaagcagacacaggcccatgtggcagagtggctccatgacagcaccacagagggtcccagctccctcctgccccgctgagcagccactgccacagaggatccagtggatgttcctaaattycccagaacctcaacagaaccttttctagttttatttttatgtttttgctattccccgctgagtagccactgccacagaggacccagtggatgttcctaaatttcccagaacctcaacagaacattttctagttttatttttatgtttttgctatttctacccctgccacagcagaccaccggactccagagagtcaaacatttggggtctccagaggcaccagcaaggaattgcagaggtgaaatggggtcaggaaggatactgtgggatcggagtggccacattttaagcaatggcggc

SEQ ID NO: 71537 - DNA, 601 bp, Human
actctgaacaccagcactgaagttgggcataagaacacctacctcaaaggtttaaatgaggttatgtgtggaaagctcttagccaggcgcacactgagtgccagtcaagtcagctggtatgcagtatgccttgcctgtaggtgacctttccaagtcttccctcttgggacgtgcggctgaccaccagcatgtaattcagaaataagatcttcaaaaggcctcccatgggaccctgatgccctcctggtcccaggagcaaatacttacaaagtcatcggaccactgctcctcttcgtcagcrgggctctctgcaacagcaggggagaagcagaaggcacaagtgtgagcctcagctggccagccccagcccatccacacacatttcgcacctgccttcccttccctttgggctttctggtgccatatacttgaccttgggttagttactacaatcatatgttcacttgcttttgactttttaaaaaatattaattctcaaagcatagagagaagtcccactgggcagagcaatgtgcgtctgatccatgtgtgggctttgttaagggacatttctgggtcccccagtagagacctacaattc

SEQ ID NO: 71538 - DNA, 601 bp, Human
tgcagtggggatccatctactgaagtcaaaagagctgtgagtgaatgcttactcagtctttagtacagctggtatcttcattttggttgtctgattttggggcaagtaattccttcctctccaggctgattttattttgtgctttctaagttcccttgtgtgctctttttcatccagccagcttgctcagttttcttctcttacctctgcatgtggaccaagcaatttctttgctttacatgtggctgtgtgtgtgtgtgtgtgtgtgtgtgtgtgtgtgtcgtgtgtgcacgcgcgtgcrcagccagcagggggcgcagctgcagtgcatctcagggagctgcggctgctgggccccaggaggagctccatgaccaagagatgggcagaaaagtcaccccttcccctcatttttcttttctttttctgcagttgaagaaggaggaactcctgtcttctgagactctgtataaactccaggtagtgtgcacagcccagggctgggcacaggactggaggtctgagtcctgggttctcattccactgaactgggtgattttcattctcttggcctcagttttcttatctgtgaaatgggtat

SEQ ID NO: 71539 - DNA, 601 bp, Human
ttaaaatcaagaaattctggaggctttattaacaagcctggatttcattctgcgtgcagtggggatccatctactgaagtcaaaagagctgtgagtgaatgcttactcagtctttagtacagctggtatcttcattttggttgtctgattttggggcaagtaattccttcctctccaggctgattttattttgtgctttctaagttcccttgtgtgctctttttcatccagccagcttgctcagttttcttctcttacctctgcatgtggaccaagcaatttctttgctttacatgtggcggtgtgtgtgtgtgtgtgtgtgtgtgtgtgtgtgtcgtgtgtgcacgcgcgtgcgcagccagcagggggcgcagctgcagtgcatctcagggagctgcggctgctgggccccaggaggagctccatgaccaagagatgggcagaaaagtcaccccttcccctcatttttcttttctttttctgcagttgaagaaggaggaactcctgtcttctgagactctgtataaactccaggtagtgtgcacagcccagggctgggcacaggactggaggtctgagtcctgggttctcattccactga

SEQ ID NO: 71540 - DNA, 601 bp, Human
gtctttaaaaaaaaagaattgtaggggtacatagtaggtatatatatatatggggtatatgagatattttgaaacaggcatacaacgtgtagtaataacatctgggtaaatggggtatccatcactcaagcattcattttttgtgtgtgttataaacattccaattatattcttttagttatttttaaatgcacaataaattattgttgactgtagttaccctgttgtcaaacactaggtcttattcatcctaactatatttttgcacccattaactgtccctgtttccctccccccaccygctgccccctcgaccacccttcccagcctctggtaaacatcattctactgtctgtctttatgagttcaagtgttttaatttttagctcctacaaatgaatgagaacatatagcaggatttttgtttaaaatcaagaaattctggaggctttattaacaagcctggatttcattctgcgtgcagtggggatccatctactgaagtcaaaagagctgtgagtgaatgcttactcagtctttagtacagctggtatcttcattttggttgtctgattttggggcaagtaattccttcctctcc

SEQ ID NO: 71541 - DNA, 601 bp, Human
tgtccaccgccctcacactctgcctatcacattgcatgatctgtacatgactttccacttgctctttggcctgtcgcctttcataagcaattttatatagcaggattttttttcctgttggtctttaaaaaaaaagaattgtaggggtacatagtaggtatatatatatatggggtatatgagatattttgaaacaggcatacaacgtgtagtaataacatctgggtaaatggggtatccatcactcaagcattcattttttgtgtgtgttataaacattccaattatattcttttagttrtttttaaatgcacaataaattattgttgactgtagttaccctgttgtcaaacactaggtcttattcatcctaactatatttttgcacccattaactgtccctgtttccctccccccacctgctgccccctcgaccacccttcccagcctctggtaaacatcattctactgtctgtctttatgagttcaagtgttttaatttttagctcctacaaatgaatgagaacatatagcaggatttttgtttaaaatcaagaaattctggaggctttattaacaagcctggatttcattctgcgtg

SEQ ID NO: 71542 - DNA, 601 bp, Human
tgtttttcagaggtagtttatgtatataccgtttgtacatatattcatgtggaggaaatatttgactcaggacataagaggtcctctggcctctgtgtccaccgccctcacactctgcctatcacattgcatgatctgtacatgactttccacttgctctttggcctgtcgcctttcataagcaattttatatagcaggattttttttcctgttggtctttaaaaaaaaagaattgtaggggtacatagtaggtatatatatatatggggtatatgagatattttgaaacaggcatacaaygtgtagtaataacatctgggtaaatggggtatccatcactcaagcattcattttttgtgtgtgttataaacattccaattatattcttttagttatttttaaatgcacaataaattattgttgactgtagttaccctgttgtcaaacactaggtcttattcatcctaactatatttttgcacccattaactgtccctgtttccctccccccacctgctgccccctcgaccacccttcccagcctctggtaaacatcattctactgtctgtctttatgagttcaagtgttttaatttttag

SEQ ID NO: 71543 - DNA, 601 bp, Human
cttgtgcatgtttttcagaggtagtttatgtatataccgtttgtacatatattcatgtggaggaaatatttgactcaggacataagaggtcctctggcctctgtgtccaccgccctcacactctgcctatcacattgcatgatctgtacatgactttccacttgctctttggcctgtcgcctttcataagcaattttatatagcaggattttttttcctgttggtctttaaaaaaaaagaattgtaggggtacatagtaggtatatatatatatggggtatatgagatattttgaaacagrcatacaacgtgtagtaataacatctgggtaaatggggtatccatcactcaagcattcattttttgtgtgtgttataaacattccaattatattcttttagttatttttaaatgcacaataaattattgttgactgtagttaccctgttgtcaaacactaggtcttattcatcctaactatatttttgcacccattaactgtccctgtttccctccccccacctgctgccccctcgaccacccttcccagcctctggtaaacatcattctactgtctgtctttatgagttcaagtgtttta

SEQ ID NO: 71544 - DNA, 601 bp, Human
ggagtctcactctgttgcccagactggagtgcagtggcgcaatctcagctcactgcagcctctgcctcctgggttccagcgattctcctgccctggtctcccaagtagctgggattacaggcatgcaccaccgtgcctggctaatttttttttgaaaccgagtcttgctttgtcgcccaggctagagtgcagtggcaggatctcagctcactgcaacctctacttcctgggttcaagttattctcctgtctcagtctctggagtagctgggattacaaattgcaccaccacgcccagctartttttgtatttttagtaaagctggggtttcaccatgttggccaggctggtctcaaactcctgacctcaggtgatctgccagcctcggcctcccaaagcgctgagattacaggcatgagccactgcgcctggcctgtttttttaaaatccacatttcatttaagtccacactgaaaatacattgtcacggtctgaagtccaaatggcttagaaggatataaagtgcagtctccttctcagcctctctgcttctcaccgcagaggcagaaagagtcactaggtttcttgtgcatgtttttca

SEQ ID NO: 71545 - DNA, 601 bp, Human
gggagctgacactctgtagatccacaacaaataacaagaggagataataaaacatatttttaaaagataggaaaatggcccaataaaatagaataaccaatgggttttatctattatgaatgctgatcactgaagagaaaataggtttaatacgaagagggtgaggagacacacagggccagctagatatctttcagatgagattttttaaaaatttcaagcagaattggtaagctgcagggtcaaggcttcaaatggactcagggtttgctctcttttttttctttttttttttttcctktttttgagatggagtctcactctgttgcccagactggagtgcagtggcgcaatctcagctcactgcagcctctgcctcctgggttccagcgattctcctgccctggtctcccaagtagctgggattacaggcatgcaccaccgtgcctggctaatttttttttgaaaccgagtcttgctttgtcgcccaggctagagtgcagtggcaggatctcagctcactgcaacctctacttcctgggttcaagttattctcctgtctcagtctctggagtagctgggattacaaattgcaccacca

SEQ ID NO: 71546 - DNA, 601 bp, Human
agtgacaggagacaaggcttggagaggttgacttcaaaaggctaggcagccgataagaggcaaagctggggtttgaagcaggcctttctgcctccaaagtttatcgtctccaccactgcactgtccttgggggacacaggaactacttaacgctaatgggagctgacactctgtagatccacaacaaataacaagaggagataataaaacatatttttaaaagataggaaaatggcccaataaaatagaataaccaatgggttttatctattatgaatgctgatcactgaagagaaaataggtttaatacgaagagggtgaggagacacacagggccagctagatatctttcagatgagattttttaaaaatttcaagcagaattggtaagctgcagggtcaaggcttcaaatggactcagggtttgctctcttttttttctttttttttttttcctgtttttgagatggagtctcactctgttgcccagactggagtgcagtggcgcaatctcagctcactgcagcctctgcctcctgggttccagcgattctcctgccctggtctcccaagtagctgggattacaggcatgcaccaccg

SEQ ID NO: 71547 - DNA, 601 bp, Human
gctcgtagctgtcatcagcgttctcctcggcgggcatcacgtacatctctgagtccgagtgctcatctggattttcatagtcgctgtcctgcaagtgcagatgcagacactgtgctcagcatccccgtctgtgctgcctggccgtcaggaccattcctgccttgggaggccagagcagtgacaggagacaaggcttggagaggttgacttcaaaaggctaggcagccgataagaggcaaagctggggtttgaagcaggcctttctgcctccaaagtttatcgtctccaccactgcactgtmcttgggggacacaggaactacttaacgctaatgggagctgacactctgtagatccacaacaaataacaagaggagataataaaacatatttttaaaagataggaaaatggcccaataaaatagaataaccaatgggttttatctattatgaatgctgatcactgaagagaaaataggtttaatacgaagagggtgaggagacacacagggccagctagatatctttcagatgagattttttaaaaatttcaagcagaattggtaagctgcagggtcaaggcttcaaatggactcagggtt

SEQ ID NO: 71548 - DNA, 601 bp, Human
caggtttgtccccaccccgcaatcttggacacccccacctccccatgggcctggaaggccgagtgcccaggtctgcgggggacctcacctatatactcgcctctggcgaagggcagggctgggtgaaccggcctggtttcctgctctactggaggcggctcgtagctgtcatcagcgttctcctcggcgggcatcacgtacatctctgagtccgagtgctcatctggattttcatagtcgctgtcctgcaagtgcagatgcagacactgtgctcagcatccccgtctgtgctgcctggccrtcaggaccattcctgccttgggaggccagagcagtgacaggagacaaggcttggagaggttgacttcaaaaggctaggcagccgataagaggcaaagctggggtttgaagcaggcctttctgcctccaaagtttatcgtctccaccactgcactgtccttgggggacacaggaactacttaacgctaatgggagctgacactctgtagatccacaacaaataacaagaggagataataaaacatatttttaaaagataggaaaatggcccaataaaatagaataaccaatgggttttatc

SEQ ID NO: 71549 - DNA, 601 bp, Human
agaaccttgagcacacgaagccctaaaagtgggactaatctcagggttgctttcccttggagtgttgggagggagcacaaccatcagggtatgctgggtttgttgtttgtttgtttgtttgtttgtttgtttatgcctgctttcaatgttcccaatctaggaaagacgcctcttcccctggaatgggaaagccctacagcttgggatcctttacctcggagcccagatcccctgcttggaggtggcgggagcgggcggctggcagaggccctcaagcagcagccaggtttgtccccacccygcaatcttggacacccccacctccccatgggcctggaaggccgagtgcccaggtctgcgggggacctcacctatatactcgcctctggcgaagggcagggctgggtgaaccggcctggtttcctgctctactggaggcggctcgtagctgtcatcagcgttctcctcggcgggcatcacgtacatctctgagtccgagtgctcatctggattttcatagtcgctgtcctgcaagtgcagatgcagacactgtgctcagcatccccgtctgtgctgcctggccgtcaggaccattcctgcc

SEQ ID NO: 71550 - DNA, 601 bp, Human
agagtgtgatttttttttttttttttgagacagagtttcactcttgttgcccaggctggagtgcagtggtgcgatcttggctcactgcaacctccgcctcccgggttcaagtgattctactgcctcagcctccctagtagctgggattactggcatgcaccaccatgcccggctaatttttttgtatttttaatagagacggggttctgccatgttggccaggctggtcttgaactcctgacgtcaggtgatccatccactgtggcctcccaaagtgctgggattacaggtgtgagccacygcgcttggccaagagtgtgttcttgagtgagccacttaaccaccctgaattgcagtagccctttcctccccagggttgctgtgatgattgaaaaagatcattcaccaagtatggtgggtggtgcacagagccgagttgtgatgagctgggcttcggaagctgagagccctggcttgtatcccagctccatcacttagaggatcttggcccagtcagttcactcctctgacctctttcaggattatcgaggaggttaagtagacccccaggggaaagcactaaactgtaaattagaagatc

SEQ ID NO: 71551 - DNA, 601 bp, Human
aacaacccaacacttggccacacagaggggatggaagcagcactggagggcacagggtgggggtgaggtgctcctggcttttaaaaatgccaaggcctaggctccaccccagcctggcaacgtttgaactcctcgggaggagcctggcattacaggttggaaaagttccccaggttatgctaaagtgtatccaggtggtgattactcacgtggatcaacttccatgctccttccctcagtgatttcgctccattcacagggaatctgtgggatccctttggtccaggactgtccttctcakcaggtatcagaaaaggagtcaggctctaaggccaactggatctgagttctgtcccttgctctgccactcactagctgtgctctttggggctggttattcaacctctctgggactcacattcttcattgttatttttaattttttaattttttatttttttgagacaaagtcttgctctgttgcccaggctggagtgcagtggcatgatctctggttactgcaacctccgcctcccaggttcaagtgattctcctgcctcagcctctgaagtagctgggattacaggcacccaccaccatg

SEQ ID NO: 71552 - DNA, 601 bp, Human
cttattgacttaaacgacaaaaactggaagaacgtcctcattaaaaacatccttccggggcagtgatggacacccagaggttcaggagaaccaacaacccaacacttggccacacagaggggatggaagcagcactggagggcacagggtgggggtgaggtgctcctggcttttaaaaatgccaaggcctaggctccaccccagcctggcaacgtttgaactcctcgggaggagcctggcattacaggttggaaaagttccccaggttatgctaaagtgtatccaggtggtgattactcaygtggatcaacttccatgctccttccctcagtgatttcgctccattcacagggaatctgtgggatccctttggtccaggactgtccttctcatcaggtatcagaaaaggagtcaggctctaaggccaactggatctgagttctgtcccttgctctgccactcactagctgtgctctttggggctggttattcaacctctctgggactcacattcttcattgttatttttaattttttaattttttatttttttgagacaaagtcttgctctgttgcccaggctggagtgcagtggcatgat

SEQ ID NO: 71553 - DNA, 601 bp, Human
aaaccacgggtgtctatgtagccacaaatgatccacggggcattccttgaaagagtaaagtgaaatgttaggcccaaaatttcaactgcttattgacttaaacgacaaaaactggaagaacgtcctcattaaaaacatccttccggggcagtgatggacacccagaggttcaggagaaccaacaacccaacacttggccacacagaggggatggaagcagcactggagggcacagggtgggggtgaggtgctcctggcttttaaaaatgccaaggcctaggctccaccccagcctggcaaygtttgaactcctcgggaggagcctggcattacaggttggaaaagttccccaggttatgctaaagtgtatccaggtggtgattactcacgtggatcaacttccatgctccttccctcagtgatttcgctccattcacagggaatctgtgggatccctttggtccaggactgtccttctcatcaggtatcagaaaaggagtcaggctctaaggccaactggatctgagttctgtcccttgctctgccactcactagctgtgctctttggggctggttattcaacctctctgggactcacatt

SEQ ID NO: 71554 - DNA, 601 bp, Human
ggtggaggtgagccttgctttctctgaaggccagctgggcttactgggaagtgtcttgctgaagggtggggaatgcctctggcttgatcgattgtcttgaaaggaacaaacaaaaaacataacataaaagaggctctggatcatttcctgggtggaagccattgagatccagaaagtataaaaccacgggtgtctatgtagccacaaatgatccacggggcattccttgaaagagtaaagtgaaatgttaggcccaaaatttcaactgcttattgacttaaacgacaaaaactggaagaaygtcctcattaaaaacatccttccggggcagtgatggacacccagaggttcaggagaaccaacaacccaacacttggccacacagaggggatggaagcagcactggagggcacagggtgggggtgaggtgctcctggcttttaaaaatgccaaggcctaggctccaccccagcctggcaacgtttgaactcctcgggaggagcctggcattacaggttggaaaagttccccaggttatgctaaagtgtatccaggtggtgattactcacgtggatcaacttccatgctccttccctcagtg

SEQ ID NO: 71555 - DNA, 601 bp, Human
tatggatttgctgtcagtaacaacaggacagagaagcaaaggagaataaagagagaggaagaacatcttaggaaggaaagaagagattcacaggaaaccccagggaagaaggaggggataatatgaggggcacagactcagtattgatattttaccatacacctctagtaaactgacatatttacaataagccattttggagaaaaccaagtccctttggtataatagtggagagttagagggggcagtcaatagcaggttgtaaagaaggaggacagccagcgggcaggctgtcctggtygcttgccccacccccctctgtgtcctgggaagcctttggcacagatttactttacctcatcctcaaggaggcctttgggtttgggtgggacttgaggtttctgcaaagcagtcagggccggcagggtggaggtgagccttgctttctctgaaggccagctgggcttactgggaagtgtcttgctgaagggtggggaatgcctctggcttgatcgattgtcttgaaaggaacaaacaaaaaacataacataaaagaggctctggatcatttcctgggtggaagccattgagatccagaaag

SEQ ID NO: 71556 - DNA, 601 bp, Human
tgctgggccatctgaaaaggtgggtctctggacacctgctggggcagggcagctgtggggagggaggaagtgagaagcaagagctgtcaaagggaagtgagggattagctcctccacaggttgtgcggggtaccttacagactagctatctccattgtacatcctggcccatgtcaccctctgcatctgagaagagggaagtggaggagcagagagaaaagaaggtggaggaaagaaagcaaggtggcgacagtgttacagtgggtataatagctagtcaggcatgagcagggcaggagasggctcccctgccccaggaatgtcaggagaccatcaggtgattgtcaggtggctgttaattgtctctctaaaataataattggttacagccagcgccagggaaaagcagtctcccaatagatagaaaaaacctgaaactggtgatgagcagtttccgataagatctcaggagttgggcaagtgggctcaagcatgcgcattaagaggcaaaatggcagcgtttaactggtacttgaccttctagaaacattcagctggtaaggcaagaatgcttcaagggatcgtgcgtacaactccggta

SEQ ID NO: 71557 - DNA, 601 bp, Human
agggaaaacaacacaaagggctaggtgctgagacagggaagattgaggaggtaaacccagagttggatgctgggccatctgaaaaggtgggtctctggacacctgctggggcagggcagctgtggggagggaggaagtgagaagcaagagctgtcaaagggaagtgagggattagctcctccacaggttgtgcggggtaccttacagactagctatctccattgtacatcctggcccatgtcaccctctgcatctgagaagagggaagtggaggagcagagagaaaagaaggtggaggaamgaaagcaaggtggcgacagtgttacagtgggtataatagctagtcaggcatgagcagggcaggagagggctcccctgccccaggaatgtcaggagaccatcaggtgattgtcaggtggctgttaattgtctctctaaaataataattggttacagccagcgccagggaaaagcagtctcccaatagatagaaaaaacctgaaactggtgatgagcagtttccgataagatctcaggagttgggcaagtgggctcaagcatgcgcattaagaggcaaaatggcagcgtttaactggtactt

SEQ ID NO: 71558 - DNA, 601 bp, Human
aacagactcatagaagttgtctagcttgccccaaatcatacacctagaagggccaaagcaggaatttgggcctagatgctgcatctatttttatttaaaagtccatcttttccatctcctgctgggctgcaaattttataaaggcggaatgaaggtcatttcacaacatgtgtgtaagccataagttttatcctctacaggcaagttatttcttagagaagctgcaggctggtctctgtccttatttaaaatgcagggacctctgggagccataacacattaggctttatcagttactacracagcttggatgagtttacctattcattttcaaataggagctatttcatagggaaaacaacacaaagggctaggtgctgagacagggaagattgaggaggtaaacccagagttggatgctgggccatctgaaaaggtgggtctctggacacctgctggggcagggcagctgtggggagggaggaagtgagaagcaagagctgtcaaagggaagtgagggattagctcctccacaggttgtgcggggtaccttacagactagctatctccattgtacatcctggcccatgtcaccctctgc

SEQ ID NO: 71559 - DNA, 601 bp, Human
cttgggtaagtttcttagcccctttacacctttgtttcctcatctgtaaagtggggctgatgatagacttcatagggttagtgtgaggatttaatgagataatgcatacaaagtgctcagaacaccagtggatacacaacattctccaagtgttagcctctctcattatagcacagatgctccttcctcctaaatgtctttgccccacctccagctctctgtttagcctgtatctctgtattttgcctataacctgcagagcagggttaaacacttttatttatgcttgtacttgacttcytcttttcccaactaatggttcagccatatcttaatgttggcttctgtttgtttgtttatttgtttttacacctctttcttatattggctctctatctgcccattccagaacgcccccgccttcatacttctctttttcccactggtgcagacttgcctgagccacctccacaaggctgctattagcaaacctctgccctgactccctggggtccattctcagttatttacagaaatgaagagccttacataacccacagtattcatctgcattctatatctgaatttgtgtcttcatgtg

SEQ ID NO: 71560 - DNA, 601 bp, Human
aaacttgacttcagtgaatcagtgattggtcttttgaagccaggtagattattatactaccatgacctacaggtattagaaatccttcttcaattattacaatgacatgattcaaaattaaaaatagattaaaaatcatcttagatcaactccaatgtttagatgtttcagtattaataagacacttgtcataattgtttacatgtttgcctccccctaggactacagatttgaaaaataggagtagcgtgaatttatcttattttcactttcccatcggctcataccctattacttagcmggagtcattttgattagctattaaatgcccacatgggctgcatcctcattaccactcatataagcatttaaaagctttccatacattattttattgaattcttataaaaataccctctaaatatattccctctgtgaccttgggtaagtttcttagcccctttacacctttgtttcctcatctgtaaagtggggctgatgatagacttcatagggttagtgtgaggatttaatgagataatgcatacaaagtgctcagaacaccagtggatacacaacattctccaagtgttagcctctc

SEQ ID NO: 71561 - DNA, 601 bp, Human
gctggaagcttgcatgggtgaatgctggcagttgtgccaataggaaaacgctacctgtgactaggcatgatcaaaatggtggctctgtcttcccctctctttgccagccacctgtacagtaaggagcagacaagatggcactggccaagtagaaaacccatttgtataataagattagggtggggcgaccagcctcttctgcaccatgtaaatgtcactcctgatcaaaccaatctgtggaccctgtataaatcagatatcacctcctgaagcctgcctctaaaatctgctgtggtccacmtcaggcttggttttcccttcagattccactgtcttgcaagagagagagagatgctctcctctctcctttcttctgtctattaaactttctgctccttaacccacccacacgtgtccatgtcattaatcttgtcagtgcgagacgacgaaccccaggtatttaccccagacaacgatgccacttcaatgatatttctggaatggagacatttgtattcccaaagaagactgataggaaaaaagactcgatccagtctcaacaaattctgtttgtagtgtctgcccaactttctcatcttta

SEQ ID NO: 71562 - DNA, 601 bp, Human
ctgtattcttaattttgtacttgttttgttctgcagtgcttgattacagaaaatgtttttatctgcagtgtttagaatctgagctgtttagagtcatgatgatataggagttaagaaaaaattacttaggcagatagtgagggtaagatgtccttggtaaggttttccttttaataaaaagcagccccaaaatcattttcttttctaacaaagagtagcctgtaaaatcaagctgctgatatagacaagcaagctggaagcttgcatgggtgaatgctggcagttgtgccaataggaaaaygctacctgtgactaggcatgatcaaaatggtggctctgtcttcccctctctttgccagccacctgtacagtaaggagcagacaagatggcactggccaagtagaaaacccatttgtataataagattagggtggggcgaccagcctcttctgcaccatgtaaatgtcactcctgatcaaaccaatctgtggaccctgtataaatcagatatcacctcctgaagcctgcctctaaaatctgctgtggtccacctcaggcttggttttcccttcagattccactgtcttgcaagagagagag

SEQ ID NO: 71563 - DNA, 601 bp, Human
aagttgtcaagtttaaaagtggtagacccagaagggcacagtggctcgtgcctgtaatcccagaactttgggaggctgaggcaggtggatagataagagtccaggagttcaaaaccagcctgggcaacatggtgaaaccctgtctctacaaaaaatatagaaaaattagccaaacatattggtatgcacctgtagtcccagctactccagaggctgaggtgggaaggttgcttgagcccaggaagctgaggctgcagtgagttgtgattgcgcttggcaacagaatgagaccttgtctccaaaaaaaaaaaaaaaaagtggtagatccaggatttgaactcaagcagttcaataatttagcacccatacttttatccaccacattctagtaccttccatcctccccctcctctttctgtcttatctatcctctctttatttaattgctatttcttatctctttcttcacctctgaagctggccgagaggcaccagagagttctactcacacatctcaatctgcagttatatttagagatgatctggctgagggagatgaggctttggaatcatacagacctgggaggaaatctgtgcttgg

SEQ ID NO: 71564 - DNA, 601 bp, Human
gctcaagttgtcaagtttaaaagtggtagacccagaagggcacagtggctcgtgcctgtaatcccagaactttgggaggctgaggcaggtggatagataagagtccaggagttcaaaaccagcctgggcaacatggtgaaaccctgtctctacaaaaaatatagaaaaattagccaaacatattggtatgcacctgtagtcccagctactccagaggctgaggtgggaaggttgcttgagcccaggaagctgaggctgcagtgagttgtgattgcgcttggcaacagaatgagaccttgtytccaaaaaaaaaaaaaaaaagtggtagatccaggatttgaactcaagcagttcaataatttagcacccatacttttatccaccacattctagtaccttccatcctccccctcctctttctgtcttatctatcctctctttatttaattgctatttcttatctctttcttcacctctgaagctggccgagaggcaccagagagttctactcacacatctcaatctgcagttatatttagagatgatctggctgagggagatgaggctttggaatcatacagacctgggaggaaatctgtgc

SEQ ID NO: 71565 - DNA, 601 bp, Human
gaatatgcacggaatcacacaatctgtagtcttttgagacttctttcacttagtataatgttttcaaggttttcctgtggtatagtatgtatcacaactcccgtctttttatggccaaataatagtctattttatgagtatgccacatttgtttatccattcatcagctgatggacatttgagtttttttccactttttggctgtaatgaataatggtgtcatgactattcatgtacaagtttttgtgtagacatgcatttctcttgggaatatcctagaagtgaaattgttgagtcatayggtagctctaagtttaacagtcggagaaactgccaaactgttttccaaagaggctgcaccatttttcattcctgccagcaatgtatgagggctccagttttttcatatcctcaccaacacttgttatcatcctttttattacagccatccttgtgtgtgcaaaatgatatctcattatagttttgatttgcatttccctgaagactaatgatgttgagtatctttttatatacttattgtcaatttttgtatattctttggagacatgtctattcaaatctttgcccatttttaattggg

SEQ ID NO: 71566 - DNA, 601 bp, Human
catgactcttcatgggtcactggcccatgaaacaatattgttccctgataatatctgccagaatggtcatggatcaaggcaggttgaacaagggattctgaataataacaataataataacaaagcactagcattttatgagtgcaagtcatctatattgagtcacttaattctcatggtatctactcatgatacccctaggcataggtgccattttttcagaggaagaaactaagaaacagagatgacttcacttgttcaaagtccggcacctagcaaatgtcagagccaggacctaaayctctggctttggagtcggctaaatccattctactggcttctcaagcacagcggggacggcaggggctgtcactgcaccagatttactatatcaccctcggcaggcaccttattggctatcaaaggaccaagagcaatattgaccagaggaaactgatgtggtgtggtgctttgacagaaacaccaactaggcacctgatggacacttttgtgatgcccactgggggactatctgaagcctttaaaggggaatggatggttattcaaagacacaggctagtagtctgatcatttcttttgt

SEQ ID NO: 71567 - DNA, 601 bp, Human
tgcatatctcagaatagtctgccaaaaccttccttttcctttccttccctataaataacttctgacaatcagaggacagcatgattgtcatggtggaacactgtcacggaggacactggtggaaagcctatggtcttgcctcaggaagacagagttctagggaaggatggagcatgactcttcatgggtcactggcccatgaaacaatattgttccctgataatatctgccagaatggtcatggatcaaggcaggttgaacaagggattctgaataataacaataataataacaaagcactagcattttatgagtgcaagtcatctatattgagtcacttaattctcatggtatctactcatgatacccctaggcataggtgccattttttcagaggaagaaactaagaaacagagatgacttcacttgttcaaagtccggcacctagcaaatgtcagagccaggacctaaacctctggctttggagtcggctaaatccattctactggcttctcaagcacagcggggacggcaggggctgtcactgcaccagatttactatatcaccctcggcaggcaccttattggctatcaaaggacc

SEQ ID NO: 71568 - DNA, 601 bp, Human
ctgaactgggtctgattttttgaaacattttggaaaagagattgcgtttggaatgtttacatttcatgtgacaacatgaaaacaataaactgaaatgtcacctgaatgtgtagtaggagtctccctgtgtttaagtaactggtgtatcaaattgaatacttaagactgacactgttaaagtacccttgactgcaatagaatttgatggaagatctcagggaagtggaacaaaatcttgtatgaaaaataaggaagtagaaagaaggtctaagtctgaatttcatcccaggggttttccctyttctgaaatgttaagggctcctttggccactatattatctttgtcagaccttcctcctggcttttctactatgcttccttttcttgcatatctcagaatagtctgccaaaaccttccttttcctttccttccctataaataacttctgacaatcagaggacagcatgattgtcatggtggaacactgtcacggaggacactggtggaaagcctatggtcttgcctcaggaagacagagttctagggaaggatggagcatgactcttcatgggtcactggcccatgaaacaatattgttcc

SEQ ID NO: 71569 - DNA, 601 bp, Human
ccaacctcccttcctgtacctgaagatagatgccagacaatcgttatgagggaggaagtgaaagagaagcaggatggatcttcactgtgggacagagggcaggccaggaggggagaggccagagctgagccagccccctcagcatcccctagctgcctcagacatgatgctcacctgcttggacaccattgctcagtgagaccaaggggtctcttcatgaggctcttcattaacttaactgaactgaataaatgttttcttaagaacttactacacatacaagtccacaattccgtttttktttttttttttttttttgagacagggtcttgttctgtcacccaggctggagtgcagtggggagatcacagcttactggaggcttcaaactcctggactcaagtgatcctccccactaagtagctcctgagtagctgggactacaggcatgcaccaccacacctggctaattttttgtccagatgagattttgccatgttgcccaggctggccttgaactcctggactcaatccatccacctgccttggtctcccaaagtgctgggattacaggaatgagccacggtgcctggcctataat

SEQ ID NO: 71570 - DNA, 601 bp, Human
gaaagtcagggtgtcttgtggaacactgtaagttagtgaactcaagacttaactaaaacttcacaggaggaaatacttctagatttatttatttatttatttatttattcatttatttatttatttgagatggagtcttgctctgttgcccaggctggagtgcagtgctgtgatctcagctcactgcaacctgcagaggttcaagtgatcctcctgcctcagcctcccaagtagctgggattacaggtgtgtgccaccacgcctggctaatttttgtatttttagtagagacggggtttcrccatgttggccaggctggtcttgaactcctggcttcaagtgagctgcccgccttggcctcccaaagtgctgggatgacaggcctgagccaccatgcctggctcatttgatgttagcagggctccttactcttggtccaagttgcagcctgccatggggagaacttctaatgaagtcaacagggcagtggggtatcaccatcctcactccccagatctcaaaagctgcttcctgcaacaggtacttacccggcccgtggcaacggggatggtgcagctggtggaggtgacttggtttccca

SEQ ID NO: 71571 - DNA, 601 bp, Human
ctgacagatggggaaggggtcaactggggataaagtagggcaccagtccggcagaactggactcttgcaccagttgcactaattacttggcgggtgaccttgggcctctttgtcttgagtgtgaggttagattcctcacctgtcaattgaggaccaggatcagtattttcagtgtttctgtggagccccctcttccccaacagctccctgtgggggttactgtccaggacagagggtagaggtaagagggtggtccagcaggtgaggttgcagctgcacttgcccactccagcttcctccytgtctctagggactattctccactgtcttctgtgcaggctttctttcagagagatccgaaaccaaaacaagtttgaaaaccactgatgtgtggtcctgaaggtacttgcctgcactaacattctagtttgcaaaatgattcaggtgctggagcttctgaaagtcggggtgtcttgtggaacactgtaagtcaatgaactcaagattccaatagagactggagtctaatattggtaaggttgtatgctccttttctgtgtgttaaatttcttaatttaaaaaccctcaccatatctctctc

SEQ ID NO: 71572 - DNA, 601 bp, Human
aaacccagcaacatcagctgagaagaaccaaatttgatcagaagtcttcccgggaacatgtcttagttactgagatgtcatggatctgtgcacttgccagtctgttgatgtggttgtgctatgaggaccaggactccctcccagcagtgttacaggtacatcctaccacctctgcattcatccactggcaatgtacatagagactgaacccacgggccctgaaactttaagtgtgtgagtataggtggaagccagaagatgagaacattttagccaccctctaaacaactcaccctctacwtgccatgtggcctccacacaggtggagacaacaccctggtgggtcttgattagtcataagacgtggtataagcagtgtgttactgataagaggcacactactgagttcataaatgatctctttttgcaaaattaattggatcaaattcaaggttatccctataataatgtaaatctcacttgcatttcagtgttttcctgagcagaagaggaaagggtgggaaatgagcataaacctgaagtgtaagaaatttatgttgaagcccatagtgaactctactgctgaaccattaataaatgt

SEQ ID NO: 71573 - DNA, 601 bp, Human
tccttgtatctcctgtgcctagaacaatgcctggcacacggcatatggtcactaacaactgaatgaatgacttggtttgaaaaacggtaaaaggtataataaacctttttaaataatgaaaaataaatttctgtagccaaatcattttcactttgtgttgtcagaattttttttaaaaactagtaaaagtttcatttatttaagatgaatattattaaaaatttaaaaagccaatttatgtttagtaaaaaaaatgcataaaaattttgcatgtggacaattactgtttatttaaatggayttaagctttattattttggaatatatcccaaattatctatgtaaagcagagtttttttcttcctttttttcccacattgagttgcaggcaaattaaggtttgggcagttacgttctgtgagcctgacttatccgattcatatatttttagggtgatgtttgccttggaaaaattatccagatatttgccgtatcttctttttaaggtaccttttgtagacatattttgtgatctttaaaatgtattttgacttaatttaaatcggtattatttgtttagaaccaaacactatagctggtg

SEQ ID NO: 71574 - DNA, 601 bp, Human
ccttctgtaaatcctgaaagggatcagaaaagtccttcaattaatcttcatatttcttgaactctttctatgcctatcccctaacactgtactaggtgctgccagggacacatccaccaaaaaaaatccttaaggcaatggttccaaaagtgtggtccaaggacccctggaaatctcgaaaatcctttcaggtggttcaagaggtcttttctttttgaattacctatcactatgaaacccaattttcttcatgtagttccaccagaaaaacattgcaacagatgaaatgtagaaacagagrtgagaatccagcagtctctgttatgttgcagtaacatacattaaagagatttacaaaatgtaaactaatgccactcttttccctaaattgtttttgtttggaaaatatagttatttttcataaaaatattatttatgttaacatgtaatgagtttaatattatttttaaatggattaataaatgttttaaatgtctcagttttaattcttaaaatactaggtatcaatagaaacatgtaaaccaaagctctttgggtctacaattattttaagagtgttaaagtggttctgagaccaaaa

SEQ ID NO: 71575 - DNA, 601 bp, Human
ccaaatgtcttcttctcagaagacatgctctttcctgcagtttcctggtaacaatttagtgacatcaagagttcatttcatacctgttctgaaatagtggaattagatgaaaagctgggtaggggcccatccacagttgggtttcccccttctgtaaatcctgaaagggatcagaaaagtccttcaattaatcttcatatttcttgaactctttctatgcctatcccctaacactgtactaggtgctgccagggacacatccaccaaaaaaaatccttaaggcaatggttccaaaagtgtkgtccaaggacccctggaaatctcgaaaatcctttcaggtggttcaagaggtcttttctttttgaattacctatcactatgaaacccaattttcttcatgtagttccaccagaaaaacattgcaacagatgaaatgtagaaacagagatgagaatccagcagtctctgttatgttgcagtaacatacattaaagagatttacaaaatgtaaactaatgccactcttttccctaaattgtttttgtttggaaaatatagttatttttcataaaaatattatttatgttaacatgtaatgagt

SEQ ID NO: 71576 - DNA, 601 bp, Human
gtgagatcaatgcttgccttttttgaaaaaaaggtaataattaattaattatttttagaaacagtctcactttgttgcccaggctggtgtgcagtggtgcaatcacagtccactacagcctggaactcctgagttcaagcgatcctcccacctcagcctcctgagtacctgggactactggcatgcaccaccatgcccagctaaatgctagctttttaatgtgctaaataaggttttatgtttataaaatttagaaatatgtgaagggacacattaagatcaaatctagaggactctcttraactgggaaccatagccaccagttgtctatgaaaaaaaatgtatcaaacaaattccattcataagtactataagaagaaaacagaggttgggaatcaaaactttcattttatatttgcccctggactaaaatcttgggtcagactgacctcattatgaaaattctctcctcaaagaacttttataagaaaaaaaatccctagccgggcatggtggcgggcacctgtagtcccagctactcgggaggctgaggcagaagaatggcgtgaacccaggagacggagtttgcagtgagccaaga

SEQ ID NO: 71577 - DNA, 601 bp, Human
gcttgtcttcttattttctaagaaaatagtccaggaaaatatatactcatagaaaatcctgagtgagatcaatgcttgccttttttgaaaaaaaggtaataattaattaattatttttagaaacagtctcactttgttgcccaggctggtgtgcagtggtgcaatcacagtccactacagcctggaactcctgagttcaagcgatcctcccacctcagcctcctgagtacctgggactactggcatgcaccaccatgcccagctaaatgctagctttttaatgtgctaaataaggttttaygtttataaaatttagaaatatgtgaagggacacattaagatcaaatctagaggactctcttgaactgggaaccatagccaccagttgtctatgaaaaaaaatgtatcaaacaaattccattcataagtactataagaagaaaacagaggttgggaatcaaaactttcattttatatttgcccctggactaaaatcttgggtcagactgacctcattatgaaaattctctcctcaaagaacttttataagaaaaaaaatccctagccgggcatggtggcgggcacctgtagtcccagctac

SEQ ID NO: 71578 - DNA, 601 bp, Human
gaatacacatgactttttcagtttgttttgcaaatgctattctcctgcctgtaatcactcaaccaaatcaattcagttgcttaataattatttatcaagtgtacactgaagccagttactgtgctctgattctggaaatacagagatgaaaagacattgtccttggcttcatgtagtggggaagacagacacttcagcaatcatgacattttccaacaattcaaatattttctagcaggtgctgggtttggaatggtgtacctttttctgaaggaatcttgaaagtaaatatttcttaccktgaattttgtttatgctattttctctgcatagattgttcttcccatttttctccttctccatccctccaacttacattctacccatttaaattcaacccgtaattcaaaaccagaataagtatcactgcatttctagaccattcatgggttactccagctcatatttcagggttcatttataggagcaggctggctaaactgagatatggtaagcactgagtttggtccagattaaagaggcattaaagttaatgtttgattaatatttaagacccatgtgatttttttttcttgctcca

SEQ ID NO: 71579 - DNA, 601 bp, Human
taaatcccattaaacattcattctgcttgtttggcataatatgttgctaaaccaaatgcagttgaaagttaaagttatggactcaagggccagaaaacgaaatagcacaatctctttgaagtggattacaagggaaaaagtgtgtcctgaacctaggaagcataggagaggattgctgtacttatacaaacaaatatctcattccgtccctctagtccctgaatatttgtgagtattgccttgttgtggtgttcggggattgaagtgtgtgcagtagggagttgagctgagttgaaacatytgaagtagggaatgaagttgaagaatatttgtgatttaatttaaaaaagaattgggcataacatagttacagcttcccctcactctcctttttttctgtttttattaattcagtgtatttgagacagatacattcagtgtatttgtggacagaaaaacaacgtattggccactaagataaagcagacagttgtcaaaactgtaaaattactcaatgttgtatcacacagtgccaaaatagctgcataaacagttaaatagttaatgaattggttactttttctagccatgtacacacaaa

SEQ ID NO: 71580 - DNA, 601 bp, Human
aagtactagaggaagaaaacatagatgaattatactttggcatttgtgttaaatttgagctccactcctcccatcttctctcattctcaagttagtaaaagttattacaccccagctgacattctgcacaaaaaaatctagtttaacaaaggctgtaaccttcaaggtggcagaccttggactttgctgtattaagtacgaagaaaaacacactgacagcctcaattagcatagctacttagagagattacttcactgagttatgataaaatattatagtatattgctttttatttaccgktaaatgtaaaactatcatacaacgcatttttctacattctttacaaaacatagatcatctcttactttgcacaagtctcagatacaagaattgatgtaataaattaaccttagaaatttagtacaaggaaatagtcatctcctaaacaaaattatgttttgttttcttttttaaacaaataaagaaagctttataaaccttcatatttccatttttacttggttcctggtaagcttagagttaacttagtgcctaattaataatgaaatttcatgctaggctctctccatacatacttat

SEQ ID NO: 71581 - DNA, 601 bp, Human
attaaagatcattaggatcattaactttaatgtatttatgttttctttccagttcatcaaagtaaaatttcagacatgaatatctcacaagtactttgtaatatggtcattatattttttaatctgttaattaaaaagcatgtggtaaataaaaatttatactataaatacaccattttaaactttcactgaaattatagtaaacaaatatataagggcccagatgataccaatatgctaatatgcatgtatgtacacatgggcagtaatatatctagaagttaacttgaccatggaggcstgggaatacatgtgtagaagtatattctcttgtatttgaagatgttgaactgggagcctggaaggatggttgtgtatgccaggcctctgaaacttttgccatccacccaaatcactgtatagcagaggcgtgggtgtcacactggcatctttttgtcaagttcaacccagtggtgctgtgtacagcagtccctttgtcaagacagaaggctgatactatctcattgttaagggtcgcttgccttttaatgttgactgatgttgtttccttggcaaaacttcactcacagttgaagcctca

SEQ ID NO: 71582 - DNA, 601 bp, Human
aaaaaaagtaaaataaaaaatattcattgtctgtgttaggcactgggctacacaatagggaaggcagtatatagatatgactgagcttaccatctggggaagcaaacatatttaataacacaaattattaattgtaattatgataaattgccaccaaatgaaagttttggggccaggcaagtcttccctgaaaaaatgatactaaaataatatctgaagaatgattggaagttagctgggaaagacataggtaaagggtagtccaggcagggccgagcacggtggctcatgcctgtaatcscagcagtttgggaggccgaggtgggcagattgcctgagctcaggagcttgagaccaccctgggcaacatggtgaaacccaatctctactaaaatacaaaaaattagcttggtatggtggcgcgtacttgtaatcctagctactcaggaagctgaggtgcgagaatcacttgggccccagaggcggaggttgcagtgagccaagatctgccactgcactctagcttgggctacagagtgagacgccaactcaaaaaaaaaaaaaaaaaaaaattccaggcagaaggaaagcaggtgcaaga

SEQ ID NO: 71583 - DNA, 601 bp, Human
aaaaaagtaaaataaaaaatattcattgtctgtgttaggcactgggctacacaatagggaaggcagtatatagatatgactgagcttaccatctggggaagcaaacatatttaataacacaaattattaattgtaattatgataaattgccaccaaatgaaagttttggggccaggcaagtcttccctgaaaaaatgatactaaaataatatctgaagaatgattggaagttagctgggaaagacataggtaaagggtagtccaggcagggccgagcacggtggctcatgcctgtaatccmagcagtttgggaggccgaggtgggcagattgcctgagctcaggagcttgagaccaccctgggcaacatggtgaaacccaatctctactaaaatacaaaaaattagcttggtatggtggcgcgtacttgtaatcctagctactcaggaagctgaggtgcgagaatcacttgggccccagaggcggaggttgcagtgagccaagatctgccactgcactctagcttgggctacagagtgagacgccaactcaaaaaaaaaaaaaaaaaaaaattccaggcagaaggaaagcaggtgcaagag

SEQ ID NO: 71584 - DNA, 601 bp, Human
tctgatttcaatgaattagaggaggatgagatataggaggataccaggaagaggctacaagaaaaatgtggaaggagggggagcctttgggttcaatttttgaagaattgttttgagtgttggaaagccaatgggaaatgtcaagaaagcagttggataatcagatttggacctttcttttctaagcagatatctactgctgtgctcaataaaaatataaaacaagccaaattttaaattttcaaagagctacattttagaaagtagaagaaaagaggtgaaattaattttaataatatawtttatgtggcccaatgcatccaaaatattacctcaacatttcatcaaaataaataattgttggctgggcgcggtggctcacacttgtaatcccagcactttgggaggctgaggtgggtggatcacgaggtcaggagttcaagaccagcctggccaacatagtgaaatcccgtctctactaaaaatacaaaaaaaattagccgggcgtggtggtaggcacctatagtcccaactacttgggaggctgaggcaggagaatcccttgaacctgggaggtgaaggttgcagtgagccaagatca

SEQ ID NO: 71585 - DNA, 601 bp, Human
gcatttccattttttcttcccgtgaatactgtgaagaatagaaggttatccccatttttttttttttttttttttgagacggagttttgctcttgttgcccaggctggagcgcagtggcatgatctcggctcaccgcaatctctgcctcccaggttcaagcaattctcctgcctcagcctgctgagtagctaggattataggcacacgccaccacacccggctaatttttgtatttttactagagacggggtttctccatgttggtcaggctggtcttgaactcccgacctcagttgatcygcccgcctcggcctcccaaagtgctgggattacaggcatgagccatcgcacctggccatgcccattttatagataacaaaatcaaagccttagatgttctctcacccaaggcagagggggagctaaaactagaatccagttttctgatccaaagactaatgttctttccatttgtcttagtgagtttttccaaacagcacatcctattaacagaaattgcatgcaggatgtttattttgggaagtgattccaaggaaacaaggaagaagggaaagagagagttaggagcaaattaccaca

SEQ ID NO: 71586 - DNA, 601 bp, Human
aagggaaagagagagttaggagcaaattaccacattgggccactgaggcttgatcctcccagggaccctctcaagagctgtggagagtgaactttagaattgtctgccctggggatttatcccctggttctcattatctgttggtcaagggttgctcccatctggtgttaagtccctgtcacttccaggtttgcacgtgtgtcagaggggtcatgtgggtaccacaggtgacaacttaggcagcaggagagaagctgctgggcagaaatagagagataaggagatactgctggggctggartaaaaagttggccaagatgtaaaatggtcacaagaggtatctgaagtatcattgcacctcctgatttttgtggaggtgagggttcttcgtacaaataatttcaatataatagagatatattcatgcagagacagtgctatggaagcccagagaaagaagctgctaattgtgcctgtttacatggaggcttcacagagaaggtagccttggagctgagtcttaagtgctatggcttgaatgtttgatccctccaaaactcatgttgaaacttaatccccagtataatagtattaagaggca

SEQ ID NO: 71587 - DNA, 601 bp, Human
aagtttgctgactctgaatagagaaagcaccttgaacagataaaaccgttccctccttgtatgtgaagaacccaggaccaacctggtagccaggcagtgtcagtgagggaagcagacctctgcctcagagttctctagagatcctagttccccactcttaccctcagagccttctcagtttgaacctccagagtgcagggcctcagaagctacatgtgttagcaggcatcctggggtgttctcatgccactgaagtctgtgaaccactgcctgtgagacacaatgagaacttaaaaaaaawtagccttaatgaactgaagagtcattagctgtacccaagactccccctgggaaagtacctttgttctggtggacctaggtggggcggtagctttgacgtctgcttggttccccacttccttgtctactcgtaactgaacactggcagttagtggttgtcagatattcttttagcacaaacattccacattttggcacacactgagtctctgtcacacaagcaccagactgacccaatgccaaacaactagccttcattaaacgctgcctcttctgtgaatgcaggctcagggaccagacc

SEQ ID NO: 71588 - DNA, 601 bp, Human
ttctctagagatcctagttccccactcttaccctcagagccttctcagtttgaacctccagagtgcagggcctcagaagctacatgtgttagcaggcatcctggggtgttctcatgccactgaagtctgtgaaccactgcctgtgagacacaatgagaacttaaaaaaaaatagccttaatgaactgaagagtcattagctgtacccaagactccccctgggaaagtacctttgttctggtggacctaggtggggcggtagctttgacgtctgcttggttccccacttccttgtctactcrtaactgaacactggcagttagtggttgtcagatattcttttagcacaaacattccacattttggcacacactgagtctctgtcacacaagcaccagactgacccaatgccaaacaactagccttcattaaacgctgcctcttctgtgaatgcaggctcagggaccagaccactttgattttaatcccagatatgctactttctagccgagactttgggcaagaaattctctctatgcctccccttatatgtaaaatcaagatagtaacagtacctacttagaatatggttgtgagaatta

SEQ ID NO: 71589 - DNA, 601 bp, Human
tcctagttccccactcttaccctcagagccttctcagtttgaacctccagagtgcagggcctcagaagctacatgtgttagcaggcatcctggggtgttctcatgccactgaagtctgtgaaccactgcctgtgagacacaatgagaacttaaaaaaaaatagccttaatgaactgaagagtcattagctgtacccaagactccccctgggaaagtacctttgttctggtggacctaggtggggcggtagctttgacgtctgcttggttccccacttccttgtctactcgtaactgaacastggcagttagtggttgtcagatattcttttagcacaaacattccacattttggcacacactgagtctctgtcacacaagcaccagactgacccaatgccaaacaactagccttcattaaacgctgcctcttctgtgaatgcaggctcagggaccagaccactttgattttaatcccagatatgctactttctagccgagactttgggcaagaaattctctctatgcctccccttatatgtaaaatcaagatagtaacagtacctacttagaatatggttgtgagaattaaatggaataat

SEQ ID NO: 71590 - DNA, 601 bp, Human
aattaaaaaataagacaataacagaactgtggtttgtattaaagatctagtaactctaattaaagaaaaaggaaaggaagaaaatggtctctaaatgtttataggccctactagcatctctgtagctaatctggtttgtttatagagtactagagtcttactcaaaattataagctttgtttataaacccaagctcactgagacagactgatgaggctgctgaagttaccattaaagctacaggaacttttaagaaagtttttgaagacacactgtgtctgaagggaccatgaaaagttartgatcatacttgcctgtgttaccagatgtcttagtctgttttgtgtggctgtaacagaatgtgacaaacttggtaatttataatataaagaacagaaattacttttctcacagttctggaggccaagaagcccaagatcaaggtgctggcaggcttggtgtctggtaagggcctggtctctgcttccaagatgatgccttgaactctgcatcctctggagggaggaatgctgttcctcacaatggcaaaagagtaggagatagcaaactcactccccaaaccccatttaattgtggcatt

SEQ ID NO: 71591 - DNA, 601 bp, Human
tcatgggtatattgcatgatgctgaggtttgggcttctaatgatcctgtcacccaagtagtgaacatagaacctgacaggtagtttttcaacctttgacctcctccccacctcccctcttttggaatccctagtgtttattgttcccgtctttgtgttcatgtgtacccaacgtttagcttccacttataagaatatgcagtatttggttttctgttcctgtgttaattcgcttagggtagtggcctccagctgcattcatgttgctgcaaaggacatgatttcattcttttttatggctkcatagtattccatggtgcatatgtaccacattttctttatacaattcatcattgatggacacctgggttgattctatgtctttgctattatgaatagtgctgtgataaatatacaagtgcaggtgtctttttggtggaataatttgttttcctttgggtatatacctagtaatgggattgctgggtcaaatggcaattctatttttagttctttgagaaatctctaaccttcttttcacagggctgaataaatttgcattcccaccaacagtgtgtaagcattctcttgtatgcacaatc

SEQ ID NO: 71592 - DNA, 601 bp, Human
ggaagatttaaaagcacatgtgccatcatgctcttctcccaagttcatatcagatgtcattaatcaatcatggaattttttaatcctgagtaagcccagagatataaccaaagatgactatcagttgatcaaaatgggcattgagcagtttactcctggatagatacccccaaagaaatgagagcttatttcaacaaaatgaaatgcatatgaatgtttctggcagctatatttccagtagccccaaactggaaataacccgaatgtccatcaacagttgaatggataaaaatatagtatmtccatataatgaaatactttgcagtgatggaaaaagatgaactactgatacacacagtttgagttcatcttacatagtgtaaagtgaaagaagttagacataaaggaggcatactatgtgagttcatacattgcagttcaaaaacaggcagaactcatacatggtggtagaagttaagacagtggtaactgactgagaggggcactgggaagccttatgagggctagaatgtgttctgtatcttgatctgggtggtggttatatggatgtgcacatatgcaaaaatttattgaggtgtat

SEQ ID NO: 71593 - DNA, 601 bp, Human
gtgtaggcaggaaagaccaaattataggctcttagggctgggaaaaggaacttacagatcgtttaaattttgtttcacagagaaggaaacaaaaacctggaggattagtgccttgaaagtagcaacagaatagagacaagaatctaggtctcctaattacactctaggtttcctgctactctgagctgctgcattatatatcaataatttttttcttttaaggtcataatatgttagagtggttgacattcagctttcaatccctttacccagtaccctaccatgcaccattataccacartctctctgacttttatctctcttagccttttgagctgggaacccactgtttatttttagtcagactgatagcctagatcctagaagataattgattttcagtttgacagcctgtggaatccactaattttcacaggtcgtcaagaaagtagtagagaggagatatttccaagagagcaagtcattctacccagtagccccatcaatactgacactttggccccatctgagacagtacttctggcctttcttaaagcccaaatccctcattttattggcttttatttgacacactgccttc

SEQ ID NO: 71594 - DNA, 601 bp, Human
ctagaagataattgattttcagtttgacagcctgtggaatccactaattttcacaggtcgtcaagaaagtagtagagaggagatatttccaagagagcaagtcattctacccagtagccccatcaatactgacactttggccccatctgagacagtacttctggcctttcttaaagcccaaatccctcattttattggcttttatttgacacactgccttccatttttaaaagttattttaatggccaagcacggtggctcatgcctgtaatcccagcactttgggaggctgaggtgggcrgatcacaaggtcaggagatggagaccatcctggctaacacggtgaaaccctgtatctactaaaaatacaaaaaaattagctaggcatggtggtgcgtgcctgtagtcccagctactagggtggctgaggcaggagaatcacttgaacccgggaggcggaggttgcagttagccgagatcgcgccactacactccagcctgggcgacagagcaagactccgtctcaaaaaaaaaaatctagcagatgtccttcttctgagacttatcccatgagcgtttggcctaacaatgaaggattctt

SEQ ID NO: 71595 - DNA, 601 bp, Human
acttctggcctttcttaaagcccaaatccctcattttattggcttttatttgacacactgccttccatttttaaaagttattttaatggccaagcacggtggctcatgcctgtaatcccagcactttgggaggctgaggtgggcggatcacaaggtcaggagatggagaccatcctggctaacacggtgaaaccctgtatctactaaaaatacaaaaaaattagctaggcatggtggtgcgtgcctgtagtcccagctactagggtggctgaggcaggagaatcacttgaacccgggaggyggaggttgcagttagccgagatcgcgccactacactccagcctgggcgacagagcaagactccgtctcaaaaaaaaaaatctagcagatgtccttcttctgagacttatcccatgagcgtttggcctaacaatgaaggattcttccctctcaaaagagagagttctctagttaatcaaatatttaacaccaaattttctgaatcaaaacaattagctggtaacttagagctgattttctcatggttattaggctgtttgaaaacctgtgaatgatctggataacttatttgaataattat

SEQ ID NO: 71596 - DNA, 601 bp, Human
cactgatagtgtagatatttatcttaatgtgagatgaaagtgttgttataacttcaaaaagcttaaggaatcttggctctaatcctccatagcaacagtcggttttgctctaaaactggaaaaacagttttgctagggaggcaggatatcggagtggaaaagtcactgaagagacatagattctgttcctctttcttgtaacaggaagcaactccacctcagaaactttaaggtgctggccaggatcagataactagttagtggcagcttccatctttttagtaaaagccaatttgtctgmcgcttaatttttattccaagtgttatctttaggtcttttaggaactagtgtcattaattacagtgttctggaggaaatatcaaaaagcagctaacagagtagctatctataatatccccattaaagtctgagaatgttatgcaattgaatatgaaattgcgccatccagtggcagaattattgaacactgaacagacccaacttaaagtctggaaattaaatcctctcaaggctaggtccagtgaattaccctctaagtacaataacctaatgtatagtacatcaggaaattgttttctt

SEQ ID NO: 71597 - DNA, 601 bp, Human
tttcttgtaacaggaagcaactccacctcagaaactttaaggtgctggccaggatcagataactagttagtggcagcttccatctttttagtaaaagccaatttgtctgacgcttaatttttattccaagtgttatctttaggtcttttaggaactagtgtcattaattacagtgttctggaggaaatatcaaaaagcagctaacagagtagctatctataatatccccattaaagtctgagaatgttatgcaattgaatatgaaattgcgccatccagtggcagaattattgaacactgracagacccaacttaaagtctggaaattaaatcctctcaaggctaggtccagtgaattaccctctaagtacaataacctaatgtatagtacatcaggaaattgttttcttgtatttttttcaaaacaccatattttgatctactattgtcaaggtatgttttataatttttttttaaaagattgttatcttctacatcttttcctaggtcctggaatctcaaaatttgttcagaaagtaaatgaaataggcatttacctgactgattgcatggaaagagctagggaagtgattccaaggtc

SEQ ID NO: 71598 - DNA, 601 bp, Human
ctgaactgaatcatgaaaaatgagttggaggatcggggaacagctttatcagcagaacagacagcatgcattcagtaactgatgtttattcagcacctattatatgtcaggcactgttctaagtactgaggatacaacagtgaacaggacaaagtctctgacttcatggagcttgtgttctaccggatgtgcaaaggtagggaagtgtgagaggcatattcagaggactgtaagtagttctgcatagatagaagataggtaagtagtgtaaaataataatgataataatagtagcagctcrtatttattgagcccttcctatgttcttagcactacgctaagcacttaattgcactgtcataacaactctatgaaattaacaattattaacaagataaggaagctgtggcttacaaatgttaagtaactcacccaaggtcacacacctgggaagtggtggagccaggattctgagtgggattctgaaaaggaagggtccaggtcacaaagtgccctatggggccatgctaggaagtttggagtttatcttagagatagtaggaagccattaaaggatgctacacaactggtgacactggta

SEQ ID NO: 71599 - DNA, 601 bp, Human
atttagatgagagatgacaggggcctaatgccagctggaaggtagcatcctctcgctcagagactcccagtgttgggtagcctagatcttggaagcaattgcatcccatcttcattaagacaaccctggaagattccttctttaggtctcaaggtctcaaacagacccaagaactgagctgtaatatgaggaagatttttcccagtctggcagcagaggagattggatatctattccaggtcatttgccacctggtttctactagaaccctaattaaaaacctggagcagagtctggccaygtaaccagctaggagccacccacagtggttaatatagcacacatcagcttcaggtatggtcatcaaaccatacccagctatcaccaccacagtaattttaagagcctttgataactttttgagccagggaacttcagaacaaaagtggtattttaaggaaaaccaacctatgaaaggattggaaggatgtggatttggagagagatgaacaaaatattaattctgcctcatccaaaaaaggggtttcttggacagctatgtgcgaagatccccatctcttcatttattccagggcattat

SEQ ID NO: 71600 - DNA, 601 bp, Human
ctcttcatttattccagggcattatggttcacttcttagtagcactgtgtggatgctgtagctgaaatgggtaatgtaatataattattaaaacaaaaatgataacctcagctcttcctttgtacaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcaggtgaatatctcacrgcatccatggaggtggctctctggaggccaatgccattgctatctcaggcagtacttgggtcgctagccagaatgaatgaatgaatgatagatggatggatggatggatgactggatgaatgaatttactctcacatttgtaagggtcaccagaggtataattctcttacaagaccttctactattgggagaataaggacatgtctttaccttagggaggcataaaggaaattaaaaatttatcattaaaaattagaatagctaacatttgccttctgctatgtgtctcccgctgtgctc

SEQ ID NO: 71601 - DNA, 601 bp, Human
ttctagcactggtaactgtactgtctttcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggcaagtataactcaatccagacctgccccyttcacatctgcacctccagcccccacatcctgttgttttctgtttcaaattcagtagtttgtctgaacttggttattgtactttccaaacctttttaggcaggatattgaactacatctggttgacccctataaattgtttcagtcagacatcccctcccatgtttgtttactgcgttatctccacagacacaactgagatcttctctcaggaaataatttctccccctcgtggggttgataatgaaaattatgtggtagaatattgtttgttggagggggaattgcaatttataagctc

SEQ ID NO: 71602 - DNA, 601 bp, Human
cagcagtgtgggaaaactgactagggggttgtgcccaggggaccttgtgggacagacctcctacagccatagaacagccactctgatttggcatctcctttggccaagtgacagagcagacttcccagggctggggatgctaaatctgcctcttccttgtctctgcctgtccccagggatatctcccttcaggatgtcacgatgcttactgtgggttaagacaaagacaggtttcctgctagggaacccaggatgatggggaagctgattgtccaccttgatctcactttttccagtgtasaaattgtgagtttgggggaaattttccacaagcttggtgtcaggcagaatcgggggagaggtgacatggatgtggaagtttgattatcttcccgtctgcttggagttttttcacttctttgtggccccaggaactgtctcatcttcatatttgatttctgggatattgctggtgataatctcagtgctgtacatttgtttctggttgtctgtggttggggggcatgaagccagcttgcttccatgccgccattttggaatcagacatccaagcatcatattttctttcacatgcaaagcc

SEQ ID NO: 71603 - DNA, 601 bp, Human
gagtttgggggaaattttccacaagcttggtgtcaggcagaatcgggggagaggtgacatggatgtggaagtttgattatcttcccgtctgcttggagttttttcacttctttgtggccccaggaactgtctcatcttcatatttgatttctgggatattgctggtgataatctcagtgctgtacatttgtttctggttgtctgtggttggggggcatgaagccagcttgcttccatgccgccattttggaatcagacatccaagcatcatattttctttcacatgcaaagccaaagcagraaagatgtttaaggttttccttgcacacatctcttgcacacacattttgcagaagtgccaactgacatcttttcagatcctgctggccagaacttggtgaaatatatactctaaaccaatctgtgataaagagaaatggattaatatagttagtttagactaattattgtttatcacctgaggagtcgtttttgaggatattgctttcctctacttgggtaaaatcaggacttcataagcgaggaagaagggggctagctatggggtatgtgcctgttagagtttgccataggtggcttc

SEQ ID NO: 71604 - DNA, 601 bp, Human
cctttaatatccaacatgatttccccctaaaaactggcacctttttgggtaggaaagaggaaaagcactggagttggggtttgaattgcctcatctagcaagctctgctcaattattttttcccctttaaattatgctctattaaaagagtaaaaaggcagttatagggtggtatgaagtataataaacattttatatgtatcatagaatgagaaagatgctagaagcctatatactatattgaatagcagttgtcactaagtagtagaatttagaggtcattttaatagaatttttttttgttttactgatttgaacttttaactttttttatagttcttatgtttgatgatgataatgatttttaaaaaatttcagttgtgtctaaaatagtacctagcccatagtagacctgtaataaatatttgttgaataaagatggattttttaaaggaaagcagtacatattcattatagaaaataggcaaaaaataagcacaaggggaaaaaaccaatttcgctactcagagataactcaatagtgttgtatagaattttccagttgtttatatttattaaacattcatatgtagtacatagt

SEQ ID NO: 71605 - DNA, 601 bp, Human
tgacacagacacaattgtggtaaaatcctctccatttcccaggtccaagatatctcctacttattcataaacttgaagcacaatttttttcttatcagaggcactgagccattcaacatccagtgccacaagatgaaaatccagggatgagaggtatggaatccactccgattataaaagacatagctcaaaacagcagctgtacttaagttgacagttgcaaaagtgaatggtgttttcattcttaagaaatactattaattaaaaatagatgcttatccctgactgcactgacaagggrgaagaaaggctgagcaagagcctggaagcttgccattctctccaggtattttgtctagaacatgaaagaaatgtggtcagggccttcatcaagagttgctcaaatatgtctcagcattttacaaaatgcttagcggtggttttttgcatctggcggtgatctgtggaggaagataagcatgttagagtggaggcaatttgagaccaggcctacatgtggctgctgaggaagcagatttaggctgctctttgaaaaaaaattacttctggtttagattaaaagttctcatcctggctaaca

SEQ ID NO: 71606 - DNA, 601 bp, Human
gctagcagtcctcagcaaaatgctgcctaaactgtgtccacagctgtgtttctcaaactttactgtgcacgtgaatcacctgggaatcatattgggatgcagattctgaattggtagttttaaggtgaggactaaccagctcccaagtgatgctgatgctgccagtccagggactaaagtgagtggtaaggctttttatggctgtgggccaaaggctctggtcaagagcatatagaaaactcagattaaacaaagtctagggcatgaacagaggtactgaaatttagtgtttcagaacctrctagaccacaggaactacttttttcctggaggacctgttattatctcatagaagcctgtgcaggaaaagcttccttaagagaccctaaactataaaaccctgctcccactgaaggagtgcagcaccacccccaaaaccctctggaagaggccaaccttcaggtgcactggagctggggctttcccctctcttcatcagggctagtagagaaaaagagggccacagagaggtgcctatcatacgagtatgatctccccctcacttcacttctagataaaaacatcttacgctggagtaaag

SEQ ID NO: 71607 - DNA, 601 bp, Human
tagtagagaaaaagagggccacagagaggtgcctatcatacgagtatgatctccccctcacttcacttctagataaaaacatcttacgctggagtaaaggagaagtacctgagtgaatactgcttttctggtacctacattctctccctccttctgcaaggctatcatttcacagctgattcctgggagcacatccatttcattggcaaggtaatttgggggcctgttgggctggggggaggttggggttcggtggtagtgactgaagcagtttggggcttgaaaaaggggggagtcagcmtggtgtagctttggcttgatgtcctgttctgccattctgcttcaaaccctggcattctgtgtcaagccctcctgggtctgttggcccactgtgagcatcctcgctaaggacagctacttgcattttcagttgcaccttcccacataacagtgactaattccttacaaaacaaaacacaaaacgagatatattaaagtaacagcatttcagcagctacagtgactctgtgtgctgacttcagcagccctctgaaaggccccttccataagctgggaaagtatgatcatggtttcatcatcc

SEQ ID NO: 71608 - DNA, 601 bp, Human
gccgactccccattgaggatcacgcagccagcaacctggccagggggtcagcaaagagcaaaaaatgagggggaaagaacaaaaggaaagcaaatgccaaagctgaggagaaaggaaaagagaaatccaaacacgggaaaggaaattaaagaaagaaagttgacatgatgttacagaagaaaagggagaagggagaaaaaaatagagaaaagagggaattattttaataaaatttgaatttatgccatgtctttagcttgaaaaactattctgagattttttttgcaggcttttttttttwaaagctaaaattctaaatagaaaactcctccctatctgcagattaataattaaggataatttgtaacttttcacaaggaaactttagacctggcttggacctgtgtttaggacaagagagccgaggagggagagctgtgtttttcgctaatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcg

SEQ ID NO: 71609 - DNA, 601 bp, Human
ttattttaataaaatttgaatttatgccatgtctttagcttgaaaaactattctgagattttttttgcaggctttttttttttaaagctaaaattctaaatagaaaactcctccctatctgcagattaataattaaggataatttgtaacttttcacaaggaaactttagacctggcttggacctgtgtttaggacaagagagccgaggagggagagctgtgtttttcgctaatcatatatttagcgttgcgggggttggggggggcgtttaaaaatacttctgggataaaatatattttyctaagtaatttccaagcgcaggaaagccgcgccgagggcatcaggcctccgcgggtctcggcgagcgggccggaaagcctcggtccttttcgggaggagtggaaccgggtccacacgccgttttcgcccagccagcctgcctcgcggcccgctgccacagctctcgttctccttttttgcggattccgccgggggtccgccgagtcctggctgcccgcgggcagccactttgaaacccaaaggtttctgcacggccaagcagaggtcggagggagagagccgcagcgcgggcccgcgggc

SEQ ID NO: 71610 - DNA, 601 bp, Human
tttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcggtccttttcgggaggagtggaaccgggtccacacgccgttttcgcccagccagcctgcctcgcggcccgctgccacagctctcgttctccttttttgcggattccgccgggggtccgccgagtcctggctgcccgcgggcagccactttgaaacccaraggtttctgcacggccaagcagaggtcggagggagagagccgcagcgcgggcccgcgggccggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccggtaacgcgagttc

SEQ ID NO: 71611 - DNA, 601 bp, Human
tggggggggagtgaaaatgggtccccgagaggagaagcagcagcatttgggaggcagaaggagggtcctggttcccacagatgctctgtgcccagtaggaaagggctcgaggtggtgcctcaaccctggcctcccagagaccttgcagcgctgttcgttttgctcttcccaagtgaaaggctgggctttcactcccacgggtgcctatttgggctggtgcgaacccagcccctggtgtggccgtctccctggagggatggtaccccttgtcctcctactccgcggcgctcctcctagccargcaccctcaggaagtcagctcagccacactgggccttttccctccactccgctgcctcggccgggcaggagagtggctcagcagctctggaacctgcagcccccctgccccgccacagtccgcttctggctgaccccgccggctttcccggcgcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcct

SEQ ID NO: 71612 - DNA, 601 bp, Human
agagggctaagcagttcatacctttgttattttttgcattcttcataagctcattatcagggcaactaataattcacatggtgccttattctgaaattggcatcacatataaaggattttttaaatattttgcaaatgatatggaattatcccaaatcatcctgaaaacagcaggtaaaattagctggtagaatgtaccttggctaaagaagattccctctgccacactcgtgctgtaatgtactgcgaggcgaccccagaaattatcccagtgtgtgccatctgtattaaaatggttatycagttatgaacagggtaacataatactgatcagctaattatacaccctccgaaaaccctccagctccctcggcctggctcagccaggtattgaaagcatagcgatttgacattcagataccttccaaaggagctggagaaagacgctgggtggtttgggagaggaataagccctttgctttaaaagccaggagaggaggctggggcagctttgggctgaggcaagagtggcacttcgggaggggaaggggacaaagcattgttttatgagccatgtagagactcagtctcttcgctgatt

SEQ ID NO: 71613 - DNA, 601 bp, Human
tggttatccagttatgaacagggtaacataatactgatcagctaattatacaccctccgaaaaccctccagctccctcggcctggctcagccaggtattgaaagcatagcgatttgacattcagataccttccaaaggagctggagaaagacgctgggtggtttgggagaggaataagccctttgctttaaaagccaggagaggaggctggggcagctttgggctgaggcaagagtggcacttcgggaggggaaggggacaaagcattgttttatgagccatgtagagactcagtctcttsgctgattgctggtcctgggcatgagttggaactgagatctcaagagaagaacagccaagggccaagagtggccctgctgtgtgcagtgttgctgggactgggtagtggtcttctgcagaacatttaagagaaatgcttgttgtcagtaacagaattttcaagcctttggagaaacccaagtcatgtaggatttaggtaatttgtttctcttgaatggggtagaggagtggcgcaacaagtcaggtgtggtggccccgtccaacaccccctgcccctcccctcaacaacatgcactcctca

SEQ ID NO: 71614 - DNA, 601 bp, Human
cagaattaggacaaagtagacaagtgagccacaagtgagatgagggtggggaaagagtagcctcagcttgacagctgtgacagctgcagaacctgcccagcacagagccctatcacctgaggggcacacaggcttcctttgggtgtggagaaatagccatctgtgggcagatgttgctggagatggagagggagtaggaggagaggaacaggtaagccaccaacaacacgggcagcctaccctgggtccgtagttaggcttcatggctggctttgtctacaaggagcaggaaaactattcycaattttgcttttgtccagaatcctctcatggttcatattttggaaagaattctgggggcttccctgtgtgctgctgagttggggctggagaaatccacctggggaaccacgctctcatcttcatccctgtaggtgctttttgctctgaagagggaaggtttatctgagatgtattgtttcacccaaaagcctgataaaaacaggatgtttctgctagtgctggttatatcagaaactttgccttttatcagttctgggaattctcactcactgtaggaagagcccggagattttcctgt

SEQ ID NO: 71615 - DNA, 601 bp, Human
ttcatatgcatgttggtattagatggggagtattgtgcaaaatagacccagggaatgacaggcaatgttggaagttgaggtggtagggaacatgtgttttggacagcatttgggaaatgggcttgttctggtgcacatgggagagtgtgactatgcatgatggcatgtgcttgcggactagaatgttacagcttctacagaaagaggaacaatagtagtaactggtgtggaagattaatcacactccataccccctaaaacccctctgaaaagggggttcctatgagcccacatgggatargggtcctgcttcccagtcttcttagcaggactgatgaaagagccccattgtccgctcccagcttcttaggtgtccaacaatagctactctgcaggttgcctcttaatactcaagtctatcttcaccccctccttgtgtctacctggaattggagtttttatattaagaagagaacaatggtgtaaaagtgacaagcatccagtagaaatcatacttcaagtacccaaacaaccattctgtttctcactttcaatacagtattcaataaattgcatgagatatccaacactttggtataaa

SEQ ID NO: 71616 - DNA, 490 bp, Human
tcctcctcctcctcgttcctcaggttagctggtttgggttagggggccaatctcagaagactctaattaaagagtgaggagaatctgataagataaggaaggccatccttcctctagggaccaatggaggtttcatgttcctcactccccgctgcttctctgaggagctgacactagggcaggcagcctkccgactgtgactgtctggagtctgggagagccagagagaaggaggtgtgactggggttgggactcgggttcctacccatttgcaatggtcctggaagggaaaacctagcagactccagatgagagcgaggggagggtagaagagagagtgcagaagtcaggaagagagaagtgggagccagatgtgatcaacacagatatgcctcgctaagtcctagtttttggccacagaaatggactgtacggggtggggtgtggtacctttttttttttaattagggaaggggctatgaagccattt

SEQ ID NO: 71617 - DNA, 601 bp, Human
gtgatcccttgataaaagtggtaatcctaaatgctactgaatggaacaatctaaatttcctatttactgagaacataaattaagtcgaggggagagaaaacctgcataagaaaaattagtagggtatatcagttagagacactgaaagatagctatgctgctctctggataaggaagttgtaaatagcattaaaaagtcaagcaggaaaggaaatggaggtaggagaaatgataaaagacagagcactaaatcacaaataggggtacatgtacgaagtcacaaaccggctttatgccaagmtttgcagaatccacagcttggactgacaatacatagagatgctaaacacacaggcatgcagacttccagagagtgtcagtatgcagagggtggattggtcgcaccatgggcaagctgttgtctgtgctggactctgggattgatccatcagttcctccttgcagggatctgattgggtacagttcggtaggcagtcgaggatacagctgtatgaggtttttaaaggtctttaaacacatgagtctcttgtgagctggatccaccttctaatggatctccaaggtagcaacccattcccag

SEQ ID NO: 71618 - DNA, 601 bp, Human
ttgactggttttgtcaaatagctgctacccctgtcctcctttttctgttttattctgggctactcttttcctttttagtgttcacttatgcctcttggaaattcatgagcacttgctgacaaacaggttaatgactgtggcaactcccaaacatctggatggaaaccaaaacttcagtcaatcatctataaaggttgtcgatatgatgccaaagatctggcgatttagaaatgtccacataattgattgaatttctcagttttttatccaggctcagaatcaacacattgggaaacacctrttttcagagaaaaatattccaggaaacaaagtgttctcattagaaagcatctttgatgtgttcgagtctgatttctggcttgaaaggaggctgggctgggctctaagtcagatggagatctggtggttagagtagttagtattggaacgagcacagctggtgagaggtttccttcccccgaaagttggccaggagggtagatcactttgtccaaataagcttaggctgcctgttaggcctggtttctctaagggagtccattttgccattttaagggagactgtcaggttcttaagacat

SEQ ID NO: 71619 - DNA, 601 bp, Human
gtgaccaagttcagctcaatggatggctgtaagacccacacccaaatacttacagagtcacttatctgataccttttataccttttgcatcattctcaaattcctagatttcattattcgtcatttatgcctattagctggtaaaggttctgattttcaaattagaaagtaaatgtttttaatgagcaaaattagaatcctgaaagctcaatcatccttacatttttcttgtagtacgaaacaagtcaagggctgcctattcattaccagatgcagggccagatgctgccctctgtgtggrcataggcagtggtgagctctgtcaatccccagcccctgccactgcccagatggcagggagagaactaccctctgcccctgtgctacctggctgcaatttttgcacttctctgcttaaaacacacacacacacacatacacctcttaatttgtcttaggattttatgtacactagcacacatgtgtacatgtttatacacatacacaggccaatcttatggctgctttactcagaaagcctttatatttatcatcatcatcatcatcatcatcatcatcatagtggttaacaagtgcttac

SEQ ID NO: 71620 - DNA, 601 bp, Human
attcaaagcagaaacacagacactgccaccaaacaatactcaaattcctccaactcagtgttacacaaagtgcagccacctcaatacaataccacaaaacaccaagtaacaaacattaagctagctgccggaatgcgtcaacacaatgcaataatacacggtaatgcacaacacagttcaaactctgtatcccataggcacacccatacccacaggctgaaatcatgtggccacttgagccacatgggcagacacacacagagacagagccaatagcgcagcacccaattctcctgcacasccagcagaaaacgatcacagctgcagtcctcccaagcacgatgcagcctgccagaaagcagcagcaccatgccgtttctccagcaggtggacgtgtccagaccatcacctctaataaggcctctgggctctcattgctagtaagagagtaaactgtcccctgagcctgcttcccgagacaggacaattcagttctatcctggttggggtttaataagacttcgctgttagtgaaaatgacagagctccagggataaagggaaaggtggtggtgggaggggagctcactaagctgggtgca

SEQ ID NO: 71621 - DNA, 601 bp, Human
actcgcacgagtcaggaggtcaaacaactgttatggagcgaagttaaaaatccaaataaaatattgacacttttttggggagggggaggtgggaagcaaaggtatttaaaataggtttttgttgcaatgcccccaggataaagaatggaaggagactgaagacaagttggagtttataaaatcaatggaatttattgcacagctacttggcatttaataattctctcatttccacatccccctcccccaccccatcctggccatagacagagagatacacaggtatacaaatgcacatttwtgtacgtcaatactggtgcatggaccaatataaaaacacgattgtgatgtgaaaatctcaaacaccccaggaagggaacaatgatggtgtagagtctcgctgtagtttacatatttgacagaaatgggcataacttggcagatactcatgaagcaggttttgataaatatatccactattataaatcttagatcaatgcattggagcagacctgaatataaagataaactaatcatagaaatagattctcaaaacagaaattgagaaacacatctatatgtagtatcatcctgcaatcat

SEQ ID NO: 71622 - DNA, 601 bp, Human
caccccatcctggccatagacagagagatacacaggtatacaaatgcacatttttgtacgtcaatactggtgcatggaccaatataaaaacacgattgtgatgtgaaaatctcaaacaccccaggaagggaacaatgatggtgtagagtctcgctgtagtttacatatttgacagaaatgggcataacttggcagatactcatgaagcaggttttgataaatatatccactattataaatcttagatcaatgcattggagcagacctgaatataaagataaactaatcatagaaatagatyctcaaaacagaaattgagaaacacatctatatgtagtatcatcctgcaatcatgtacatgatttggaaactagatagatgaaaataatttggaaaatttgccccccaaacctaccagtgcatataaaattcaccgaagcctatagcagcttaatctaaaattgtgatttgttagtaacacagacatgatgcttatcaaatacagctatggcacatgcatgggagaggataagcgtgtttaaaatcacagctacctgtgctctctgttaattgtctacatatataattgctcaattttcca

SEQ ID NO: 71623 - DNA, 601 bp, Human
acctggaacctgtgtattccagcaacatcctgccacagccagaatggaaggtcctgcccacagctctgaagaatggcctggcccttatcagtggccatgttcagaaccctgcctgacatatggtcagttatccagactgaaacctgcagggcatatgagtgagcatgggcaaaaaaacctctaaactcagcccaaactgcagccagaggctacaaaaacagtgtgttaagtgattcaggcctgccttaaaggaagccacgtgcaggagagatgctgtttcctttgtgtttctgtggagagsaggaagtaaatttcaatttttcagttcctggggtatacaaagggggagactctagttccttagagttctcaggagtagggaccatttccaggagaggtaaacatttcctgggtgatctatgacatctcactcaaggttctgctgtgaaaagtctcccgctgttagtgttgctgacttgcctcggggccaagccatggatacgtgcctgatataggcagctctcaaagacttgtgttgaagcaataaccacctgcattagctgggcaaaatatcctttgctgaagcaaatatcttcttttt

SEQ ID NO: 71624 - DNA, 601 bp, Human
gagactctagttccttagagttctcaggagtagggaccatttccaggagaggtaaacatttcctgggtgatctatgacatctcactcaaggttctgctgtgaaaagtctcccgctgttagtgttgctgacttgcctcggggccaagccatggatacgtgcctgatataggcagctctcaaagacttgtgttgaagcaataaccacctgcattagctgggcaaaatatcctttgctgaagcaaatatcttctttttttttttctaagacacagtctcgctctgttgccgaggctggagtgcrgtggcgcgatctctgctcactgcaactttcacctcccgcgttcaagcaattctctgcctcagcctccccagtagcagggattacaggcatccgccaccatgcccggctaatttttgtatttttagtagaggcgaggtttcaccatcttggccaggctggtcttgaacttccgacctcatgattcacttgcctcggcctcccaaagtgttgtgattacaggcgtgagccactgtgcccggccacaaatatcctttttaatatcttttttgtgtgtgtgacagagtctcactctgcagccca

SEQ ID NO: 71625 - DNA, 601 bp, Human
tcacttgcctcggcctcccaaagtgttgtgattacaggcgtgagccactgtgcccggccacaaatatcctttttaatatcttttttgtgtgtgtgacagagtctcactctgcagcccaggctggagtgcaatggcaccatctcagctcactgcaacctccaccgactccagtcgtgggttccacttcaccactgcaatcgtgggtttgagagattctcccacctcagcctcccgagtagctggaaccacaagcatgtgacaccctgcccggctaatttttgtattttcagtagagatgggktttcaccatgttggccaggctggtctcgaactcctgacctcaagtgatccacctgcctcagcctcccaaagtgctgggattataggcataagccaccatgcctggctgcaaatatcattttgttctctaggatgattgagtttataatgcccaggcagtctgagaccactggcagaggcccccatgaccactcgtctggcttagtgggcaatggggccagctagtctggcacattttctaccctggagtgcctttgatttactgaatcaggaaagaccctccccataccagggattaaat

SEQ ID NO: 71626 - DNA, 601 bp, Human
gactttgagcaagttgtaataagccttatgtgcaaaatgcgttgttgtaaggattgagtgaactatttatttgaagtacatagaacattgcctagcacatagtagatactcagtagacagttttttgtttttgtttttaaactggagcctctcctgaggaagcattgctcctagaaagcctgcccagcctagtccagtaaatgctgccacctcactcctcccaaggtgagctgtctgaggtcacctcaatgctaataggacctcttcttgtctccacctcagggagtttttgcacaccatktattatcatataatataatgcaatataatatcatacataacataacataatatgatgggtaggttaacttggaaaccctgaggcggacagtggatggatggatagatgaatagatacatttgtactaagtatacatacattatatcattctattgatttgtaaaaagttcccggtctgcctggctgtaatgagatttttgaactttgcgtggcgatcaatgagaggaatattattggcctggagaattgatatacctgctctcagtggcttgttctgctcccaggctgccccggcccccc

SEQ ID NO: 71627 - DNA, 601 bp, Human
gcctagcacatagtagatactcagtagacagttttttgtttttgtttttaaactggagcctctcctgaggaagcattgctcctagaaagcctgcccagcctagtccagtaaatgctgccacctcactcctcccaaggtgagctgtctgaggtcacctcaatgctaataggacctcttcttgtctccacctcagggagtttttgcacaccatttattatcatataatataatgcaatataatatcatacataacataacataatatgatgggtaggttaacttggaaaccctgaggcggacrgtggatggatggatagatgaatagatacatttgtactaagtatacatacattatatcattctattgatttgtaaaaagttcccggtctgcctggctgtaatgagatttttgaactttgcgtggcgatcaatgagaggaatattattggcctggagaattgatatacctgctctcagtggcttgttctgctcccaggctgccccggccccccaggtgtatgattccagcagacacttaaccttttttacagtgtcatcaggctaaaaggaatctaatagtgacacaggacttgtgctcagc

SEQ ID NO: 71628 - DNA, 601 bp, Human
tgagcctgcaccccagccttgcctcctgcttcccccagctcccaggaatcaataaactcacatagccacggtgggacttcagggtgcaaggagacagacagacagacaaagagaggggaagtggagagaggagcagagaaggagaagaagagagggacagagagtgaaacacagagaaaagaatggggaaggaggaggaagagagagagctgaactagaagatgagtaagaatgcctggtgctctcttaaaaggtggagcgcttctctctttcttcttgagtttaacacagtgttaatagragtttcatgcagggctttcattcttactcacagagcctgagactgtgttgatatccaagttggtgagaggtgggggtcttccgggaatttaaccagtaagggagtggcctccccacctgccctgtcatcctttgctctgaagtcctgccacgaccccctgccatcccttgggtctcctgtggatccttgccagtgaccctagtggggcttggtccagcccccagtctgtctgcttgagagtctgacgcaacctccttttgggtcagatgtcgctgccgccactgctgctatttcttgtct

SEQ ID NO: 71629 - DNA, 601 bp, Human
atagaaccaaccatcatagtaatcacattacatggagtgtccctatttagtccttgccacagtcctatgaagtgtatggtagtattatcttattttacagagaagggaataagaaactgccaggggtttcacaggaaacaagtaacaaagccgggattccgactaaggcaggctgagcccagaacccatgtccttcttccttttgctgctctcactcccttggaagtgtgggagactctaagtgcctggaagtccccatgcggggcccaggccaaagccctggaggtccccaggaaagggygagctctcatcggaaatggtggaggagaaagagcatcttgtgaaggaaagagaagtggggagcaggcaccctggcagggcagtctctcagtggaaatggaaaaatgacacctcccagcttctgagcagagctgtgtcctccagggtcccagctgcaccctccagggatctatatccagaacttgaccttccaggtcaaacctgcctggggccgtggaggtttgatgtgtgtctggctgtcttgtgaggccaagtatgaaaaagaattggagaaagaggaggaggaacatggggaaacggt

SEQ ID NO: 71630 - DNA, 601 bp, Human
cggtatcaggccgtcatcatcaacaactgctttacttcattcatcctttagccccgagtgaaattgccatgagttgttgggttgttgtatgggagacaggaggacaatggatgaccatcagatttccatgatcccagttcttaaattctccgagatcagctctagggactggcaagtgcccactgcctgaggtcatggatggacaccaagagcattagtaactcacagcaggcaccctgcccagctcctcccccatgcaccaccaagccgctgtcagggagtagtgattttccatcactcrctgcctcagctaaatttgcgccagtgccctaggggtcagaggctctgggtaacaaagacagaaactcctcaagcccgtccagttctctctctcagccagccccacccctggggttcccttagtcaagagcccatcagacctcaagccagagccacccacaggcccagtgagctcacagaagctgttgctgcagtaaactaggagcagctgctctgagctgctcagcatctttctagacttttcttgtagatgattgtacactgcctctcagctactatccaatcttttccattgtgatca

SEQ ID NO: 71631 - DNA, 601 bp, Human
tcttaaattctccgagatcagctctagggactggcaagtgcccactgcctgaggtcatggatggacaccaagagcattagtaactcacagcaggcaccctgcccagctcctcccccatgcaccaccaagccgctgtcagggagtagtgattttccatcactcgctgcctcagctaaatttgcgccagtgccctaggggtcagaggctctgggtaacaaagacagaaactcctcaagcccgtccagttctctctctcagccagccccacccctggggttcccttagtcaagagcccatcagmcctcaagccagagccacccacaggcccagtgagctcacagaagctgttgctgcagtaaactaggagcagctgctctgagctgctcagcatctttctagacttttcttgtagatgattgtacactgcctctcagctactatccaatcttttccattgtgatcaaactccaaatcttccctccaactcttgggagatgaccttgccttctgctttgctgagagataaaagccgtaaaagctccttttcaaagctttggccacctgaaaatatgccatttctggctaacacctccctggagtc

SEQ ID NO: 71632 - DNA, 601 bp, Human
cagcatctttctagacttttcttgtagatgattgtacactgcctctcagctactatccaatcttttccattgtgatcaaactccaaatcttccctccaactcttgggagatgaccttgccttctgctttgctgagagataaaagccgtaaaagctccttttcaaagctttggccacctgaaaatatgccatttctggctaacacctccctggagtctgcactccatttttccttgttctcccttgctctgttaatcatccacagtcccttaggcaacttcagtctcttcctcttcactggktcttcctcctcagtctacaagcttatccaggtctttcctacccaagaaggccttccctccacttagctgcccgttccatcctccaccttccatactttcctctcctttcgttttccaaaaacttctgaggcaatagtctccgtttactgccctgcctccttttcctccctatgcattccctaaccttgttctgtctggctcctgctccagtcgctttgctgagactcctcctcaaggtcactaatggctaccagaatcccaaatctgtgcttcttcttgttcctaattcccttcggtccc

SEQ ID NO: 71633 - DNA, 601 bp, Human
cagtctcctaaatccatacctctgtgtgcctgctgatgcaggggcattgcccctggacgctcctctttcacctcaaatgctgcacatctaggaccaacatcaccacttccctccaaaaccagtcacctccctatagccttattcctgacctgctgatgtaaactccaccaagcttccagttacacaaatctgagtttgtaaaaccatggttgactccagttggttgccaaactctgaccattctgccttcctcttgtcttgcaaattcttccctttctttcctgagaccagctccctatcrcctcatgcctcatgtatatgtatgttgctttactgggatctgtttgtagagatcccccctagtttagaaatcactcatggcttaaggccctctaaacctggttcctacatgttgggggcaggatgacaaagtaacaaaaagcatagattttagaggctgcattctgagtcttccctaattggtactgtgattttttttttttttttttttgagacggagtcttactctgtcgcctaggctggagtgcagaggcacaatctcagctcactgcaacctccgcctcctgggttcaagcgattc

SEQ ID NO: 71634 - DNA, 601 bp, Human
ctcctgcctcagctgcctgaatagctaagattacaggtatctgccaccatgcctggctaatttttgtacttttagtagagtcgagatttcaccgtgttggccaggctggtctcaaactcctgacctcaggtggtccacccgccttggcctcccaaagtgctgggattacaggcgtgagccactgcacccagccagtagtgtgatcttgagtgagctacttaaacttgtctcagctttggttttcaatttgcaaaatgaggataatagtctctactttggaggtggttgtgcgaattaacartaatatatatgtcatataaattgtgtataatattggcacatagtagatgttcagtaagtggaaaatggtgatggttctcatcacatccaagttttcattcttgtttcctcttagtcccttgcctgtctccactcattctggctgaccactctgggcattaacccagaaggcagcaggctcgcgtggcttccgcttccaccagcttgtgatgccctcccctctacttctttgttcatcttaggatcaagttattttttactggggaaagagacagtggagatcctgtagtccaaccccttc

SEQ ID NO: 71635 - DNA, 601 bp, Human
cagggagcagatggatgaggaaatcgctgaggaacttgggagagagcccctttgcagggctgggctggaattggccgggataggagtgggcatttgatgtgtgatgctgttgtgacgctgttgcagaatcatccggaccaaagttcagcagcctttccacccaacgccggatggggctgggacaggagtgaccgcccctggccacaccattggtaagagggctcagggaaggggaggaaaccagatcccacctagagaaaggcaggaaacgcagctccacccctgggaactgcctgcccgsttgaggtccagagcccaacctatttgccaactcctctcacctgagctcctgtccacatagggtcttcctgagagatactggttctctaggactgttctctgcctcccacttgtgtcacctccctctgccctgctttagtcagtccctatcctctcccctcctctcctctctcttaagtgtttttcttctagcatttcttcttctttttcttcttctcctcctcctgcttccctctccctcattctccaacatcttttgtttttatctgattctgtctccctacctgtgccctctttcttt

SEQ ID NO: 71636 - DNA, 601 bp, Human
cctcccacttgtgtcacctccctctgccctgctttagtcagtccctatcctctcccctcctctcctctctcttaagtgtttttcttctagcatttcttcttctttttcttcttctcctcctcctgcttccctctccctcattctccaacatcttttgtttttatctgattctgtctccctacctgtgccctctttcttttatatcaactttcttattccatctttgtttaacattccatcttgttcttaacattgtcctctgtcttctccccttggctcctcttcttttctccctctgccsttccctctcttctctcttcttcttaggtgtagctctggctctgttctgtcttcctccttcctcatggcctctttcctcttggcctttctctcttgattgctcagcctctgtctcacccactctgtatctctcatcctttctccatcctcctcattctttgagccatgcttagggcctctcaaagacgtgacccaggcctactagaacacctgctaacactcctcctctgtccccaacgcacacagactagcttccctctggcccaaggagaaacttggtgctactgtagccatagatgag

SEQ ID NO: 71637 - DNA, 601 bp, Human
tggagaatcagagacagatcttagaaagccacagactctaaatcaggattggtaaagactcagcccaggagactgagaacaatgagctggggcttcattagaagggtttgcccagccccagggattggatgagctgtgcaagggggtatccaaggagctgtgctctctagaggaccatggaggtgctgcctagaaggagacaggtttgctgtttcctgggcctgtactccatccgtctttaggagagtgagtttgagaaccccagtgaaatccacaggtctgcagagaaggcctggggttaactgggcaccacttacctcagggctggacagaagtgaataatagcctgtatatggcaatgcagtcccctcttaaatagaccccagaggaagtagaggaatgagaggaacgtgggctcctcatccctccttatgtcctctgcttctctctgccccccagccttggggctttggcctacgatcacaactgctaaactgctatcctgatgccatttcctccttcctctcatccagttcccagcacggcctcccctcctgtttccagcgcctccaatgacccagtgggatcctactccatcaat

SEQ ID NO: 71638 - DNA, 601 bp, Human
tctgctgtgagatcaattttagtagcaaagcccaggtccccccactgccctgctggctcctggagagagggagggtggctgctagtggggccatcagcttcaccatctgctcagcagccccggctgcctcacctgccactagggctcaccctatcgatccctgtgggatgtcaggaggagaagcaagaaccgtttaccttgggaaggttttggagttgggggaacagctggtctctgacctgaggatgaaaggccaacctaccttgtccttacctgatcccaatctgtctggaggtgaggkagtgatgtcatgtgcagcctagcctggtgtcctttctctttaacacctgcacaccgcccccagttcaaacctcacagggagctggacatgggacccctctctcctcttcttctccatgagtagaaatgccactccaaatcccctggccctctccctcacctccctgaaatgcctcaaggtgcagccaggctgttaggaagggtgtcaaagggaagggggaaggaagaggaggaggagagaagaaaagaaataagggggagagtggtagggatgatcctgggacaaagtgtttttcaaatg

SEQ ID NO: 71639 - DNA, 601 bp, Human
tgtcaggaggagaagcaagaaccgtttaccttgggaaggttttggagttgggggaacagctggtctctgacctgaggatgaaaggccaacctaccttgtccttacctgatcccaatctgtctggaggtgagggagtgatgtcatgtgcagcctagcctggtgtcctttctctttaacacctgcacaccgcccccagttcaaacctcacagggagctggacatgggacccctctctcctcttcttctccatgagtagaaatgccactccaaatcccctggccctctccctcacctccctgaratgcctcaaggtgcagccaggctgttaggaagggtgtcaaagggaagggggaaggaagaggaggaggagagaagaaaagaaataagggggagagtggtagggatgatcctgggacaaagtgtttttcaaatgtcgtgacattgggggtcccttggtgaccatctggttctcttctgatgcgtgaagctggggcacagggctggcagaccctgaacaacagagacaccagtgtctccggcctgcgtcctgcccccattttctcatggttcccgctggagaagtggtaacctcctggccttc

SEQ ID NO: 71640 - DNA, 601 bp, Human
catgtgcagcctagcctggtgtcctttctctttaacacctgcacaccgcccccagttcaaacctcacagggagctggacatgggacccctctctcctcttcttctccatgagtagaaatgccactccaaatcccctggccctctccctcacctccctgaaatgcctcaaggtgcagccaggctgttaggaagggtgtcaaagggaagggggaaggaagaggaggaggagagaagaaaagaaataagggggagagtggtagggatgatcctgggacaaagtgtttttcaaatgtcgtgacaytgggggtcccttggtgaccatctggttctcttctgatgcgtgaagctggggcacagggctggcagaccctgaacaacagagacaccagtgtctccggcctgcgtcctgcccccattttctcatggttcccgctggagaagtggtaacctcctggccttcagaggattttaaagacatctcccaggaaagaggcagaatcctcaaacaatgagcataaaggggtgaccatctatcccattagcccagaacagtcccaatttatgcctgttgtctctgcatcttggccagtcagcatctcag

SEQ ID NO: 71641 - DNA, 601 bp, Human
ctctccctcacctccctgaaatgcctcaaggtgcagccaggctgttaggaagggtgtcaaagggaagggggaaggaagaggaggaggagagaagaaaagaaataagggggagagtggtagggatgatcctgggacaaagtgtttttcaaatgtcgtgacattgggggtcccttggtgaccatctggttctcttctgatgcgtgaagctggggcacagggctggcagaccctgaacaacagagacaccagtgtctccggcctgcgtcctgcccccattttctcatggttcccgctggagaastggtaacctcctggccttcagaggattttaaagacatctcccaggaaagaggcagaatcctcaaacaatgagcataaaggggtgaccatctatcccattagcccagaacagtcccaatttatgcctgttgtctctgcatcttggccagtcagcatctcagcatctcccttttctctcaaaaatgtcgtgtttggacaataaattatgtggtcattccacacatagacaaaccctcggtaggggaagcctaatggagtgaggagcagagaaaagggacaacactgagcttgcctgggccca

SEQ ID NO: 71642 - DNA, 601 bp, Human
gggaaggaagaggaggaggagagaagaaaagaaataagggggagagtggtagggatgatcctgggacaaagtgtttttcaaatgtcgtgacattgggggtcccttggtgaccatctggttctcttctgatgcgtgaagctggggcacagggctggcagaccctgaacaacagagacaccagtgtctccggcctgcgtcctgcccccattttctcatggttcccgctggagaagtggtaacctcctggccttcagaggattttaaagacatctcccaggaaagaggcagaatcctcaaacartgagcataaaggggtgaccatctatcccattagcccagaacagtcccaatttatgcctgttgtctctgcatcttggccagtcagcatctcagcatctcccttttctctcaaaaatgtcgtgtttggacaataaattatgtggtcattccacacatagacaaaccctcggtaggggaagcctaatggagtgaggagcagagaaaagggacaacactgagcttgcctgggcccacagtccaagatcccccagcctaggctgagggaagagagtgggagaggccaggcccccagcggaaggga

SEQ ID NO: 71643 - DNA, 601 bp, Human
gaagaggaggaggagagaagaaaagaaataagggggagagtggtagggatgatcctgggacaaagtgtttttcaaatgtcgtgacattgggggtcccttggtgaccatctggttctcttctgatgcgtgaagctggggcacagggctggcagaccctgaacaacagagacaccagtgtctccggcctgcgtcctgcccccattttctcatggttcccgctggagaagtggtaacctcctggccttcagaggattttaaagacatctcccaggaaagaggcagaatcctcaaacaatgagcmtaaaggggtgaccatctatcccattagcccagaacagtcccaatttatgcctgttgtctctgcatcttggccagtcagcatctcagcatctcccttttctctcaaaaatgtcgtgtttggacaataaattatgtggtcattccacacatagacaaaccctcggtaggggaagcctaatggagtgaggagcagagaaaagggacaacactgagcttgcctgggcccacagtccaagatcccccagcctaggctgagggaagagagtgggagaggccaggcccccagcggaagggacagcgt

SEQ ID NO: 71644 - DNA, 601 bp, Human
agaggaggaggagagaagaaaagaaataagggggagagtggtagggatgatcctgggacaaagtgtttttcaaatgtcgtgacattgggggtcccttggtgaccatctggttctcttctgatgcgtgaagctggggcacagggctggcagaccctgaacaacagagacaccagtgtctccggcctgcgtcctgcccccattttctcatggttcccgctggagaagtggtaacctcctggccttcagaggattttaaagacatctcccaggaaagaggcagaatcctcaaacaatgagcataaaggggtgaccatctatcccattagcccagaacagtcccaatttatgcctgttgtctctgcatcttggccagtcagcatctcagcatctcccttttctctcaaaaatgtcgtgtttggacaataaattatgtggtcattccacacatagacaaaccctcggtaggggaagcctaatggagtgaggagcagagaaaagggacaacactgagcttgcctgggcccacagtccaagatcccccagcctaggctgagggaagagagtgggagaggccaggcccccagcggaagggacagcgtgg

SEQ ID NO: 71645 - DNA, 601 bp, Human
agagaaaagggacaacactgagcttgcctgggcccacagtccaagatcccccagcctaggctgagggaagagagtgggagaggccaggcccccagcggaagggacagcgtggaggggaggcctaggcctgacaagacagtgatgacctggcgctggcctccttccagaagccctaatggcctcgtttcacagggaaacagcttgtctggctctatttctccttcttccaaaatatccaaaccgatttggccgccacggcctttgccattcactaaatttcattgtggttgttttggcggcrgcccctgatgggcagggggaggttgtgggaaaggccctaagtcccagttctccctgaggctccctgtgctcaggccttggccaagctccttggcaccccaagtgctttggtagaatctgcctcaaaccctaaaggtctctcccttaaccagcagcccctgtgttttttaggggtgagaggcccagcagcccatgggaggccacagatacccctctgtactctcccttttcagtctgaggctgtggccaagtatgccaacctcgtggccaagtatgccctctgctgcatgggctcctgtgg

SEQ ID NO: 71646 - DNA, 601 bp, Human
gctccctgtgctcaggccttggccaagctccttggcaccccaagtgctttggtagaatctgcctcaaaccctaaaggtctctcccttaaccagcagcccctgtgttttttaggggtgagaggcccagcagcccatgggaggccacagatacccctctgtactctcccttttcagtctgaggctgtggccaagtatgccaacctcgtggccaagtatgccctctgctgcatgggctcctgtggggcaagaaaggctgggggtagggaggcactggcatgaggttgtggtcacccagggctgygcctggctggcccagaacagggcgctctcctgagtggttgatcgccttcattgtttctaatcaattcagttcagtgaacctttcctggacatcagtttcaagaaaggcttggtactataggatcccaaagcagaacaagatatgattcttgtccttaaggagcttacattctagtggggcatgttaaacatgtgagctcaaagagcagataggcccatcagatatcctgttgcgatggaggtctggtggcgggccacaggaactgggctggggagggagtacatggccaggaagggctgc

SEQ ID NO: 71647 - DNA, 601 bp, Human
attttccctggtggaggcctggcctatgagggagaccagttctccctgacctccccctccaatcctgatccaccagcccctggtgggaagggagaggagagagcaaaggtagagctgtggcagcccctcctcccctttcccccactctggatgcttctaaggagccaggcccagtttgcattagggagcagctcagatgattaagaataagggagataattatgtgtcaagatgatgtagcccaactctgcagtcaggccaaggtagcaaagcagctggcaggccagtcacagaaggcagcctcgggcatgggctgcagacacccaggtgtgtccttcagtgactgggccgggactgcagcaaaagagaatactgaccaggggactaaggggtgttgggatgggactgagcacgcacattaaagggctagaccctagagggaatggaggggctcatctccctccaggaggacccttaaagaccctgccagactggccctcctttggccccaagcactgtggcatcttcctaggagtgtcataccccaagggcaagctgtgaatctctttgtcctccaggaagctgctcctcttttgctctg

SEQ ID NO: 71648 - DNA, 601 bp, Human
ggagccaggcccagtttgcattagggagcagctcagatgattaagaataagggagataattatgtgtcaagatgatgtagcccaactctgcagtcaggccaaggtagcaaagcagctggcaggccagtcacagaaggcagcctcgggcatgggctgcagacacccaggtgtgtccttcagtgactgggccgggactgcagcaaaagagaatactgaccaggggactaaggggtgttgggatgggactgagcacgcacattaaagggctagaccctagagggaatggaggggctcatctccytccaggaggacccttaaagaccctgccagactggccctcctttggccccaagcactgtggcatcttcctaggagtgtcataccccaagggcaagctgtgaatctctttgtcctccaggaagctgctcctcttttgctctgggtacagttcggcctattcttcagctctaacaatgtcacggtgatgggcattagtgaggacaatcactgcagtgagtgctggcattattggagacaatctcagcagtagttattggtgttcacagtgataatgcccagaacattattggcactggcactc

SEQ ID NO: 71649 - DNA, 601 bp, Human
gttgggatcatcctttgaggtgtgagattgcagggggccatgattttgcattccattcattaggtgtacaatgaattgtgccattgagtggtgccaagctggtgcagttgtgcgtttgcaggcagggcaggttgcatggctgcagatggccgagtcctgtcactgcctttaatagctcccttctgctttggatgaagccataaatggaagaagcagtttatttccttagttagctaccatcctagaggtccccaagagtgttgctcaggttagacttggagcaaatgaggggattaagccrtggaaatgagaagcacctgcccttgtctacgagcctggcttgaggcagcagaaggttgcaaagactcccaccaggaaggaaggcacagggtaggagtgagcatgccatccctagagcagggcatggatgggcagtggggctcagtgggaatgaatgtggcctctggagtgagcacagcagggtctgaatcctggtgcccctcactagttgggcaagtcacctaaccttcatcagctcaatcttctcctctgtaaaatgaagatggtaatggcacttccttcctgggggctgtggagagga

SEQ ID NO: 71650 - DNA, 601 bp, Human
tataaataaataaacataagatcctcttctttttctaacatgtgggcatctctccctctattcatctgtggacattactgctcccacatgcaagtttatttctttaccttggaaaatgtatgtttgttttataaacccaaatgtaattttttacacagtttatgcaagtgtgagtatgcatgtgttctaccgctctgaggtctttgggtataaggggatgggaatgtcatgcactgggaaggtgtgcagttacctgggtagtgtgcgtgcttggagagagtgccgggtgtgactgtgtgakcggggagagctctaagccaggcctcagtgtgttgagcgcccatggtcctgggcacaggcatcaccctaccttctgctgataaagggaggggctgtcctgagcctgcctccaggggtggcctagggcccaagactagggagactaaggcccttacagccaggctgtgagggaattgcagctcagaacccttgtagcccttagaaggggagtctggtctcccgatcttgggatcctgcccccaatcttctgcctgcctgtctttcgggatctctcagtgtttgtctgtctcttatttgctct

SEQ ID NO: 71651 - DNA, 601 bp, Human
ttttctagcccttggaaaaacaaagagcagatcgggtagtaaaacaaaagcaaaggagacctggaagcacctgacagccctaattcatcacagcccaagttttttcctgtgttcccattatatttgtttgtaaaagtggaaatcaattttgaaggtaattttctggaaagaatggaagggaggtgggagggccggataaggcagagatggtaaaaggaaaaatttaggccaggcacagcccaggggcagctcttggcaaggtgaaagaaaattgcatattcaatctccatccatgaatctycctcactgctgcccgcctcctgcttgaaaacaatgaaggctttttcccaacgctgggcagggcctcggtatcagcctcactttaacttcagggtcattaattccctgattattgaaggagaagagagggttgcagcatcgtcaattccaaaggcaccccctcatgtgatcgggcactggctggggttgggtggggggcacccagggcaaagtgaggtgttgtttgagaaaggtgtgaggagcgaggaaatgggggagccactggactatgggggaaggaagccaggagggtggaagaagg

SEQ ID NO: 71652 - DNA, 601 bp, Human
ggtaattttctggaaagaatggaagggaggtgggagggccggataaggcagagatggtaaaaggaaaaatttaggccaggcacagcccaggggcagctcttggcaaggtgaaagaaaattgcatattcaatctccatccatgaatctccctcactgctgcccgcctcctgcttgaaaacaatgaaggctttttcccaacgctgggcagggcctcggtatcagcctcactttaacttcagggtcattaattccctgattattgaaggagaagagagggttgcagcatcgtcaattccaaagrcaccccctcatgtgatcgggcactggctggggttgggtggggggcacccagggcaaagtgaggtgttgtttgagaaaggtgtgaggagcgaggaaatgggggagccactggactatgggggaaggaagccaggagggtggaagaaggcagtcattactgcatacctctgttgtgttgttattgcaaattaaaagtagcatgttccactccacagctatctttggggagggaggggcaccgagggaggtgggggatcttatcattgcttcttcagcagaccagccgtggtgtcaccgtgtg

SEQ ID NO: 71653 - DNA, 601 bp, Human
caggcacagcccaggggcagctcttggcaaggtgaaagaaaattgcatattcaatctccatccatgaatctccctcactgctgcccgcctcctgcttgaaaacaatgaaggctttttcccaacgctgggcagggcctcggtatcagcctcactttaacttcagggtcattaattccctgattattgaaggagaagagagggttgcagcatcgtcaattccaaaggcaccccctcatgtgatcgggcactggctggggttgggtggggggcacccagggcaaagtgaggtgttgtttgagaraggtgtgaggagcgaggaaatgggggagccactggactatgggggaaggaagccaggagggtggaagaaggcagtcattactgcatacctctgttgtgttgttattgcaaattaaaagtagcatgttccactccacagctatctttggggagggaggggcaccgagggaggtgggggatcttatcattgcttcttcagcagaccagccgtggtgtcaccgtgtgaggtgacatttgaatttacaattccgctgagaaaagccattaattcacaaattaacatttctccctctccctctct

SEQ ID NO: 71654 - DNA, 601 bp, Human
gtcagcactcaccaaaacacagggggaaaaaaaactcatttatgaacacacattcattgctatgattatatctccctagtaaccaaggaaattaaactgttcatacctgaggggggaggttttctgtcttagttggatcacatattttagccaaactctctgggtagagttggccgtgagcctgttgaatactgactatgtcattatccagaggtaggtgtaggttctgtcgatgttttagaaggacctttatcttgggccctgtgcataggtgatttgtactttttttgtggggaagtayaggggtttagccctggctgtgtggatcaacataggtgcatgcatctgcatataagtccttgcctttatatcagagacagcagccaaatcaccaactacctttgcttcccaactagttaatgctgttgtggatgaagaattccatctggttgtttggggaagtattttgggatttagcacaaaagagtatatattttttcatacaatgccagaaattcagaatagagaggtcaattccaccctaccaggagagaatatacagaattgccctagaggagactgtatgtgtccatccaccgct

SEQ ID NO: 71655 - DNA, 601 bp, Human
cattaaatgcccagacacatggctgtgtgttccataggaatctggggaaatggactagaagggcaagcaggaaatggggcttcagcctgggagcctgggagtggctgagattgagagaggccttggctgggctggatggtgacaaggcagagtgtcagattcttaagggtcatcctgtcttatctgccactcaccatagaactctttcctccaacagttctgcctgaaaggccacagccctgcctggacatatgtcagagatggacagtggccattgtttgtttgcagcatcactttataycaagtcatgcgggttgagggaagaccacgggacatgggatccaaatgtccagatgtgggtccatctccactccctacttgctctgggaactttgactcattacataatatctctgaatctcagtttcctcatctttaaaatagaggtaatggcatttgccacagagaatggtggtggtggtaaagctctccatttgacaccctcccttccctatcctccctccctccctttcatccactccaccttatttactgagctcttggcaaatgctgggctgggtcctgggtggatttcagattc

SEQ ID NO: 71656 - DNA, 601 bp, Human
taggaatctggggaaatggactagaagggcaagcaggaaatggggcttcagcctgggagcctgggagtggctgagattgagagaggccttggctgggctggatggtgacaaggcagagtgtcagattcttaagggtcatcctgtcttatctgccactcaccatagaactctttcctccaacagttctgcctgaaaggccacagccctgcctggacatatgtcagagatggacagtggccattgtttgtttgcagcatcactttataccaagtcatgcgggttgagggaagaccacgggacrtgggatccaaatgtccagatgtgggtccatctccactccctacttgctctgggaactttgactcattacataatatctctgaatctcagtttcctcatctttaaaatagaggtaatggcatttgccacagagaatggtggtggtggtaaagctctccatttgacaccctcccttccctatcctccctccctccctttcatccactccaccttatttactgagctcttggcaaatgctgggctgggtcctgggtggatttcagattctcacatgatatggttcctgcccttggagttccct

SEQ ID NO: 71657 - DNA, 601 bp, Human
gtgcatgcatgttaagcatagtgtctggtatccaagtagaaactggatctgttttagttattattagtactatttctacaatagaggtttggatagatggctgttagaatgcagagaaaggagaaattaatggtgagggaggagctaacagccctcttgtatatgtctgaggaaactcaatccagaaaagctcaggagatttatagcaagtgagcaacaaaactaggatttcaatccaggagatgttacttctggtccagcattgtgttagggtcactagtacagttagtgtccctagagrccggtgggtgtgaatgggtacagcaagcctgaggtcagacaggcccacagccaccccagcctctccctattcatgaactcactgagtgtttagaagctaggcttggtcaagtacagcaggtagtttcccagggctagaaggctgggcagaacctggtcttgccccgagccaaggtttgggccagatttccaaagccttcttcatgtccacctctttttttttttttttttttttttagacagggtcagggtctcactctgtctcccaggctggagtgcagtggcatgatctcaactcact

SEQ ID NO: 71658 - DNA, 601 bp, Human
caacaaaactaggatttcaatccaggagatgttacttctggtccagcattgtgttagggtcactagtacagttagtgtccctagaggccggtgggtgtgaatgggtacagcaagcctgaggtcagacaggcccacagccaccccagcctctccctattcatgaactcactgagtgtttagaagctaggcttggtcaagtacagcaggtagtttcccagggctagaaggctgggcagaacctggtcttgccccgagccaaggtttgggccagatttccaaagccttcttcatgtccacctctttttttttttttttttttttttagacagggtcagggtctcactctgtctcccaggctggagtgcagtggcatgatctcaactcactgcagcctccatccccagggctcaagtgatcctccaatctcagcctcccaagtagcctggaccacagacacatgctaccacacccagctaatttttatatttttggtagagacggggtttcaccatgttggccaggctggtcttgacctcctgagctcaagcaatctgcccacctcggcctcccaaagtgctgggattacaggagtgagccactg

SEQ ID NO: 71659 - DNA, 601 bp, Human
aactgtggccaggccagactcactgaatgtccagtttaaagatgggaggcaatggggcatatcatccatctccctggacaagcagtgtcaccatagctcctttcccagcccggccctctggagccccttccctcctctctcctttttcctatctattcctccctcactcccggaatcccactttcccctcatcctctcttcttccctcccttctcctatctcccttacctctctcttcattcctgaacactccttccttttctatcctcctccactctcccttgtgacccccccacccaakccatcaatcctccctcctctcccagtctggacagcacctgacctctggggagccaccccattcctcagctcccaaacctcactccctgttcccagttggacctccacctccctggtcctgctgtgccgccgtgggggtggggctgggcctgcacaggcaggctgccctgaatgacaagcggggatattgatcgcgttctgaactcagcccagccgatagaaggtaattaatgactccatttgcctcactaccgaggagaacaattgagtttgaaactgcaacaactggcagctgggaaga

SEQ ID NO: 71660 - DNA, 601 bp, Human
ttggacctccacctccctggtcctgctgtgccgccgtgggggtggggctgggcctgcacaggcaggctgccctgaatgacaagcggggatattgatcgcgttctgaactcagcccagccgatagaaggtaattaatgactccatttgcctcactaccgaggagaacaattgagtttgaaactgcaacaactggcagctgggaagactggggggcagcctgggggtgaacccctcagaggcggaagtaatgtgtggagtagctaggcagagagagcaccttctgagcagaggccaccatcakaacgggcagagcccccatccccagcacagctggcccctgagccccactgctcccccagcccttgaggcccaaggcccatcacccactggtccccccacctccacgcttttctcttttcttcccatatcactttttgaggtcattttctgcctgcggatgaagactcagttttcccaagactgcttcttgccagctgtgcaatcttgcacatattttgaactctccctgagcctgtttcctcgtttgtaaaattgaactaacagtatcacttttgcaagcattctgtgaagactgtggata

SEQ ID NO: 71661 - DNA, 601 bp, Human
tcagtaaatgatgatgggtccttgacagagaaggcaaacatggtagagtggagagagcttcagagtccgacatccctgagttcacatccaggctctgctgcttcctagctgtgcagtgttgaacaaataattttgcctctctaagactatttccttttctagaaaatgagagtaataataagtacctcgtaaagtttgaagaggttgatgagtgtaggtgaaagccctaatatcattactttctccatagacagatagatgtttgtatttgagcttagaaaactgaagttagtgtaattcttttttttttttttttttttctgagacagagtctcactctgtcacccaggctggcatgatctcaactcactgcaacctccgcctcctgggttcaagcgattctcctgcctcaggcctcccaagtaactgggattacaggcgcccaccactacacccagctaattttttgtatttttagtagagatggggttttaccatgttggccaggctggtctcgaattcatgaccttgtgattcacctgcctcaagcctcccaaggtgctgggattataggagtgagccaccgcgcccggccaaagtt

SEQ ID NO: 71662 - DNA, 601 bp, Human
agatggggttttaccatgttggccaggctggtctcgaattcatgaccttgtgattcacctgcctcaagcctcccaaggtgctgggattataggagtgagccaccgcgcccggccaaagttagtgtaattctttgctatacttaaattcttctcaaatacctcatcttgcttcctgggatttgatgggcaaccccgttcatcccaccctgattttgtagactttgatgagccttggtgctttctgcccaagcaaatgacatcatttcattttcattttctttatttttcttttcttttcttyctttcttttttttttttttttgagacagggtctcactctgttgtccaggctgaatgcagtggcactatcttagctcactgcagccttgacctcccaggcttaagcaatactcccgcctcagcctcctgagtagctgagccacaggtgcatacaactatgcccagctaattttttatttttgtaaagatgagtctcgctatgttgcccaggctggtctcacactcctggacacaagcaatcctccagcctcagcctcccaaagtgttgggattacaggcatgagccactatgcctggccca

SEQ ID NO: 71663 - DNA, 601 bp, Human
atggggttttaccatgttggccaggctggtctcgaattcatgaccttgtgattcacctgcctcaagcctcccaaggtgctgggattataggagtgagccaccgcgcccggccaaagttagtgtaattctttgctatacttaaattcttctcaaatacctcatcttgcttcctgggatttgatgggcaaccccgttcatcccaccctgattttgtagactttgatgagccttggtgctttctgcccaagcaaatgacatcatttcattttcattttctttatttttcttttcttttctttctttcttttttttttttttttgagacagggtctcactctgttgtccaggctgaatgcagtggcactatcttagctcactgcagccttgacctcccaggcttaagcaatactcccgcctcagcctcctgagtagctgagccacaggtgcatacaactatgcccagctaattttttatttttgtaaagatgagtctcgctatgttgcccaggctggtctcacactcctggacacaagcaatcctccagcctcagcctcccaaagtgttgggattacaggcatgagccactatgcctggcccatt

SEQ ID NO: 71664 - DNA, 601 bp, Human
gggttttaccatgttggccaggctggtctcgaattcatgaccttgtgattcacctgcctcaagcctcccaaggtgctgggattataggagtgagccaccgcgcccggccaaagttagtgtaattctttgctatacttaaattcttctcaaatacctcatcttgcttcctgggatttgatgggcaaccccgttcatcccaccctgattttgtagactttgatgagccttggtgctttctgcccaagcaaatgacatcatttcattttcattttctttatttttcttttcttttctttctttyttttttttttttttttgagacagggtctcactctgttgtccaggctgaatgcagtggcactatcttagctcactgcagccttgacctcccaggcttaagcaatactcccgcctcagcctcctgagtagctgagccacaggtgcatacaactatgcccagctaattttttatttttgtaaagatgagtctcgctatgttgcccaggctggtctcacactcctggacacaagcaatcctccagcctcagcctcccaaagtgttgggattacaggcatgagccactatgcctggcccattatt

SEQ ID NO: 71665 - DNA, 601 bp, Human
ctgtcagggcacctgccctgtgccaggatccccagcaaatgtccccttgagccagtcacttgccctcgcttcacctgcacctcatttactctgagcctcagtttcctccccagtaaaaagggattaaaatccctacctaccttggagagtggttgggaagcccatataacctaagatctatgaagaccttttgttaaatgctaagcaaataggaaacagtcagataagaagacaatatgagctttgttatcctcgaaagaataatctatgtcaaagttttgactcagcagtttgtttaatygaattaatttatttacatactatctgtgttccaaaaagacctgtagtagctcacccccttgagagtgctcatgccacagtggacagagcacctggaatggcccagtcctgggagtcccattccccagttgtgtgaccttggaaaagtcactgcccacccctgctagttatggtaacatgaaaaatttggaccagacatcctctaatcatctgggcacagtctgcactcagccagcacctgtgccacaggctgtagcctccatttggggagggtgccaggcaaagaacgagggatgccgag

SEQ ID NO: 71666 - DNA, 601 bp, Human
ccccagtaaaaagggattaaaatccctacctaccttggagagtggttgggaagcccatataacctaagatctatgaagaccttttgttaaatgctaagcaaataggaaacagtcagataagaagacaatatgagctttgttatcctcgaaagaataatctatgtcaaagttttgactcagcagtttgtttaatcgaattaatttatttacatactatctgtgttccaaaaagacctgtagtagctcacccccttgagagtgctcatgccacagtggacagagcacctggaatggcccagtyctgggagtcccattccccagttgtgtgaccttggaaaagtcactgcccacccctgctagttatggtaacatgaaaaatttggaccagacatcctctaatcatctgggcacagtctgcactcagccagcacctgtgccacaggctgtagcctccatttggggagggtgccaggcaaagaacgagggatgccgagaggaaggctgtgccctggatggagccaagtggccttcaactgggcccactgtgtttggcacccaggctgcagagtgaaatgatttagagggcaagctctgtactccg

SEQ ID NO: 71667 - DNA, 601 bp, Human
accagacatcctctaatcatctgggcacagtctgcactcagccagcacctgtgccacaggctgtagcctccatttggggagggtgccaggcaaagaacgagggatgccgagaggaaggctgtgccctggatggagccaagtggccttcaactgggcccactgtgtttggcacccaggctgcagagtgaaatgatttagagggcaagctctgtactccgacagacctggattcaaatctggctgtcatttactagcttcatggcctttgacaagctacttaacctctctttgcttcagcttccttatctttaaaatggttatcatagtagttccctcacagggttgtcggaaggattaaatgagctctgtaaataacagcaatggcatgtaatgagttcttgatacttgtgagctgctacagaatgggagctgggcagggggcagacggagaatgaggctgaaccctccctctatggggactgactagcacacggtcccttccttgctctgtttggtcttattaaacccacagccaccatattttccagccccaatctaaaaatgtggccagagaatggggaagaatactggaaatcagaat

SEQ ID NO: 71668 - DNA, 601 bp, Human
gaacaccctggggcctccggcatgggctggccccaggcccaaggctcctcagctggtcttgggctgagggaagcctggagtgaccaagctggtatggggtttgggggggaaaccccactttggggggctgcaaggtgtgggttcagagagaggccacagagcaggcacattgcctactgtacaccttgaaaactccaaggaaccgacgctgggaggcaaggataggggagggctgagaacgcctgaggaaaggggacatggagacaggattggcctgtagactcaggggagcaggcaccgstgtgataagactctgctccctctggagacttgcaggaggaaccaggtgaccaagaaactggctcctgtaggaggcttgagcctgggtctaggttggagacagaggccgagaaggcggccagggcatagaggcatccacaggggcccttctgtgggctctgcccaagcgggagctttgctgctctagcgacacctctttcctcccgcttggtttccctctggcctcagtcctggcccaacccaagcagagtgcctcagctctgcctcagagcccctcctccctcagggcgaagttgattac

SEQ ID NO: 71669 - DNA, 601 bp, Human
ctggtatggggtttgggggggaaaccccactttggggggctgcaaggtgtgggttcagagagaggccacagagcaggcacattgcctactgtacaccttgaaaactccaaggaaccgacgctgggaggcaaggataggggagggctgagaacgcctgaggaaaggggacatggagacaggattggcctgtagactcaggggagcaggcaccggtgtgataagactctgctccctctggagacttgcaggaggaaccaggtgaccaagaaactggctcctgtaggaggcttgagcctgggtytaggttggagacagaggccgagaaggcggccagggcatagaggcatccacaggggcccttctgtgggctctgcccaagcgggagctttgctgctctagcgacacctctttcctcccgcttggtttccctctggcctcagtcctggcccaacccaagcagagtgcctcagctctgcctcagagcccctcctccctcagggcgaagttgattacttcacccagtctccaggttacactcggcctcggaaatttgatggttttcaacccttggaattagtggaactgaaattcatctcggagc

SEQ ID NO: 71670 - DNA, 601 bp, Human
ttggatcgggtctttgagcgtccttcctaccctgacgtcttccaggcatcagagcacatcaaatcagaacaggtgaggagggagctttctgcttgcagaagtagaaaggagccggcagagcaaggcctctcaaaaacttgttcactaaacaccacatgcatagccagcattgtatgtgttacacacgtgtgttctgtgtgtgtgcagtgtgaacaggctcacatgagacagtatggtatcgttaagacaaatcattatggtctgtatatggtaattagaaatgagttctgggtgcaagagyatggccttgggtaaatcatctctgttcagagcctcggtttccccatctatagaatgaagggcttggatgtagggtttgtcaagtcccttctagctccgcttttctgtggttcttgcatggagtactcaggaacatcctcttgctgtgtcccttgcccacaccccctcagggtcctacagaaagtctacgctagactggggagctctccttgcccagtgtcaggagagcctgcctgtgcctgcctcctgctccccaagccagcaattcaatggaaccctaggtaggctggcagcttcccac

SEQ ID NO: 71671 - DNA, 601 bp, Human
ccaggaagcggaagggaaaaaaacagacccgaaagagcaggaaatcagttttaatttaacgtaatattaatcagagcaacttttcctgctttgtgcaggctcccggtctgcccagctctggggtctggcttggccgtggctgcaataaaaaggcaattacccgagtgtttcaggcaggacaccctttcagagtcaatgactggccccctcctacccttctgttagccatgtggactctccccctccccaatttcataccccagtgcacaggcagacagcgaggggcccatggggctgtcaytgtttgtttttaaaaaaggggcgcccatacccgatcagccagcagtgccaggctgaaggccccactaggcccttctcccagctactggctctgccagtcatgtcatggttccccctcctccccaaggctcctcgacatcccatgcctctcaacaagggtatccccactactacaccctacccgcaggggtgcttaggcaggagatgctacagaaacataaagggtgctggcattaagtgcccaaaatgtgtaaagggtgctgtgcctccggtttcaccaagtcaggtctactacccgcac

SEQ ID NO: 71672 - DNA, 601 bp, Human
aatattctaaaaaagatcaaaggggccgggcgcggtggctcacgcctgtaatcccagcactttgggaggccgaggcaggcggatcacgaggtcaggagatcaagaccatcctggctaacatggtgaaaccccgtctccactaaaaaaatatacaaaaaattagccgggcgtggtggcaggcgcctgtagtcccagctacttcggaggctgaggcaggaatatcacttgaacccagaaggcagagcttgcagtgagctgagatcgtgccactgcactctagcctgggcgacacagcgagacyccatctcaaaaaaaaaaaaaaaaaaaaaaaaagatcaaaggaagtatcagctgtatctttatcacagatccagatcccccagtcccttcccaccactgctcaccaaattgtcagataatggagatcaaaaagggcaaagaatgaggaccatacctatagattattgctttggggtccaggaggcatggaaagagctgagcctcaggcaactctgaaagtagagcctgttccaggcttgtccaggctcccagactgctaagcctcagcagaaaatcttatattttctttgagaaaatgtct

SEQ ID NO: 71673 - DNA, 601 bp, Human
aaaaaagatcaaaggggccgggcgcggtggctcacgcctgtaatcccagcactttgggaggccgaggcaggcggatcacgaggtcaggagatcaagaccatcctggctaacatggtgaaaccccgtctccactaaaaaaatatacaaaaaattagccgggcgtggtggcaggcgcctgtagtcccagctacttcggaggctgaggcaggaatatcacttgaacccagaaggcagagcttgcagtgagctgagatcgtgccactgcactctagcctgggcgacacagcgagactccatctcaaaaaaaaaaaaaaaaaaaaaaaaagatcaaaggaagtatcagctgtatctttatcacagatccagatcccccagtcccttcccaccactgctcaccaaattgtcagataatggagatcaaaaagggcaaagaatgaggaccatacctatagattattgctttggggtccaggaggcatggaaagagctgagcctcaggcaactctgaaagtagagcctgttccaggcttgtccaggctcccagactgctaagcctcagcagaaaatcttatattttctttgagaaaatgtctgaacatta

SEQ ID NO: 71674 - DNA, 601 bp, Human
cggtggctcacgcctgtaatcccagcactttgggaggccgaggcaggcggatcacgaggtcaggagatcaagaccatcctggctaacatggtgaaaccccgtctccactaaaaaaatatacaaaaaattagccgggcgtggtggcaggcgcctgtagtcccagctacttcggaggctgaggcaggaatatcacttgaacccagaaggcagagcttgcagtgagctgagatcgtgccactgcactctagcctgggcgacacagcgagactccatctcaaaaaaaaaaaaaaaaaaaaaaaargatcaaaggaagtatcagctgtatctttatcacagatccagatcccccagtcccttcccaccactgctcaccaaattgtcagataatggagatcaaaaagggcaaagaatgaggaccatacctatagattattgctttggggtccaggaggcatggaaagagctgagcctcaggcaactctgaaagtagagcctgttccaggcttgtccaggctcccagactgctaagcctcagcagaaaatcttatattttctttgagaaaatgtctgaacattagagagctagagatgggcacagtac

SEQ ID NO: 71675 - DNA, 601 bp, Human
ggatcaggcctctttcccttcctcctttatccagtccactgatagaggtaaaggatatggaaaagaagaggccctaatccactgtcgggatcagagtcaggccatatttgaccagcataaaagctgtgccacctcaatctcaggtcccaatcccatgtccttgtctgtgcctaccggccaccctgtgctgctgggctgcccttcccaggagggtgccatggcagaagtaccctggctgagaatggggctgcagagggaggagcatcgtagggagggtgacaaaggtaggaagggtttgggstgtcttagcaaagacgtagttctggtgttttctacgctgagctcaaatttggcccttaaccttgggcctttcttcttacctcctcccttcatctcttccctctgtccgtgaggcccaaaaacctgaacatgccaaatggagtgcttattcctccaaggatggcctcacttgttcatcagagatcagagagagagagaaaggggccagtctgaatttgaatcaaaatattttctaagaaatcaatgatcttgctatcaagtgcataacaatagccaactcaggccaataaaggattgccca

SEQ ID NO: 71676 - DNA, 601 bp, Human
aatggggattaaaggccgggcgtcgtggctcaccctgttatcccagcactttgggaggccgaggtgggtggatcacctcaggtcaggagttcgagaccagcctggtcaacatggcaaaaccctgtctctactaaaaaatacaaaagttagctgggtgcagtggcaggcgcttgtaatcccagctactcgtgaggctgaggcaggagaatcacttgaacctgggaggcagaggttgcagtgagtggagattgcaccactgcactccagcctgggagacagagcaagactctgtctcaaaaamaaaaaaggggggggagtttaaaaacatatcaatggctggtcccagtggctcacgcctgtaatcccagcactttgggaggctaagacaggcagagcacctgaggtcaggagttggagaccagcctggccaacatagtgaaaccccgtctctactaaaaaatataaaaattagccaggcatggtgacaggtgcctgtaatccctgctacttgggaggctgaggcaagataatcacttgaacccaggaagcagaggttgcagtgagccgagatcgtgccactgctctccagcctgggtgacga

SEQ ID NO: 71677 - DNA, 601 bp, Human
gattaaaggccgggcgtcgtggctcaccctgttatcccagcactttgggaggccgaggtgggtggatcacctcaggtcaggagttcgagaccagcctggtcaacatggcaaaaccctgtctctactaaaaaatacaaaagttagctgggtgcagtggcaggcgcttgtaatcccagctactcgtgaggctgaggcaggagaatcacttgaacctgggaggcagaggttgcagtgagtggagattgcaccactgcactccagcctgggagacagagcaagactctgtctcaaaaaaaaaaarggggggggagtttaaaaacatatcaatggctggtcccagtggctcacgcctgtaatcccagcactttgggaggctaagacaggcagagcacctgaggtcaggagttggagaccagcctggccaacatagtgaaaccccgtctctactaaaaaatataaaaattagccaggcatggtgacaggtgcctgtaatccctgctacttgggaggctgaggcaagataatcacttgaacccaggaagcagaggttgcagtgagccgagatcgtgccactgctctccagcctgggtgacgagagcga

SEQ ID NO: 71678 - DNA, 601 bp, Human
gcgtgctttttccttgtcttgggactcttctttcacgttttaaaaatttctacatggcactgcccaacttcagttttctaaatagaatttggcaatgtgcctttcaatcagctgttcagtgggtgactttcagcatgcaaaagttcctacctgagggaagttgccattttgcaagacagaaaggcagtagaaataaaactttccaataggactgcatccaggttagctggaaacatctttctagttatccagcctgtcttccttcctcctgaagtgaggtaggagattccgtgacaaaacyttagattataaggaattcatggtgacagattgtgggaatcataaaactgaaaaccagaattcagatgcatttaaattcctgtttattaagaaagaggcacaccccttttcctgctgctttgcagactttatgatgacagggaaggaggaattaggtttctatatctgttcagcttcaaaacttctgcgtcttccctaactcgatcctgtcctgggcctttctcttttttttgaccaataaatgccatattattaatctctctaggaattgattttgatattgctgtcattgtctacttca

SEQ ID NO: 71679 - DNA, 601 bp, Human
gttgccattttgcaagacagaaaggcagtagaaataaaactttccaataggactgcatccaggttagctggaaacatctttctagttatccagcctgtcttccttcctcctgaagtgaggtaggagattccgtgacaaaaccttagattataaggaattcatggtgacagattgtgggaatcataaaactgaaaaccagaattcagatgcatttaaattcctgtttattaagaaagaggcacaccccttttcctgctgctttgcagactttatgatgacagggaaggaggaattaggtttytatatctgttcagcttcaaaacttctgcgtcttccctaactcgatcctgtcctgggcctttctcttttttttgaccaataaatgccatattattaatctctctaggaattgattttgatattgctgtcattgtctacttcaggtccactccactgagagacagtcaggaggagtgtagctttcaatgacaacagaagtcaataaaagaaaacccacatcaaagcaaacacaaatcctttattctgtctctctaggagtcaaaagtgatctcttgtttggcagttctactctgcttgttct

SEQ ID NO: 71680 - DNA, 601 bp, Human
cagagctctttcctctccaagagtttcctctccgtgcagtaccctggtgtgagtagaggcaggcccctttcttccaggcctcaccccttcccctttgtgtttttccaggtcgtgacatggcgagcaccactctgcctggttacccccctcacgtgccccccactggccagggaagctaccccacctccaccctggcaggaatggtgcctggtaggtgacaatgctgcagctgcctaatctaggtggggggaactaaattgtgggtgagctgctgaatggtctgtagtctgaggctggggtrgggggagacacaacgtcccctccctgcaaaccactgctattctgtccctctctctccttagaggctgcagttggtccctcatcctccctcatgagcaagccggggaggaagcttgcagaagtgcccccttgtgtgcaacccactgtatgtcatggcccctccacagcgcccacccacccaagtctgtgcccgaggagcactcagcctcagctccaccctcagtgcccagcccaccccagccagctgacactgcttggaagagcctgccctggtttccatggaaacttggagccaagaacc

SEQ ID NO: 71681 - DNA, 601 bp, Human; identical to SEQ ID NO: 71608

SEQ ID NO: 71682 - DNA, 601 bp, Human; identical to SEQ ID NO: 71609

SEQ ID NO: 71683 - DNA, 601 bp, Human; identical to SEQ ID NO: 71610

SEQ ID NO: 71684 - DNA, 601 bp, Human; identical to SEQ ID NO: 71611

SEQ ID NO: 71685 - DNA, 601 bp, Human; identical to SEQ ID NO: 71612

SEQ ID NO: 71686 - DNA, 601 bp, Human; identical to SEQ ID NO: 71613

SEQ ID NO: 71687 - DNA, 601 bp, Human; identical to SEQ ID NO: 71614

SEQ ID NO: 71688 - DNA, 601 bp, Human; identical to SEQ ID NO: 71615

SEQ ID NO: 71689 - DNA, 490 bp, Human; identical to SEQ ID NO: 71616

SEQ ID NO: 71690 - DNA, 601 bp, Human; identical to SEQ ID NO: 71617

SEQ ID NO: 71691 - DNA, 601 bp, Human; identical to SEQ ID NO: 71618

SEQ ID NO: 71692 - DNA, 601 bp, Human; identical to SEQ ID NO: 71619

SEQ ID NO: 71693 - DNA, 601 bp, Human; identical to SEQ ID NO: 71620

SEQ ID NO: 71694 - DNA, 601 bp, Human; identical to SEQ ID NO: 71621

SEQ ID NO: 71695 - DNA, 601 bp, Human; identical to SEQ ID NO: 71622

SEQ ID NO: 71696 - DNA, 601 bp, Human; identical to SEQ ID NO: 71623

SEQ ID NO: 71697 - DNA, 601 bp, Human; identical to SEQ ID NO: 71624

SEQ ID NO: 71698 - DNA, 601 bp, Human; identical to SEQ ID NO: 71625

SEQ ID NO: 71699 - DNA, 601 bp, Human; identical to SEQ ID NO: 71626

SEQ ID NO: 71700 - DNA, 601 bp, Human; identical to SEQ ID NO: 71627

SEQ ID NO: 71701 - DNA, 601 bp, Human; identical to SEQ ID NO: 71628

SEQ ID NO: 71702 - DNA, 601 bp, Human; identical to SEQ ID NO: 71629

SEQ ID NO: 71703 - DNA, 601 bp, Human; identical to SEQ ID NO: 71630

SEQ ID NO: 71704 - DNA, 601 bp, Human; identical to SEQ ID NO: 71631

SEQ ID NO: 71705 - DNA, 601 bp, Human; identical to SEQ ID NO: 71632

SEQ ID NO: 71706 - DNA, 601 bp, Human; identical to SEQ ID NO: 71633

SEQ ID NO: 71707 - DNA, 601 bp, Human; identical to SEQ ID NO: 71634

SEQ ID NO: 71708 - DNA, 601 bp, Human; identical to SEQ ID NO: 71635

SEQ ID NO: 71709 - DNA, 601 bp, Human; identical to SEQ ID NO: 71636

SEQ ID NO: 71710 - DNA, 601 bp, Human; identical to SEQ ID NO: 71637

SEQ ID NO: 71711 - DNA, 601 bp, Human; identical to SEQ ID NO: 71638

SEQ ID NO: 71712 - DNA, 601 bp, Human; identical to SEQ ID NO: 71639

SEQ ID NO: 71713 - DNA, 601 bp, Human; identical to SEQ ID NO: 71640

SEQ ID NO: 71714 - DNA, 601 bp, Human; identical to SEQ ID NO: 71641

SEQ ID NO: 71715 - DNA, 601 bp, Human; identical to SEQ ID NO: 71642

SEQ ID NO: 71716 - DNA, 601 bp, Human; identical to SEQ ID NO: 71643

SEQ ID NO: 71717 - DNA, 601 bp, Human; identical to SEQ ID NO: 71644

SEQ ID NO: 71718 - DNA, 601 bp, Human; identical to SEQ ID NO: 71645

SEQ ID NO: 71719 - DNA, 601 bp, Human; identical to SEQ ID NO: 71646

SEQ ID NO: 71720 - DNA, 601 bp, Human; identical to SEQ ID NO: 71647

SEQ ID NO: 71721 - DNA, 601 bp, Human; identical to SEQ ID NO: 71648

SEQ ID NO: 71722 - DNA, 601 bp, Human; identical to SEQ ID NO: 71649

SEQ ID NO: 71723 - DNA, 601 bp, Human; identical to SEQ ID NO: 71650

SEQ ID NO: 71724 - DNA, 601 bp, Human; identical to SEQ ID NO: 71651

SEQ ID NO: 71725 - DNA, 601 bp, Human; identical to SEQ ID NO: 71652

SEQ ID NO: 71726 - DNA, 601 bp, Human; identical to SEQ ID NO: 71653

SEQ ID NO: 71727 - DNA, 601 bp, Human; identical to SEQ ID NO: 71654

SEQ ID NO: 71728 - DNA, 601 bp, Human; identical to SEQ ID NO: 71655

SEQ ID NO: 71729 - DNA, 601 bp, Human; identical to SEQ ID NO: 71656

SEQ ID NO: 71730 - DNA, 601 bp, Human; identical to SEQ ID NO: 71657

SEQ ID NO: 71731 - DNA, 601 bp, Human; identical to SEQ ID NO: 71658

SEQ ID NO: 71732 - DNA, 601 bp, Human; identical to SEQ ID NO: 71659

SEQ ID NO: 71733 - DNA, 601 bp, Human; identical to SEQ ID NO: 71660

SEQ ID NO: 71734 - DNA, 601 bp, Human; identical to SEQ ID NO: 71661

SEQ ID NO: 71735 - DNA, 601 bp, Human; identical to SEQ ID NO: 71662

SEQ ID NO: 71736 - DNA, 601 bp, Human; identical to SEQ ID NO: 71663

SEQ ID NO: 71737 - DNA, 601 bp, Human; identical to SEQ ID NO: 71664

SEQ ID NO: 71738 - DNA, 601 bp, Human; identical to SEQ ID NO: 71665

SEQ ID NO: 71739 - DNA, 601 bp, Human; identical to SEQ ID NO: 71666

SEQ ID NO: 71740 - DNA, 601 bp, Human; identical to SEQ ID NO: 71667

SEQ ID NO: 71741 - DNA, 601 bp, Human; identical to SEQ ID NO: 71668

SEQ ID NO: 71742 - DNA, 601 bp, Human; identical to SEQ ID NO: 71669

SEQ ID NO: 71743 - DNA, 601 bp, Human; identical to SEQ ID NO: 71670

SEQ ID NO: 71744 - DNA, 601 bp, Human; identical to SEQ ID NO: 71671

SEQ ID NO: 71745 - DNA, 601 bp, Human; identical to SEQ ID NO: 71672

SEQ ID NO: 71746 - DNA, 601 bp, Human; identical to SEQ ID NO: 71673

SEQ ID NO: 71747 - DNA, 601 bp, Human; identical to SEQ ID NO: 71674

SEQ ID NO: 71748 - DNA, 601 bp, Human; identical to SEQ ID NO: 71675

SEQ ID NO: 71749 - DNA, 601 bp, Human; identical to SEQ ID NO: 71676

SEQ ID NO: 71750 - DNA, 601 bp, Human; identical to SEQ ID NO: 71677

SEQ ID NO: 71751 - DNA, 601 bp, Human; identical to SEQ ID NO: 71678

SEQ ID NO: 71752 - DNA, 601 bp, Human; identical to SEQ ID NO: 71679

SEQ ID NO: 71753 - DNA, 601 bp, Human; identical to SEQ ID NO: 71680

SEQ ID NO: 71754 - DNA, 601 bp, Human; identical to SEQ ID NO: 71608

SEQ ID NO: 71755 - DNA, 601 bp, Human; identical to SEQ ID NO: 71609

SEQ ID NO: 71756 - DNA, 601 bp, Human; identical to SEQ ID NO: 71610

SEQ ID NO: 71757 - DNA, 601 bp, Human; identical to SEQ ID NO: 71611

SEQ ID NO: 71758 - DNA, 601 bp, Human; identical to SEQ ID NO: 71612

SEQ ID NO: 71759 - DNA, 601 bp, Human; identical to SEQ ID NO: 71613

SEQ ID NO: 71760 - DNA, 601 bp, Human; identical to SEQ ID NO: 71614

SEQ ID NO: 71761 - DNA, 601 bp, Human; identical to SEQ ID NO: 71615

SEQ ID NO: 71762 - DNA, 490 bp, Human; identical to SEQ ID NO: 71616

SEQ ID NO: 71763 - DNA, 601 bp, Human; identical to SEQ ID NO: 71617

SEQ ID NO: 71764 - DNA, 601 bp, Human; identical to SEQ ID NO: 71618

SEQ ID NO: 71765 - DNA, 601 bp, Human; identical to SEQ ID NO: 71619

SEQ ID NO: 71766 - DNA, 601 bp, Human; identical to SEQ ID NO: 71620

SEQ ID NO: 71767 - DNA, 601 bp, Human; identical to SEQ ID NO: 71621

SEQ ID NO: 71768 - DNA, 601 bp, Human; identical to SEQ ID NO: 71622

SEQ ID NO: 71769 - DNA, 601 bp, Human; identical to SEQ ID NO: 71623

SEQ ID NO: 71770 - DNA, 601 bp, Human; identical to SEQ ID NO: 71624

SEQ ID NO: 71771 - DNA, 601 bp, Human; identical to SEQ ID NO: 71625

SEQ ID NO: 71772 - DNA, 601 bp, Human; identical to SEQ ID NO: 71626

SEQ ID NO: 71773 - DNA, 601 bp, Human; identical to SEQ ID NO: 71627

SEQ ID NO: 71774 - DNA, 601 bp, Human; identical to SEQ ID NO: 71628

SEQ ID NO: 71775 - DNA, 601 bp, Human; identical to SEQ ID NO: 71629

SEQ ID NO: 71776 - DNA, 601 bp, Human; identical to SEQ ID NO: 71630

SEQ ID NO: 71777 - DNA, 601 bp, Human; identical to SEQ ID NO: 71631

SEQ ID NO: 71778 - DNA, 601 bp, Human; identical to SEQ ID NO: 71632

SEQ ID NO: 71779 - DNA, 601 bp, Human; identical to SEQ ID NO: 71633

SEQ ID NO: 71780 - DNA, 601 bp, Human; identical to SEQ ID NO: 71634

SEQ ID NO: 71781 - DNA, 601 bp, Human; identical to SEQ ID NO: 71635

SEQ ID NO: 71782 - DNA, 601 bp, Human; identical to SEQ ID NO: 71636

SEQ ID NO: 71783 - DNA, 601 bp, Human; identical to SEQ ID NO: 71637

SEQ ID NO: 71784 - DNA, 601 bp, Human; identical to SEQ ID NO: 71638

SEQ ID NO: 71785 - DNA, 601 bp, Human; identical to SEQ ID NO: 71639

SEQ ID NO: 71786 - DNA, 601 bp, Human; identical to SEQ ID NO: 71640

SEQ ID NO: 71787 - DNA, 601 bp, Human; identical to SEQ ID NO: 71641

SEQ ID NO: 71788 - DNA, 601 bp, Human; identical to SEQ ID NO: 71642

SEQ ID NO: 71789 - DNA, 601 bp, Human; identical to SEQ ID NO: 71643

SEQ ID NO: 71790 - DNA, 601 bp, Human; identical to SEQ ID NO: 71644

SEQ ID NO: 71791 - DNA, 601 bp, Human; identical to SEQ ID NO: 71645

SEQ ID NO: 71792 - DNA, 601 bp, Human; identical to SEQ ID NO: 71646

SEQ ID NO: 71793 - DNA, 601 bp, Human; identical to SEQ ID NO: 71647

SEQ ID NO: 71794 - DNA, 601 bp, Human; identical to SEQ ID NO: 71648

SEQ ID NO: 71795 - DNA, 601 bp, Human; identical to SEQ ID NO: 71649

SEQ ID NO: 71796 - DNA, 601 bp, Human; identical to SEQ ID NO: 71650

SEQ ID NO: 71797 - DNA, 601 bp, Human; identical to SEQ ID NO: 71651

SEQ ID NO: 71798 - DNA, 601 bp, Human; identical to SEQ ID NO: 71652

SEQ ID NO: 71799 - DNA, 601 bp, Human; identical to SEQ ID NO: 71653

SEQ ID NO: 71800 - DNA, 601 bp, Human; identical to SEQ ID NO: 71654

SEQ ID NO: 71801 - DNA, 601 bp, Human; identical to SEQ ID NO: 71655

SEQ ID NO: 71802 - DNA, 601 bp, Human; identical to SEQ ID NO: 71656

SEQ ID NO: 71803 - DNA, 601 bp, Human; identical to SEQ ID NO: 71657

SEQ ID NO: 71804 - DNA, 601 bp, Human; identical to SEQ ID NO: 71658

SEQ ID NO: 71805 - DNA, 601 bp, Human; identical to SEQ ID NO: 71659

SEQ ID NO: 71806 - DNA, 601 bp, Human; identical to SEQ ID NO: 71660

SEQ ID NO: 71807 - DNA, 601 bp, Human; identical to SEQ ID NO: 71661

SEQ ID NO: 71808 - DNA, 601 bp, Human; identical to SEQ ID NO: 71662

SEQ ID NO: 71809 - DNA, 601 bp, Human; identical to SEQ ID NO: 71663

SEQ ID NO: 71810 - DNA, 601 bp, Human; identical to SEQ ID NO: 71664

SEQ ID NO: 71811 - DNA, 601 bp, Human; identical to SEQ ID NO: 71665

SEQ ID NO: 71812 - DNA, 601 bp, Human; identical to SEQ ID NO: 71666

SEQ ID NO: 71813 - DNA, 601 bp, Human; identical to SEQ ID NO: 71667

SEQ ID NO: 71814 - DNA, 601 bp, Human; identical to SEQ ID NO: 71668

SEQ ID NO: 71815 - DNA, 601 bp, Human; identical to SEQ ID NO: 71669

SEQ ID NO: 71816 - DNA, 601 bp, Human; identical to SEQ ID NO: 71670

SEQ ID NO: 71817 - DNA, 601 bp, Human; identical to SEQ ID NO: 71671

SEQ ID NO: 71818 - DNA, 601 bp, Human; identical to SEQ ID NO: 71672

SEQ ID NO: 71819 - DNA, 601 bp, Human; identical to SEQ ID NO: 71673

SEQ ID NO: 71820 - DNA, 601 bp, Human; identical to SEQ ID NO: 71674

SEQ ID NO: 71821 - DNA, 601 bp, Human; identical to SEQ ID NO: 71675

SEQ ID NO: 71822 - DNA, 601 bp, Human; identical to SEQ ID NO: 71676

SEQ ID NO: 71823 - DNA, 601 bp, Human; identical to SEQ ID NO: 71677

SEQ ID NO: 71824 - DNA, 601 bp, Human; identical to SEQ ID NO: 71678

SEQ ID NO: 71825 - DNA, 601 bp, Human; identical to SEQ ID NO: 71679

SEQ ID NO: 71826 - DNA, 601 bp, Human; identical to SEQ ID NO: 71680

SEQ ID NO: 71827 - DNA, 601 bp, Human; identical to SEQ ID NO: 71608

SEQ ID NO: 71828 - DNA, 601 bp, Human; identical to SEQ ID NO: 71609

SEQ ID NO: 71829 - DNA, 601 bp, Human; identical to SEQ ID NO: 71610

SEQ ID NO: 71830 - DNA, 601 bp, Human; identical to SEQ ID NO: 71611

SEQ ID NO: 71831 - DNA, 601 bp, Human; identical to SEQ ID NO: 71612

SEQ ID NO: 71832 - DNA, 601 bp, Human; identical to SEQ ID NO: 71613

SEQ ID NO: 71833 - DNA, 601 bp, Human; identical to SEQ ID NO: 71614

SEQ ID NO: 71834 - DNA, 601 bp, Human; identical to SEQ ID NO: 71615

SEQ ID NO: 71835 - DNA, 490 bp, Human; identical to SEQ ID NO: 71616

SEQ ID NO: 71836 - DNA, 601 bp, Human; identical to SEQ ID NO: 71617

SEQ ID NO: 71837 - DNA, 601 bp, Human; identical to SEQ ID NO: 71618

SEQ ID NO: 71838 - DNA, 601 bp, Human; identical to SEQ ID NO: 71619

SEQ ID NO: 71839 - DNA, 601 bp, Human; identical to SEQ ID NO: 71620

SEQ ID NO: 71840 - DNA, 601 bp, Human; identical to SEQ ID NO: 71621

SEQ ID NO: 71841 - DNA, 601 bp, Human; identical to SEQ ID NO: 71622

SEQ ID NO: 71842 - DNA, 601 bp, Human; identical to SEQ ID NO: 71623

SEQ ID NO: 71843 - DNA, 601 bp, Human; identical to SEQ ID NO: 71624

SEQ ID NO: 71844 - DNA, 601 bp, Human; identical to SEQ ID NO: 71625

SEQ ID NO: 71845 - DNA, 601 bp, Human; identical to SEQ ID NO: 71626

SEQ ID NO: 71846 - DNA, 601 bp, Human; identical to SEQ ID NO: 71627

SEQ ID NO: 71847 - DNA, 601 bp, Human; identical to SEQ ID NO: 71628

SEQ ID NO: 71848 - DNA, 601 bp, Human; identical to SEQ ID NO: 71629

SEQ ID NO: 71849 - DNA, 601 bp, Human; identical to SEQ ID NO: 71630

SEQ ID NO: 71850 - DNA, 601 bp, Human; identical to SEQ ID NO: 71631

SEQ ID NO: 71851 - DNA, 601 bp, Human; identical to SEQ ID NO: 71632

SEQ ID NO: 71852 - DNA, 601 bp, Human; identical to SEQ ID NO: 71633

SEQ ID NO: 71853 - DNA, 601 bp, Human; identical to SEQ ID NO: 71634

SEQ ID NO: 71854 - DNA, 601 bp, Human; identical to SEQ ID NO: 71635

SEQ ID NO: 71855 - DNA, 601 bp, Human; identical to SEQ ID NO: 71636

SEQ ID NO: 71856 - DNA, 601 bp, Human; identical to SEQ ID NO: 71637

SEQ ID NO: 71857 - DNA, 601 bp, Human; identical to SEQ ID NO: 71638

SEQ ID NO: 71858 - DNA, 601 bp, Human; identical to SEQ ID NO: 71639

SEQ ID NO: 71859 - DNA, 601 bp, Human; identical to SEQ ID NO: 71640

SEQ ID NO: 71860 - DNA, 601 bp, Human; identical to SEQ ID NO: 71641

SEQ ID NO: 71861 - DNA, 601 bp, Human; identical to SEQ ID NO: 71642

SEQ ID NO: 71862 - DNA, 601 bp, Human; identical to SEQ ID NO: 71643

SEQ ID NO: 71863 - DNA, 601 bp, Human; identical to SEQ ID NO: 71644

SEQ ID NO: 71864 - DNA, 601 bp, Human; identical to SEQ ID NO: 71645

SEQ ID NO: 71865 - DNA, 601 bp, Human; identical to SEQ ID NO: 71646

SEQ ID NO: 71866 - DNA, 601 bp, Human; identical to SEQ ID NO: 71647

SEQ ID NO: 71867 - DNA, 601 bp, Human; identical to SEQ ID NO: 71648

SEQ ID NO: 71868 - DNA, 601 bp, Human; identical to SEQ ID NO: 71649

SEQ ID NO: 71869 - DNA, 601 bp, Human; identical to SEQ ID NO: 71650

SEQ ID NO: 71870 - DNA, 601 bp, Human; identical to SEQ ID NO: 71651

SEQ ID NO: 71871 - DNA, 601 bp, Human; identical to SEQ ID NO: 71652

SEQ ID NO: 71872 - DNA, 601 bp, Human; identical to SEQ ID NO: 71653

SEQ ID NO: 71873 - DNA, 601 bp, Human; identical to SEQ ID NO: 71654

SEQ ID NO: 71874 - DNA, 601 bp, Human; identical to SEQ ID NO: 71655

SEQ ID NO: 71875 - DNA, 601 bp, Human; identical to SEQ ID NO: 71656

SEQ ID NO: 71876 - DNA, 601 bp, Human; identical to SEQ ID NO: 71657

SEQ ID NO: 71877 - DNA, 601 bp, Human; identical to SEQ ID NO: 71658

SEQ ID NO: 71878 - DNA, 601 bp, Human; identical to SEQ ID NO: 71659

SEQ ID NO: 71879 - DNA, 601 bp, Human; identical to SEQ ID NO: 71660

SEQ ID NO: 71880 - DNA, 601 bp, Human; identical to SEQ ID NO: 71661

SEQ ID NO: 71881 - DNA, 601 bp, Human; identical to SEQ ID NO: 71662

SEQ ID NO: 71882 - DNA, 601 bp, Human; identical to SEQ ID NO: 71663

SEQ ID NO: 71883 - DNA, 601 bp, Human; identical to SEQ ID NO: 71664

SEQ ID NO: 71884 - DNA, 601 bp, Human; identical to SEQ ID NO: 71665

SEQ ID NO: 71885 - DNA, 601 bp, Human; identical to SEQ ID NO: 71666

SEQ ID NO: 71886 - DNA, 601 bp, Human; identical to SEQ ID NO: 71667

SEQ ID NO: 71887 - DNA, 601 bp, Human; identical to SEQ ID NO: 71668

SEQ ID NO: 71888 - DNA, 601 bp, Human; identical to SEQ ID NO: 71669

SEQ ID NO: 71889 - DNA, 601 bp, Human; identical to SEQ ID NO: 71670

SEQ ID NO: 71890 - DNA, 601 bp, Human; identical to SEQ ID NO: 71671

SEQ ID NO: 71891 - DNA, 601 bp, Human; identical to SEQ ID NO: 71672

SEQ ID NO: 71892 - DNA, 601 bp, Human; identical to SEQ ID NO: 71673

SEQ ID NO: 71893 - DNA, 601 bp, Human; identical to SEQ ID NO: 71674

SEQ ID NO: 71894 - DNA, 601 bp, Human; identical to SEQ ID NO: 71675

SEQ ID NO: 71895 - DNA, 601 bp, Human; identical to SEQ ID NO: 71676

SEQ ID NO: 71896 - DNA, 601 bp, Human; identical to SEQ ID NO: 71677

SEQ ID NO: 71897 - DNA, 601 bp, Human; identical to SEQ ID NO: 71678

SEQ ID NO: 71898 - DNA, 601 bp, Human; identical to SEQ ID NO: 71679

SEQ ID NO: 71899 - DNA, 601 bp, Human; identical to SEQ ID NO: 71680

SEQ ID NO: 71900 - DNA, 601 bp, Human; identical to SEQ ID NO: 71608

SEQ ID NO: 71901 - DNA, 601 bp, Human; identical to SEQ ID NO: 71609

SEQ ID NO: 71902 - DNA, 601 bp, Human; identical to SEQ ID NO: 71610

SEQ ID NO: 71903 - DNA, 601 bp, Human; identical to SEQ ID NO: 71611

SEQ ID NO: 71904 - DNA, 601 bp, Human; identical to SEQ ID NO: 71612

SEQ ID NO: 71905 - DNA, 601 bp, Human; identical to SEQ ID NO: 71613

SEQ ID NO: 71906 - DNA, 601 bp, Human; identical to SEQ ID NO: 71614

SEQ ID NO: 71907 - DNA, 601 bp, Human; identical to SEQ ID NO: 71615

SEQ ID NO: 71908 - DNA, 490 bp, Human; identical to SEQ ID NO: 71616

SEQ ID NO: 71909 - DNA, 601 bp, Human; identical to SEQ ID NO: 71617

SEQ ID NO: 71910 - DNA, 601 bp, Human; identical to SEQ ID NO: 71618

SEQ ID NO: 71911 - DNA, 601 bp, Human; identical to SEQ ID NO: 71619

SEQ ID NO: 71912 - DNA, 601 bp, Human; identical to SEQ ID NO: 71620

SEQ ID NO: 71913 - DNA, 601 bp, Human; identical to SEQ ID NO: 71621

SEQ ID NO: 71914 - DNA, 601 bp, Human; identical to SEQ ID NO: 71622

SEQ ID NO: 71915 - DNA, 601 bp, Human; identical to SEQ ID NO: 71623

SEQ ID NO: 71916 - DNA, 601 bp, Human; identical to SEQ ID NO: 71624

SEQ ID NO: 71917 - DNA, 601 bp, Human; identical to SEQ ID NO: 71625

SEQ ID NO: 71918 - DNA, 601 bp, Human; identical to SEQ ID NO: 71626

SEQ ID NO: 71919 - DNA, 601 bp, Human; identical to SEQ ID NO: 71627

SEQ ID NO: 71920 - DNA, 601 bp, Human; identical to SEQ ID NO: 71628

SEQ ID NO: 71921 - DNA, 601 bp, Human; identical to SEQ ID NO: 71629

SEQ ID NO: 71922 - DNA, 601 bp, Human; identical to SEQ ID NO: 71630

SEQ ID NO: 71923 - DNA, 601 bp, Human; identical to SEQ ID NO: 71631

SEQ ID NO: 71924 - DNA, 601 bp, Human; identical to SEQ ID NO: 71632

SEQ ID NO: 71925 - DNA, 601 bp, Human; identical to SEQ ID NO: 71633

SEQ ID NO: 71926 - DNA, 601 bp, Human; identical to SEQ ID NO: 71634

SEQ ID NO: 71927 - DNA, 601 bp, Human; identical to SEQ ID NO: 71635

SEQ ID NO: 71928 - DNA, 601 bp, Human; identical to SEQ ID NO: 71636

SEQ ID NO: 71929 - DNA, 601 bp, Human; identical to SEQ ID NO: 71637

SEQ ID NO: 71930 - DNA, 601 bp, Human; identical to SEQ ID NO: 71638

SEQ ID NO: 71931 - DNA, 601 bp, Human; identical to SEQ ID NO: 71639

SEQ ID NO: 71932 - DNA, 601 bp, Human; identical to SEQ ID NO: 71640

SEQ ID NO: 71933 - DNA, 601 bp, Human; identical to SEQ ID NO: 71641

SEQ ID NO: 71934 - DNA, 601 bp, Human; identical to SEQ ID NO: 71642

SEQ ID NO: 71935 - DNA, 601 bp, Human; identical to SEQ ID NO: 71643

SEQ ID NO: 71936 - DNA, 601 bp, Human; identical to SEQ ID NO: 71644

SEQ ID NO: 71937 - DNA, 601 bp, Human; identical to SEQ ID NO: 71645

SEQ ID NO: 71938 - DNA, 601 bp, Human; identical to SEQ ID NO: 71646

SEQ ID NO: 71939 - DNA, 601 bp, Human; identical to SEQ ID NO: 71647

SEQ ID NO: 71940 - DNA, 601 bp, Human; identical to SEQ ID NO: 71648

SEQ ID NO: 71941 - DNA, 601 bp, Human; identical to SEQ ID NO: 71649

SEQ ID NO: 71942 - DNA, 601 bp, Human; identical to SEQ ID NO: 71650

SEQ ID NO: 71943 - DNA, 601 bp, Human; identical to SEQ ID NO: 71651

SEQ ID NO: 71944 - DNA, 601 bp, Human; identical to SEQ ID NO: 71652

SEQ ID NO: 71945 - DNA, 601 bp, Human; identical to SEQ ID NO: 71653

SEQ ID NO: 71946 - DNA, 601 bp, Human; identical to SEQ ID NO: 71654

SEQ ID NO: 71947 - DNA, 601 bp, Human; identical to SEQ ID NO: 71655

SEQ ID NO: 71948 - DNA, 601 bp, Human; identical to SEQ ID NO: 71656

SEQ ID NO: 71949 - DNA, 601 bp, Human; identical to SEQ ID NO: 71657

SEQ ID NO: 71950 - DNA, 601 bp, Human; identical to SEQ ID NO: 71658

SEQ ID NO: 71951 - DNA, 601 bp, Human; identical to SEQ ID NO: 71659

SEQ ID NO: 71952 - DNA, 601 bp, Human; identical to SEQ ID NO: 71660

SEQ ID NO: 71953 - DNA, 601 bp, Human; identical to SEQ ID NO: 71661

SEQ ID NO: 71954 - DNA, 601 bp, Human; identical to SEQ ID NO: 71662

SEQ ID NO: 71955 - DNA, 601 bp, Human; identical to SEQ ID NO: 71663

SEQ ID NO: 71956 - DNA, 601 bp, Human; identical to SEQ ID NO: 71664

SEQ ID NO: 71957 - DNA, 601 bp, Human; identical to SEQ ID NO: 71665

SEQ ID NO: 71958 - DNA, 601 bp, Human; identical to SEQ ID NO: 71666

SEQ ID NO: 71959 - DNA, 601 bp, Human; identical to SEQ ID NO: 71667

SEQ ID NO: 71960 - DNA, 601 bp, Human; identical to SEQ ID NO: 71668

SEQ ID NO: 71961 - DNA, 601 bp, Human; identical to SEQ ID NO: 71669

SEQ ID NO: 71962 - DNA, 601 bp, Human; identical to SEQ ID NO: 71670

SEQ ID NO: 71963 - DNA, 601 bp, Human; identical to SEQ ID NO: 71671

SEQ ID NO: 71964 - DNA, 601 bp, Human; identical to SEQ ID NO: 71672

SEQ ID NO: 71965 - DNA, 601 bp, Human; identical to SEQ ID NO: 71673

SEQ ID NO: 71966 - DNA, 601 bp, Human; identical to SEQ ID NO: 71674

SEQ ID NO: 71967 - DNA, 601 bp, Human; identical to SEQ ID NO: 71675

SEQ ID NO: 71968 - DNA, 601 bp, Human; identical to SEQ ID NO: 71676

SEQ ID NO: 71969 - DNA, 601 bp, Human; identical to SEQ ID NO: 71677

SEQ ID NO: 71970 - DNA, 601 bp, Human; identical to SEQ ID NO: 71678

SEQ ID NO: 71971 - DNA, 601 bp, Human; identical to SEQ ID NO: 71679

SEQ ID NO: 71972 - DNA, 601 bp, Human; identical to SEQ ID NO: 71680

SEQ ID NO: 71973 - DNA, 601 bp, Human; identical to SEQ ID NO: 71608

SEQ ID NO: 71974 - DNA, 601 bp, Human; identical to SEQ ID NO: 71609

SEQ ID NO: 71975 - DNA, 601 bp, Human; identical to SEQ ID NO: 71610

SEQ ID NO: 71976 - DNA, 601 bp, Human; identical to SEQ ID NO: 71611

SEQ ID NO: 71977 - DNA, 601 bp, Human; identical to SEQ ID NO: 71612

SEQ ID NO: 71978 - DNA, 601 bp, Human; identical to SEQ ID NO: 71613

SEQ ID NO: 71979 - DNA, 601 bp, Human; identical to SEQ ID NO: 71614

SEQ ID NO: 71980 - DNA, 601 bp, Human; identical to SEQ ID NO: 71615

SEQ ID NO: 71981 - DNA, 490 bp, Human; identical to SEQ ID NO: 71616

SEQ ID NO: 71982 - DNA, 601 bp, Human; identical to SEQ ID NO: 71617

SEQ ID NO: 71983 - DNA, 601 bp, Human; identical to SEQ ID NO: 71618

SEQ ID NO: 71984 - DNA, 601 bp, Human; identical to SEQ ID NO: 71619

SEQ ID NO: 71985 - DNA, 601 bp, Human; identical to SEQ ID NO: 71620

SEQ ID NO: 71986 - DNA, 601 bp, Human; identical to SEQ ID NO: 71621

SEQ ID NO: 71987 - DNA, 601 bp, Human; identical to SEQ ID NO: 71622

SEQ ID NO: 71988 - DNA, 601 bp, Human; identical to SEQ ID NO: 71623

SEQ ID NO: 71989 - DNA, 601 bp, Human; identical to SEQ ID NO: 71624

SEQ ID NO: 71990 - DNA, 601 bp, Human; identical to SEQ ID NO: 71625

SEQ ID NO: 71991 - DNA, 601 bp, Human; identical to SEQ ID NO: 71626

SEQ ID NO: 71992 - DNA, 601 bp, Human; identical to SEQ ID NO: 71627

SEQ ID NO: 71993 - DNA, 601 bp, Human; identical to SEQ ID NO: 71628

SEQ ID NO: 71994 - DNA, 601 bp, Human; identical to SEQ ID NO: 71629

SEQ ID NO: 71995 - DNA, 601 bp, Human; identical to SEQ ID NO: 71630

SEQ ID NO: 71996 - DNA, 601 bp, Human; identical to SEQ ID NO: 71631

SEQ ID NO: 71997 - DNA, 601 bp, Human; identical to SEQ ID NO: 71632

SEQ ID NO: 71998 - DNA, 601 bp, Human; identical to SEQ ID NO: 71633

SEQ ID NO: 71999 - DNA, 601 bp, Human; identical to SEQ ID NO: 71634

SEQ ID NO: 72000 - DNA, 601 bp, Human; identical to SEQ ID NO: 71635

SEQ ID NO: 72001 - DNA, 601 bp, Human; identical to SEQ ID NO: 71636

SEQ ID NO: 72002 - DNA, 601 bp, Human; identical to SEQ ID NO: 71637

SEQ ID NO: 72003 - DNA, 601 bp, Human; identical to SEQ ID NO: 71638

SEQ ID NO: 72004 - DNA, 601 bp, Human; identical to SEQ ID NO: 71639

SEQ ID NO: 72005 - DNA, 601 bp, Human; identical to SEQ ID NO: 71640

SEQ ID NO: 72006 - DNA, 601 bp, Human; identical to SEQ ID NO: 71641

SEQ ID NO: 72007 - DNA, 601 bp, Human; identical to SEQ ID NO: 71642

SEQ ID NO: 72008 - DNA, 601 bp, Human; identical to SEQ ID NO: 71643

SEQ ID NO: 72009 - DNA, 601 bp, Human; identical to SEQ ID NO: 71644

SEQ ID NO: 72010 - DNA, 601 bp, Human; identical to SEQ ID NO: 71645

SEQ ID NO: 72011 - DNA, 601 bp, Human; identical to SEQ ID NO: 71646

SEQ ID NO: 72012 - DNA, 601 bp, Human; identical to SEQ ID NO: 71647

SEQ ID NO: 72013 - DNA, 601 bp, Human; identical to SEQ ID NO: 71648

SEQ ID NO: 72014 - DNA, 601 bp, Human; identical to SEQ ID NO: 71649

SEQ ID NO: 72015 - DNA, 601 bp, Human; identical to SEQ ID NO: 71650

SEQ ID NO: 72016 - DNA, 601 bp, Human; identical to SEQ ID NO: 71651

SEQ ID NO: 72017 - DNA, 601 bp, Human; identical to SEQ ID NO: 71652

SEQ ID NO: 72018 - DNA, 601 bp, Human; identical to SEQ ID NO: 71653

SEQ ID NO: 72019 - DNA, 601 bp, Human; identical to SEQ ID NO: 71654

SEQ ID NO: 72020 - DNA, 601 bp, Human; identical to SEQ ID NO: 71655

SEQ ID NO: 72021 - DNA, 601 bp, Human; identical to SEQ ID NO: 71656

SEQ ID NO: 72022 - DNA, 601 bp, Human; identical to SEQ ID NO: 71657

SEQ ID NO: 72023 - DNA, 601 bp, Human; identical to SEQ ID NO: 71658

SEQ ID NO: 72024 - DNA, 601 bp, Human; identical to SEQ ID NO: 71659

SEQ ID NO: 72025 - DNA, 601 bp, Human; identical to SEQ ID NO: 71660

SEQ ID NO: 72026 - DNA, 601 bp, Human; identical to SEQ ID NO: 71661

SEQ ID NO: 72027 - DNA, 601 bp, Human; identical to SEQ ID NO: 71662

SEQ ID NO: 72028 - DNA, 601 bp, Human; identical to SEQ ID NO: 71663

SEQ ID NO: 72029 - DNA, 601 bp, Human; identical to SEQ ID NO: 71664

SEQ ID NO: 72030 - DNA, 601 bp, Human; identical to SEQ ID NO: 71665

SEQ ID NO: 72031 - DNA, 601 bp, Human; identical to SEQ ID NO: 71666

SEQ ID NO: 72032 - DNA, 601 bp, Human; identical to SEQ ID NO: 71667

SEQ ID NO: 72033 - DNA, 601 bp, Human; identical to SEQ ID NO: 71668

SEQ ID NO: 72034 - DNA, 601 bp, Human; identical to SEQ ID NO: 71669

SEQ ID NO: 72035 - DNA, 601 bp, Human; identical to SEQ ID NO: 71670

SEQ ID NO: 72036 - DNA, 601 bp, Human; identical to SEQ ID NO: 71671

SEQ ID NO: 72037 - DNA, 601 bp, Human; identical to SEQ ID NO: 71672

SEQ ID NO: 72038 - DNA, 601 bp, Human; identical to SEQ ID NO: 71673

SEQ ID NO: 72039 - DNA, 601 bp, Human; identical to SEQ ID NO: 71674

SEQ ID NO: 72040 - DNA, 601 bp, Human; identical to SEQ ID NO: 71675

SEQ ID NO: 72041 - DNA, 601 bp, Human; identical to SEQ ID NO: 71676

SEQ ID NO: 72042 - DNA, 601 bp, Human; identical to SEQ ID NO: 71677

SEQ ID NO: 72043 - DNA, 601 bp, Human; identical to SEQ ID NO: 71678

SEQ ID NO: 72044 - DNA, 601 bp, Human; identical to SEQ ID NO: 71679

SEQ ID NO: 72045 - DNA, 601 bp, Human; identical to SEQ ID NO: 71680

SEQ ID NO: 72046 - DNA, 601 bp, Human; identical to SEQ ID NO: 71608

SEQ ID NO: 72047 - DNA, 601 bp, Human; identical to SEQ ID NO: 71609

SEQ ID NO: 72048 - DNA, 601 bp, Human; identical to SEQ ID NO: 71610

SEQ ID NO: 72049 - DNA, 601 bp, Human; identical to SEQ ID NO: 71611

SEQ ID NO: 72050 - DNA, 601 bp, Human; identical to SEQ ID NO: 71612

SEQ ID NO: 72051 - DNA, 601 bp, Human; identical to SEQ ID NO: 71613

SEQ ID NO: 72052 - DNA, 601 bp, Human; identical to SEQ ID NO: 71614

SEQ ID NO: 72053 - DNA, 601 bp, Human; identical to SEQ ID NO: 71615

SEQ ID NO: 72054 - DNA, 490 bp, Human; identical to SEQ ID NO: 71616

SEQ ID NO: 72055 - DNA, 601 bp, Human; identical to SEQ ID NO: 71617

SEQ ID NO: 72056 - DNA, 601 bp, Human; identical to SEQ ID NO: 71618

SEQ ID NO: 72057 - DNA, 601 bp, Human; identical to SEQ ID NO: 71619

SEQ ID NO: 72058 - DNA, 601 bp, Human; identical to SEQ ID NO: 71620

SEQ ID NO: 72059 - DNA, 601 bp, Human; identical to SEQ ID NO: 71621

SEQ ID NO: 72060 - DNA, 601 bp, Human; identical to SEQ ID NO: 71622

SEQ ID NO: 72061 - DNA, 601 bp, Human; identical to SEQ ID NO: 71623

SEQ ID NO: 72062 - DNA, 601 bp, Human; identical to SEQ ID NO: 71624

SEQ ID NO: 72063 - DNA, 601 bp, Human; identical to SEQ ID NO: 71625

SEQ ID NO: 72064 - DNA, 601 bp, Human; identical to SEQ ID NO: 71626

SEQ ID NO: 72065 - DNA, 601 bp, Human; identical to SEQ ID NO: 71627

SEQ ID NO: 72066 - DNA, 601 bp, Human; identical to SEQ ID NO: 71628

SEQ ID NO: 72067 - DNA, 601 bp, Human; identical to SEQ ID NO: 71629

SEQ ID NO: 72068 - DNA, 601 bp, Human; identical to SEQ ID NO: 71630

SEQ ID NO: 72069 - DNA, 601 bp, Human; identical to SEQ ID NO: 71631

SEQ ID NO: 72070 - DNA, 601 bp, Human; identical to SEQ ID NO: 71632

SEQ ID NO: 72071 - DNA, 601 bp, Human; identical to SEQ ID NO: 71633

SEQ ID NO: 72072 - DNA, 601 bp, Human; identical to SEQ ID NO: 71634

SEQ ID NO: 72073 - DNA, 601 bp, Human; identical to SEQ ID NO: 71635

SEQ ID NO: 72074 - DNA, 601 bp, Human; identical to SEQ ID NO: 71636

SEQ ID NO: 72075 - DNA, 601 bp, Human; identical to SEQ ID NO: 71637

SEQ ID NO: 72076 - DNA, 601 bp, Human; identical to SEQ ID NO: 71638

SEQ ID NO: 72077 - DNA, 601 bp, Human; identical to SEQ ID NO: 71639

SEQ ID NO: 72078 - DNA, 601 bp, Human; identical to SEQ ID NO: 71640

SEQ ID NO: 72079 - DNA, 601 bp, Human; identical to SEQ ID NO: 71641

SEQ ID NO: 72080 - DNA, 601 bp, Human; identical to SEQ ID NO: 71642

SEQ ID NO: 72081 - DNA, 601 bp, Human; identical to SEQ ID NO: 71643

SEQ ID NO: 72082 - DNA, 601 bp, Human; identical to SEQ ID NO: 71644

SEQ ID NO: 72083 - DNA, 601 bp, Human; identical to SEQ ID NO: 71645

SEQ ID NO: 72084 - DNA, 601 bp, Human; identical to SEQ ID NO: 71646

SEQ ID NO: 72085 - DNA, 601 bp, Human; identical to SEQ ID NO: 71647

SEQ ID NO: 72086 - DNA, 601 bp, Human; identical to SEQ ID NO: 71648

SEQ ID NO: 72087 - DNA, 601 bp, Human; identical to SEQ ID NO: 71649

SEQ ID NO: 72088 - DNA, 601 bp, Human; identical to SEQ ID NO: 71650

SEQ ID NO: 72089 - DNA, 601 bp, Human; identical to SEQ ID NO: 71651

SEQ ID NO: 72090 - DNA, 601 bp, Human; identical to SEQ ID NO: 71652

SEQ ID NO: 72091 - DNA, 601 bp, Human; identical to SEQ ID NO: 71653

SEQ ID NO: 72092 - DNA, 601 bp, Human; identical to SEQ ID NO: 71654

SEQ ID NO: 72093 - DNA, 601 bp, Human; identical to SEQ ID NO: 71655

SEQ ID NO: 72094 - DNA, 601 bp, Human; identical to SEQ ID NO: 71656

SEQ ID NO: 72095 - DNA, 601 bp, Human; identical to SEQ ID NO: 71657

SEQ ID NO: 72096 - DNA, 601 bp, Human; identical to SEQ ID NO: 71658

SEQ ID NO: 72097 - DNA, 601 bp, Human; identical to SEQ ID NO: 71659

SEQ ID NO: 72098 - DNA, 601 bp, Human; identical to SEQ ID NO: 71660

SEQ ID NO: 72099 - DNA, 601 bp, Human; identical to SEQ ID NO: 71661

SEQ ID NO: 72100 - DNA, 601 bp, Human; identical to SEQ ID NO: 71662

SEQ ID NO: 72101 - DNA, 601 bp, Human; identical to SEQ ID NO: 71663

SEQ ID NO: 72102 - DNA, 601 bp, Human; identical to SEQ ID NO: 71664

SEQ ID NO: 72103 - DNA, 601 bp, Human; identical to SEQ ID NO: 71665

SEQ ID NO: 72104 - DNA, 601 bp, Human; identical to SEQ ID NO: 71666

SEQ ID NO: 72105 - DNA, 601 bp, Human; identical to SEQ ID NO: 71667

SEQ ID NO: 72106 - DNA, 601 bp, Human; identical to SEQ ID NO: 71668

SEQ ID NO: 72107 - DNA, 601 bp, Human; identical to SEQ ID NO: 71669

SEQ ID NO: 72108 - DNA, 601 bp, Human; identical to SEQ ID NO: 71670

SEQ ID NO: 72109 - DNA, 601 bp, Human; identical to SEQ ID NO: 71671

SEQ ID NO: 72110 - DNA, 601 bp, Human; identical to SEQ ID NO: 71672

SEQ ID NO: 72111 - DNA, 601 bp, Human; identical to SEQ ID NO: 71673

SEQ ID NO: 72112 - DNA, 601 bp, Human; identical to SEQ ID NO: 71674

SEQ ID NO: 72113 - DNA, 601 bp, Human; identical to SEQ ID NO: 71675

SEQ ID NO: 72114 - DNA, 601 bp, Human; identical to SEQ ID NO: 71676

SEQ ID NO: 72115 - DNA, 601 bp, Human; identical to SEQ ID NO: 71677

SEQ ID NO: 72116 - DNA, 601 bp, Human; identical to SEQ ID NO: 71678

SEQ ID NO: 72117 - DNA, 601 bp, Human; identical to SEQ ID NO: 71679

SEQ ID NO: 72118 - DNA, 601 bp, Human; identical to SEQ ID NO: 71680

SEQ ID NO: 72119 - DNA, 601 bp, Human; identical to SEQ ID NO: 71608

SEQ ID NO: 72120 - DNA, 601 bp, Human; identical to SEQ ID NO: 71609

SEQ ID NO: 72121 - DNA, 601 bp, Human; identical to SEQ ID NO: 71610

SEQ ID NO: 72122 - DNA, 601 bp, Human; identical to SEQ ID NO: 71611

SEQ ID NO: 72123 - DNA, 601 bp, Human; identical to SEQ ID NO: 71612

SEQ ID NO: 72124 - DNA, 601 bp, Human; identical to SEQ ID NO: 71613

SEQ ID NO: 72125 - DNA, 601 bp, Human; identical to SEQ ID NO: 71614

SEQ ID NO: 72126 - DNA, 601 bp, Human; identical to SEQ ID NO: 71615

SEQ ID NO: 72127 - DNA, 490 bp, Human; identical to SEQ ID NO: 71616

SEQ ID NO: 72128 - DNA, 601 bp, Human; identical to SEQ ID NO: 71617

SEQ ID NO: 72129 - DNA, 601 bp, Human; identical to SEQ ID NO: 71618

SEQ ID NO: 72130 - DNA, 601 bp, Human; identical to SEQ ID NO: 71619

SEQ ID NO: 72131 - DNA, 601 bp, Human; identical to SEQ ID NO: 71620

SEQ ID NO: 72132 - DNA, 601 bp, Human; identical to SEQ ID NO: 71621

SEQ ID NO: 72133 - DNA, 601 bp, Human; identical to SEQ ID NO: 71622

SEQ ID NO: 72134 - DNA, 601 bp, Human; identical to SEQ ID NO: 71623

SEQ ID NO: 72135 - DNA, 601 bp, Human; identical to SEQ ID NO: 71624

SEQ ID NO: 72136 - DNA, 601 bp, Human; identical to SEQ ID NO: 71625

SEQ ID NO: 72137 - DNA, 601 bp, Human; identical to SEQ ID NO: 71626

SEQ ID NO: 72138 - DNA, 601 bp, Human; identical to SEQ ID NO: 71627

SEQ ID NO: 72139 - DNA, 601 bp, Human; identical to SEQ ID NO: 71628

SEQ ID NO: 72140 - DNA, 601 bp, Human; identical to SEQ ID NO: 71629

SEQ ID NO: 72141 - DNA, 601 bp, Human; identical to SEQ ID NO: 71630

SEQ ID NO: 72142 - DNA, 601 bp, Human; identical to SEQ ID NO: 71631

SEQ ID NO: 72143 - DNA, 601 bp, Human; identical to SEQ ID NO: 71632

SEQ ID NO: 72144 - DNA, 601 bp, Human; identical to SEQ ID NO: 71633

SEQ ID NO: 72145 - DNA, 601 bp, Human; identical to SEQ ID NO: 71634

SEQ ID NO: 72146 - DNA, 601 bp, Human; identical to SEQ ID NO: 71635

SEQ ID NO: 72147 - DNA, 601 bp, Human; identical to SEQ ID NO: 71636

SEQ ID NO: 72148 - DNA, 601 bp, Human; identical to SEQ ID NO: 71637

SEQ ID NO: 72149 - DNA, 601 bp, Human; identical to SEQ ID NO: 71638

SEQ ID NO: 72150 - DNA, 601 bp, Human; identical to SEQ ID NO: 71639

SEQ ID NO: 72151 - DNA, 601 bp, Human; identical to SEQ ID NO: 71640

SEQ ID NO: 72152 - DNA, 601 bp, Human; identical to SEQ ID NO: 71641

SEQ ID NO: 72153 - DNA, 601 bp, Human; identical to SEQ ID NO: 71642

SEQ ID NO: 72154 - DNA, 601 bp, Human; identical to SEQ ID NO: 71643

SEQ ID NO: 72155 - DNA, 601 bp, Human; identical to SEQ ID NO: 71644

SEQ ID NO: 72156 - DNA, 601 bp, Human; identical to SEQ ID NO: 71645

SEQ ID NO: 72157 - DNA, 601 bp, Human; identical to SEQ ID NO: 71646

SEQ ID NO: 72158 - DNA, 601 bp, Human; identical to SEQ ID NO: 71647

SEQ ID NO: 72159 - DNA, 601 bp, Human; identical to SEQ ID NO: 71648

SEQ ID NO: 72160 - DNA, 601 bp, Human; identical to SEQ ID NO: 71649

SEQ ID NO: 72161 - DNA, 601 bp, Human; identical to SEQ ID NO: 71650

SEQ ID NO: 72162 - DNA, 601 bp, Human; identical to SEQ ID NO: 71651

SEQ ID NO: 72163 - DNA, 601 bp, Human; identical to SEQ ID NO: 71652

SEQ ID NO: 72164 - DNA, 601 bp, Human; identical to SEQ ID NO: 71653

SEQ ID NO: 72165 - DNA, 601 bp, Human; identical to SEQ ID NO: 71654

SEQ ID NO: 72166 - DNA, 601 bp, Human; identical to SEQ ID NO: 71655

SEQ ID NO: 72167 - DNA, 601 bp, Human; identical to SEQ ID NO: 71656

SEQ ID NO: 72168 - DNA, 601 bp, Human; identical to SEQ ID NO: 71657

SEQ ID NO: 72169 - DNA, 601 bp, Human; identical to SEQ ID NO: 71658

SEQ ID NO: 72170 - DNA, 601 bp, Human; identical to SEQ ID NO: 71659

SEQ ID NO: 72171 - DNA, 601 bp, Human; identical to SEQ ID NO: 71660

SEQ ID NO: 72172 - DNA, 601 bp, Human; identical to SEQ ID NO: 71661

SEQ ID NO: 72173 - DNA, 601 bp, Human; identical to SEQ ID NO: 71662

SEQ ID NO: 72174 - DNA, 601 bp, Human; identical to SEQ ID NO: 71663

SEQ ID NO: 72175 - DNA, 601 bp, Human; identical to SEQ ID NO: 71664

SEQ ID NO: 72176 - DNA, 601 bp, Human; identical to SEQ ID NO: 71665

SEQ ID NO: 72177 - DNA, 601 bp, Human; identical to SEQ ID NO: 71666

SEQ ID NO: 72178 - DNA, 601 bp, Human; identical to SEQ ID NO: 71667

SEQ ID NO: 72179 - DNA, 601 bp, Human; identical to SEQ ID NO: 71668

SEQ ID NO: 72180 - DNA, 601 bp, Human; identical to SEQ ID NO: 71669

SEQ ID NO: 72181 - DNA, 601 bp, Human; identical to SEQ ID NO: 71670

SEQ ID NO: 72182 - DNA, 601 bp, Human; identical to SEQ ID NO: 71671

SEQ ID NO: 72183 - DNA, 601 bp, Human; identical to SEQ ID NO: 71672

SEQ ID NO: 72184 - DNA, 601 bp, Human; identical to SEQ ID NO: 71673

SEQ ID NO: 72185 - DNA, 601 bp, Human; identical to SEQ ID NO: 71674

SEQ ID NO: 72186 - DNA, 601 bp, Human; identical to SEQ ID NO: 71675

SEQ ID NO: 72187 - DNA, 601 bp, Human; identical to SEQ ID NO: 71676

SEQ ID NO: 72188 - DNA, 601 bp, Human; identical to SEQ ID NO: 71677

SEQ ID NO: 72189 - DNA, 601 bp, Human; identical to SEQ ID NO: 71678

SEQ ID NO: 72190 - DNA, 601 bp, Human; identical to SEQ ID NO: 71679

SEQ ID NO: 72191 - DNA, 601 bp, Human; identical to SEQ ID NO: 71680

SEQ ID NO: 72192 - DNA, 601 bp, Human; identical to SEQ ID NO: 71608

SEQ ID NO: 72193 - DNA, 601 bp, Human; identical to SEQ ID NO: 71609

SEQ ID NO: 72194 - DNA, 601 bp, Human; identical to SEQ ID NO: 71610

SEQ ID NO: 72195 - DNA, 601 bp, Human; identical to SEQ ID NO: 71611

SEQ ID NO: 72196 - DNA, 601 bp, Human; identical to SEQ ID NO: 71612

SEQ ID NO: 72197 - DNA, 601 bp, Human; identical to SEQ ID NO: 71613

SEQ ID NO: 72198 - DNA, 601 bp, Human; identical to SEQ ID NO: 71614

SEQ ID NO: 72199 - DNA, 601 bp, Human; identical to SEQ ID NO: 71615

SEQ ID NO: 72200 - DNA, 490 bp, Human; identical to SEQ ID NO: 71616

SEQ ID NO: 72201 - DNA, 601 bp, Human; identical to SEQ ID NO: 71617

SEQ ID NO: 72202 - DNA, 601 bp, Human; identical to SEQ ID NO: 71618

SEQ ID NO: 72203 - DNA, 601 bp, Human; identical to SEQ ID NO: 71619

SEQ ID NO: 72204 - DNA, 601 bp, Human; identical to SEQ ID NO: 71620

SEQ ID NO: 72205 - DNA, 601 bp, Human; identical to SEQ ID NO: 71621

SEQ ID NO: 72206 - DNA, 601 bp, Human; identical to SEQ ID NO: 71622

SEQ ID NO: 72207 - DNA, 601 bp, Human; identical to SEQ ID NO: 71623

SEQ ID NO: 72208 - DNA, 601 bp, Human; identical to SEQ ID NO: 71624

SEQ ID NO: 72209 - DNA, 601 bp, Human; identical to SEQ ID NO: 71625

SEQ ID NO: 72210 - DNA, 601 bp, Human; identical to SEQ ID NO: 71626

SEQ ID NO: 72211 - DNA, 601 bp, Human; identical to SEQ ID NO: 71627

SEQ ID NO: 72212 - DNA, 601 bp, Human; identical to SEQ ID NO: 71628

SEQ ID NO: 72213 - DNA, 601 bp, Human; identical to SEQ ID NO: 71629

SEQ ID NO: 72214 - DNA, 601 bp, Human; identical to SEQ ID NO: 71630

SEQ ID NO: 72215 - DNA, 601 bp, Human; identical to SEQ ID NO: 71631

SEQ ID NO: 72216 - DNA, 601 bp, Human; identical to SEQ ID NO: 71632

SEQ ID NO: 72217 - DNA, 601 bp, Human; identical to SEQ ID NO: 71633

SEQ ID NO: 72218 - DNA, 601 bp, Human; identical to SEQ ID NO: 71634

SEQ ID NO: 72219 - DNA, 601 bp, Human; identical to SEQ ID NO: 71635

SEQ ID NO: 72220 - DNA, 601 bp, Human; identical to SEQ ID NO: 71636

SEQ ID NO: 72221 - DNA, 601 bp, Human; identical to SEQ ID NO: 71637

SEQ ID NO: 72222 - DNA, 601 bp, Human; identical to SEQ ID NO: 71638

SEQ ID NO: 72223 - DNA, 601 bp, Human; identical to SEQ ID NO: 71639

SEQ ID NO: 72224 - DNA, 601 bp, Human; identical to SEQ ID NO: 71640

SEQ ID NO: 72225 - DNA, 601 bp, Human; identical to SEQ ID NO: 71641

SEQ ID NO: 72226 - DNA, 601 bp, Human; identical to SEQ ID NO: 71642

SEQ ID NO: 72227 - DNA, 601 bp, Human; identical to SEQ ID NO: 71643

SEQ ID NO: 72228 - DNA, 601 bp, Human; identical to SEQ ID NO: 71644

SEQ ID NO: 72229 - DNA, 601 bp, Human; identical to SEQ ID NO: 71645

SEQ ID NO: 72230 - DNA, 601 bp, Human; identical to SEQ ID NO: 71646

SEQ ID NO: 72231 - DNA, 601 bp, Human; identical to SEQ ID NO: 71647

SEQ ID NO: 72232 - DNA, 601 bp, Human; identical to SEQ ID NO: 71648

SEQ ID NO: 72233 - DNA, 601 bp, Human; identical to SEQ ID NO: 71649

SEQ ID NO: 72234 - DNA, 601 bp, Human; identical to SEQ ID NO: 71650

SEQ ID NO: 72235 - DNA, 601 bp, Human; identical to SEQ ID NO: 71651

SEQ ID NO: 72236 - DNA, 601 bp, Human; identical to SEQ ID NO: 71652

SEQ ID NO: 72237 - DNA, 601 bp, Human; identical to SEQ ID NO: 71653

SEQ ID NO: 72238 - DNA, 601 bp, Human; identical to SEQ ID NO: 71654

SEQ ID NO: 72239 - DNA, 601 bp, Human; identical to SEQ ID NO: 71655

SEQ ID NO: 72240 - DNA, 601 bp, Human; identical to SEQ ID NO: 71656

SEQ ID NO: 72241 - DNA, 601 bp, Human; identical to SEQ ID NO: 71657

SEQ ID NO: 72242 - DNA, 601 bp, Human; identical to SEQ ID NO: 71658

SEQ ID NO: 72243 - DNA, 601 bp, Human; identical to SEQ ID NO: 71659

SEQ ID NO: 72244 - DNA, 601 bp, Human; identical to SEQ ID NO: 71660

SEQ ID NO: 72245 - DNA, 601 bp, Human; identical to SEQ ID NO: 71661

SEQ ID NO: 72246 - DNA, 601 bp, Human; identical to SEQ ID NO: 71662

SEQ ID NO: 72247 - DNA, 601 bp, Human; identical to SEQ ID NO: 71663

SEQ ID NO: 72248 - DNA, 601 bp, Human; identical to SEQ ID NO: 71664

SEQ ID NO: 72249 - DNA, 601 bp, Human; identical to SEQ ID NO: 71665

SEQ ID NO: 72250 - DNA, 601 bp, Human; identical to SEQ ID NO: 71666

SEQ ID NO: 72251 - DNA, 601 bp, Human; identical to SEQ ID NO: 71667

SEQ ID NO: 72252 - DNA, 601 bp, Human; identical to SEQ ID NO: 71668

SEQ ID NO: 72253 - DNA, 601 bp, Human; identical to SEQ ID NO: 71669

SEQ ID NO: 72254 - DNA, 601 bp, Human; identical to SEQ ID NO: 71670

SEQ ID NO: 72255 - DNA, 601 bp, Human; identical to SEQ ID NO: 71671

SEQ ID NO: 72256 - DNA, 601 bp, Human; identical to SEQ ID NO: 71672

SEQ ID NO: 72257 - DNA, 601 bp, Human; identical to SEQ ID NO: 71673

SEQ ID NO: 72258 - DNA, 601 bp, Human; identical to SEQ ID NO: 71674

SEQ ID NO: 72259 - DNA, 601 bp, Human; identical to SEQ ID NO: 71675

SEQ ID NO: 72260 - DNA, 601 bp, Human; identical to SEQ ID NO: 71676

SEQ ID NO: 72261 - DNA, 601 bp, Human; identical to SEQ ID NO: 71677

SEQ ID NO: 72262 - DNA, 601 bp, Human; identical to SEQ ID NO: 71678

SEQ ID NO: 72263 - DNA, 601 bp, Human; identical to SEQ ID NO: 71679

SEQ ID NO: 72264 - DNA, 601 bp, Human; identical to SEQ ID NO: 71680

SEQ ID NO: 72265 - DNA, 601 bp, Human; identical to SEQ ID NO: 71608

SEQ ID NO: 72266 - DNA, 601 bp, Human; identical to SEQ ID NO: 71609

SEQ ID NO: 72267 - DNA, 601 bp, Human; identical to SEQ ID NO: 71610

SEQ ID NO: 72268 - DNA, 601 bp, Human; identical to SEQ ID NO: 71611

SEQ ID NO: 72269 - DNA, 601 bp, Human; identical to SEQ ID NO: 71612

SEQ ID NO: 72270 - DNA, 601 bp, Human; identical to SEQ ID NO: 71613

SEQ ID NO: 72271 - DNA, 601 bp, Human; identical to SEQ ID NO: 71614

SEQ ID NO: 72272 - DNA, 601 bp, Human; identical to SEQ ID NO: 71615

SEQ ID NO: 72273 - DNA, 490 bp, Human; identical to SEQ ID NO: 71616

SEQ ID NO: 72274 - DNA, 601 bp, Human; identical to SEQ ID NO: 71617

SEQ ID NO: 72275 - DNA, 601 bp, Human; identical to SEQ ID NO: 71618

SEQ ID NO: 72276 - DNA, 601 bp, Human; identical to SEQ ID NO: 71619

SEQ ID NO: 72277 - DNA, 601 bp, Human; identical to SEQ ID NO: 71620

SEQ ID NO: 72278 - DNA, 601 bp, Human; identical to SEQ ID NO: 71621

SEQ ID NO: 72279 - DNA, 601 bp, Human; identical to SEQ ID NO: 71622

SEQ ID NO: 72280 - DNA, 601 bp, Human; identical to SEQ ID NO: 71623

SEQ ID NO: 72281 - DNA, 601 bp, Human; identical to SEQ ID NO: 71624

SEQ ID NO: 72282 - DNA, 601 bp, Human; identical to SEQ ID NO: 71625

SEQ ID NO: 72283 - DNA, 601 bp, Human; identical to SEQ ID NO: 71626

SEQ ID NO: 72284 - DNA, 601 bp, Human; identical to SEQ ID NO: 71627

SEQ ID NO: 72285 - DNA, 601 bp, Human; identical to SEQ ID NO: 71628

SEQ ID NO: 72286 - DNA, 601 bp, Human; identical to SEQ ID NO: 71629

SEQ ID NO: 72287 - DNA, 601 bp, Human; identical to SEQ ID NO: 71630

SEQ ID NO: 72288 - DNA, 601 bp, Human; identical to SEQ ID NO: 71631

SEQ ID NO: 72289 - DNA, 601 bp, Human; identical to SEQ ID NO: 71632

SEQ ID NO: 72290 - DNA, 601 bp, Human; identical to SEQ ID NO: 71633

SEQ ID NO: 72291 - DNA, 601 bp, Human; identical to SEQ ID NO: 71634

SEQ ID NO: 72292 - DNA, 601 bp, Human; identical to SEQ ID NO: 71635

SEQ ID NO: 72293 - DNA, 601 bp, Human; identical to SEQ ID NO: 71636

SEQ ID NO: 72294 - DNA, 601 bp, Human; identical to SEQ ID NO: 71637

SEQ ID NO: 72295 - DNA, 601 bp, Human; identical to SEQ ID NO: 71638

SEQ ID NO: 72296 - DNA, 601 bp, Human; identical to SEQ ID NO: 71639

SEQ ID NO: 72297 - DNA, 601 bp, Human; identical to SEQ ID NO: 71640

SEQ ID NO: 72298 - DNA, 601 bp, Human; identical to SEQ ID NO: 71641

SEQ ID NO: 72299 - DNA, 601 bp, Human; identical to SEQ ID NO: 71642

SEQ ID NO: 72300 - DNA, 601 bp, Human; identical to SEQ ID NO: 71643

SEQ ID NO: 72301 - DNA, 601 bp, Human; identical to SEQ ID NO: 71644

SEQ ID NO: 72302 - DNA, 601 bp, Human; identical to SEQ ID NO: 71645

SEQ ID NO: 72303 - DNA, 601 bp, Human; identical to SEQ ID NO: 71646

SEQ ID NO: 72304 - DNA, 601 bp, Human; identical to SEQ ID NO: 71647

SEQ ID NO: 72305 - DNA, 601 bp, Human; identical to SEQ ID NO: 71648

SEQ ID NO: 72306 - DNA, 601 bp, Human; identical to SEQ ID NO: 71649

SEQ ID NO: 72307 - DNA, 601 bp, Human; identical to SEQ ID NO: 71650

SEQ ID NO: 72308 - DNA, 601 bp, Human; identical to SEQ ID NO: 71651

SEQ ID NO: 72309 - DNA, 601 bp, Human; identical to SEQ ID NO: 71652

SEQ ID NO: 72310 - DNA, 601 bp, Human; identical to SEQ ID NO: 71653

SEQ ID NO: 72311 - DNA, 601 bp, Human; identical to SEQ ID NO: 71654

SEQ ID NO: 72312 - DNA, 601 bp, Human; identical to SEQ ID NO: 71655

SEQ ID NO: 72313 - DNA, 601 bp, Human; identical to SEQ ID NO: 71656

SEQ ID NO: 72314 - DNA, 601 bp, Human; identical to SEQ ID NO: 71657

SEQ ID NO: 72315 - DNA, 601 bp, Human; identical to SEQ ID NO: 71658

SEQ ID NO: 72316 - DNA, 601 bp, Human; identical to SEQ ID NO: 71659

SEQ ID NO: 72317 - DNA, 601 bp, Human; identical to SEQ ID NO: 71660

SEQ ID NO: 72318 - DNA, 601 bp, Human; identical to SEQ ID NO: 71661

SEQ ID NO: 72319 - DNA, 601 bp, Human; identical to SEQ ID NO: 71662

SEQ ID NO: 72320 - DNA, 601 bp, Human; identical to SEQ ID NO: 71663

SEQ ID NO: 72321 - DNA, 601 bp, Human; identical to SEQ ID NO: 71664

SEQ ID NO: 72322 - DNA, 601 bp, Human; identical to SEQ ID NO: 71665

SEQ ID NO: 72323 - DNA, 601 bp, Human; identical to SEQ ID NO: 71666

SEQ ID NO: 72324 - DNA, 601 bp, Human; identical to SEQ ID NO: 71667

SEQ ID NO: 72325 - DNA, 601 bp, Human; identical to SEQ ID NO: 71668

SEQ ID NO: 72326 - DNA, 601 bp, Human; identical to SEQ ID NO: 71669

SEQ ID NO: 72327 - DNA, 601 bp, Human; identical to SEQ ID NO: 71670

SEQ ID NO: 72328 - DNA, 601 bp, Human; identical to SEQ ID NO: 71671

SEQ ID NO: 72329 - DNA, 601 bp, Human; identical to SEQ ID NO: 71672

SEQ ID NO: 72330 - DNA, 601 bp, Human; identical to SEQ ID NO: 71673

SEQ ID NO: 72331 - DNA, 601 bp, Human; identical to SEQ ID NO: 71674

SEQ ID NO: 72332 - DNA, 601 bp, Human; identical to SEQ ID NO: 71675

SEQ ID NO: 72333 - DNA, 601 bp, Human; identical to SEQ ID NO: 71676

SEQ ID NO: 72334 - DNA, 601 bp, Human; identical to SEQ ID NO: 71677

SEQ ID NO: 72335 - DNA, 601 bp, Human; identical to SEQ ID NO: 71678

SEQ ID NO: 72336 - DNA, 601 bp, Human; identical to SEQ ID NO: 71679

SEQ ID NO: 72337 - DNA, 601 bp, Human; identical to SEQ ID NO: 71680

SEQ ID NO: 72338 - DNA, 601 bp, Human; identical to SEQ ID NO: 32396

SEQ ID NO: 72339 - DNA, 601 bp, Human; identical to SEQ ID NO: 32397

SEQ ID NO: 72340 - DNA, 601 bp, Human; identical to SEQ ID NO: 32398

SEQ ID NO: 72341 - DNA, 601 bp, Human; identical to SEQ ID NO: 40478

SEQ ID NO: 72342 - DNA, 601 bp, Human; identical to SEQ ID NO: 40479

SEQ ID NO: 72343 - DNA, 601 bp, Human; identical to SEQ ID NO: 40480

SEQ ID NO: 72344 - DNA, 601 bp, Human
cccgcagggcagtctgtcggaaacccccgctttactcagcaggaatttagtctccgcgctccccctaaaacccgggcgtcctctcctctgtaccctcgctcctggggccctcacacgccctccgtggctgacctccaagccgggcgggtgcgctgtgcgacgcggaaagcgccgtagagcacgcagaacacgattggctgagctcccggaagtgacgtacctcaaccgcccgacagtggaagtcccacctgcgcccgacggcggaagttccgggagtgccaagtacccgcgtgcatacggytgccggcatggcacattacaacttcaagaaaattacggtggtgccgtccgccaaggtaggcggccccgggagggccactgcaactttcgcgttctcctcagctgggtccccggggagggtccgggcctgtagccgtgggagagcggtcgccttccgctcgcccatcccccgctcctgggcctgaccgtctggccgcgtactcgggatcatttcccctcccccagcagaatccggggtccaccagagatcggatcccccagagaccggggtccacctaagaccgtggtccacccaaagact

SEQ ID NO: 72345 - DNA, 601 bp, Human
atcggatccttattaaagagaagtgctgactctttgcactgggtaactcatgcaaaaatccttcatctcctcaaatagttcccttccatctctttggaaattataaacagtggattttagttttacctgttattttatgtactttcaaagtcaagggtatgcataaacaaatgggaggattgtttctttttctcaactattctaatttatggtttgaattctctgattatttaagtttcaaaggttcttaggtgtttggaaattaagatagcatcaagaaagtatggtgtaaaatttatctttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggtgcccgctaccacgcccggctaattttttgtatttttagtagagacggggtttcaccgtgttagccaggatggtctcgatctcctgacctcgtgatccgcccgcctcagcctcccaaagtgctgggattacaggtgtgagccaccgcgcccg

SEQ ID NO: 72346 - DNA, 601 bp, Human
tcagtaagttagtggcaaagaactaatttgttgaatttataaaagtgagaacagaatttgggttttttgattccctagtattctttctttcctccaaccaaaacccatctaaggaggccccaagctgtcttctcaggctttctgtgtaaaccctgggcttgcaggtgccaacccaagtgttaatgatagctgtgggttatgaacacagaagctagcagctcactggttgtctgggctttatctcttccaccttctttccaagggttttttttttcctctgggctcagcttgggtcagtggygtaagatccaccactgtttgtgatcttgttgcttcatcagctgatgacagtcagttcagcactgactgttttcttctttggcaaggagagatcacatgggagctatgacttttgaatgaagccagaaaccttgagctcctttctctgctgcacattgcagtttgcctgtttctttttttctcttttttttggagactgagtctcactctgttgcccaggctggagtgcagtggcgtgatctcagcccgctgaaatctctacctcctggattcaagcaattcttgtgcttcagcctcccgc

SEQ ID NO: 72347 - DNA, 601 bp, Human
tacaggtgcccgccaccacgcccggctagttttgtatttttagtagagacagggtttcaccatgttggccaggcttgtctcgaactcctgacctcaggtgatccgcctgccttggcctcccaaagtgctgggattacaggtgtgagccactgcacctgtccaataatggcttatttttaaaatacagaagtgcttaaaatacaaaaattcttgctagaggacggacacttaggttgtgtctagctaggatttgacacagttgctcagtagatgtttgttgaatgagtgaatggtttcttgrgaaaggtcaggtactagagagtacctgggggtgaagaaagtgatttaagaatgagatttttgtttgtttgtttgtttgtttgttttgagacagtcttgctctgttgcccaggctggagtaaaatggcgtgatctcagctcactgtaacctcttcctcccaggttcaagcgattctcccacctcagcctcccgagtagctgggattacaggcatgtgcgactatacccggctaatttttgtgtttttttagtagagacgaggtttctccatgttggccaggctggtctcgaactcctgacc

SEQ ID NO: 72348 - DNA, 601 bp, Human
ccggctagttttgtatttttagtagagacagggtttcaccatgttggccaggcttgtctcgaactcctgacctcaggtgatccgcctgccttggcctcccaaagtgctgggattacaggtgtgagccactgcacctgtccaataatggcttatttttaaaatacagaagtgcttaaaatacaaaaattcttgctagaggacggacacttaggttgtgtctagctaggatttgacacagttgctcagtagatgtttgttgaatgagtgaatggtttcttgggaaaggtcaggtactagagastacctgggggtgaagaaagtgatttaagaatgagatttttgtttgtttgtttgtttgtttgttttgagacagtcttgctctgttgcccaggctggagtaaaatggcgtgatctcagctcactgtaacctcttcctcccaggttcaagcgattctcccacctcagcctcccgagtagctgggattacaggcatgtgcgactatacccggctaatttttgtgtttttttagtagagacgaggtttctccatgttggccaggctggtctcgaactcctgacctcaggtgatccgcctgccttg

SEQ ID NO: 72349 - DNA, 601 bp, Human
acagtgcctggccaagaatgagattattcttaactgatttgatattaggaaatatttgattttagccaacaacatactttgatctacttagtatcagatttttgtggttctttttaagaagttttgtctttttcatcctcagtgttatagccatcagaggtaggagagttcaaatgtattaacattctattactctttttaaagccaggactagttatctgagaacagcttcagagtggagggttagatattaagttgtcattcactgaatgcttattgtctgtcaggtactgttctgagycctaggaatccagaagtggtaaaggttcctgctctcattctggtggagaaaagatagtaaatagcatgtcagatgaatgcagtgaagccatggaagggagtagggagtatctgtgcggggagagggtgtcaggcctgtagtcaaagaagcagcaggtgcaggagacccaggaggtggggcaggctagggaggtgaacactgggacatgggattggaggtggtagtcaagggtcgagtttatatgcactggtgagatatctcaggagatgctggcctggtgatttaaaatgcattagtaaa

SEQ ID NO: 72350 - DNA, 601 bp, Human
gagctgtgagcactagccagcacaggacttagaggggtcagactctccacctagaagctgtgaggaaaataccgcaggcaggatgcatggccagcccgcagcgtttcaagaggtctgtgagataaaaactgagaattggtcattgggaggtccttggtgagcttgtaggctgtttagatggagtggtggacacagaattctggagagagtgggttcaagagagggaggagaggagagacacagtgtgtcttgggagcaaagagagggaattggaaggattttggggctatgggaatttttkattttttttcctaaagattgagaaataacagcaaatttttaggctgatgggaatagtcaggtggagggaagaatttctagtgctgagttcctgagcaacaggaagggtacatgcagggtcgggggctggtcattgctgggtcccacagctctaccactgcactgagagcgaggtgggtgggagccgtgactgtcggcacccgcatcccttctgatgcctgttttctcagaggactaaatagacagggcccctggccaggagagggaactggggaggagacactgcaggcgtggagggaga

SEQ ID NO: 72351 - DNA, 601 bp, Human
tctgaattaatgtactaggattctgttgaaacaattacttgcttattgtgtgtattcttacatgacaaattattttgactcattcggttttgttttctctcctgcatcttagaaataatttttaacaaaatttgtgatacttggatgccttgcaggtgctttgctacagatctgtgtggtcttcatgatggccggggtgccaccctggagccgtgtttgttacagacgaggtggcagagtggcagtaacccatgttgtagcccaaacggcatggcctgcaggcttcaaagtgcactggttmcctaatgtcatcttgctaatgagaattgtctggacactgccagacatgctgttggccccacctgtcacctaatgaattaaaacgtgggcttagaagggctgaggaatatgattcttaccagagccaaacttgggagatagcaattgaatatactatgtgtatactattactttctgcaactattttctccatcacttttgcattacaaaagttggagtaagatgaatatcaccacaggcctggactgtaactaagttgaaaagaaaatttaaagcaaatcttaaactttgaatttcttaa

SEQ ID NO: 72352 - DNA, 601 bp, Human
tgccaaccattgatccgaataccaggaccctgcttttgtgtgggtacccaaatgttgggaagtccagcttcatcaacaaggttggtctggtttttatcgtaaagcaaatcatctgactattttacgtcagtgttactgtattctggcggcgtgggattcaggatggccttgtaggtcagtgttaactgtattctgactgcgtgggattcaggacggccttggtaataatttcggcctccgagttggtccttgagtaaaacactgccctggtctgcaggagttcccggtgcctgagcacgcygagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctccggtggcaggtgacactcacccagctggggtcttcccgtctgcagctgcatctgagtgatctgttaccttggttgctgtgtcagctttcacatgaaatcgtat

SEQ ID NO: 72353 - DNA, 601 bp, Human
gtgttaactgtattctgactgcgtgggattcaggacggccttggtaataatttcggcctccgagttggtccttgagtaaaacactgccctggtctgcaggagttcccggtgcctgagcacgccgagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagyggctatgccagcggggctccggtggcaggtgacactcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacag

SEQ ID NO: 72354 - DNA, 601 bp, Human
gcgtgggattcaggacggccttggtaataatttcggcctccgagttggtccttgagtaaaacactgccctggtctgcaggagttcccggtgcctgagcacgccgagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctcyggtggcaggtgacactcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacagctcatgtgccaagaaaatgg

SEQ ID NO: 72355 - DNA, 601 bp, Human
tctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctccggtggcaggtgacactcacccagctggggtcttcccgtctgcagctgcatctgagtgatctgttaccttggttgctgtgtcagctttcacatgaaatcgtatgtggtctagtagagggacggtgccgagtygctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacagctcatgtgccaagaaaatggtcaaattttatggcttactcagtgccaagatcactttatttttaattaaaaaaatttttttctttctttttgttgaaactttttctttttgagacagggtctcgctctgttgcccaggctgaagtgcagtg

SEQ ID NO: 72356 - DNA, 601 bp, Human
tcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaacatttaaaatgtgaatttacaaccagcaacagctcatgtgccaagaaaatggtcaaattttatggctyactcagtgccaagatcactttatttttaattaaaaaaatttttttctttctttttgttgaaactttttctttttgagacagggtctcgctctgttgcccaggctgaagtgcagtggtgcagacatggctcgctgcagcctcaaccttccgggcccaaacagtcctcccacctcagccacccaagtagctgggaccacaggtgcacgccaccgcacctgtttaatttttttattttttgtggagatggagtctcactgtgttccccaggctgatctcaaactcccgagctcaagccatcct

SEQ ID NO: 72357 - DNA, 601 bp, Human
ccactgcactgggtggctttttaaattgcagtttaattcagcaaaatgaaaatttcaactcctcagtcacatgagccacatactgaaagttcattagcagtgcatgactggtggcccggtttggacagtgcagacagaacatgcctgtcatcataaagagctctgcgggcattgcaggcggtggggcaggacttgggagggtgaggggaggtggtggctgtcctccaaatgccagccctcacgctgtcctagtaccccagtccttggcctggtggtgcaaagggagaggtaccaggctccyattcgatgcagttttatcgtgtgaggtttcttctatggttatttcctacccaaaatcagtcttgttaaaacacacagatcccacgtgtacacagaggaaatgaggtgattctgaaagttctcacttgttccaggtgacgagagcagacgtggatgtccagccctatgcgttcacaaccaagtctctgtttgttgggcacatggattataagtatctacgttggcaggtgagagtcttgtctttatttttattcatttatttattttgagttggagtttcactcttgttgcccaggctgga

SEQ ID NO: 72358 - DNA, 601 bp, Human
cgtgatccacccgcctcggcctcccagagtgctgggattacaggtgtgagccaccgcacccagccctacttttttttttttttaactacaattctgctgtaagattattaggtctggttgggtgtgtgtgagtgacttctgggatgtgctggacaagaagcttgtgggtgagtgtgctttcagtgacaaggtctggctgtgttaggttgtagacactcctgggatcctggaccaccctctggaggataggaacaccatcgagatgcaggccatcactgccctggcccacctccgtgctgcrgtcctgtatgtgatggatttgtctgagcagtgtgggcatgggctgagggagcagctagaactcttccagaacatcagacctctcttcatcaacaaggtgtgtgtggtcactcatgttttgcttcatatcctgcagtacgagaataatgatttcattatttttcttccttgcctagcctctcatagttgtagccaacaaatgtgatgtgaagagaatagctgaactttctgaagatgatcaggtaaatcacgttaatattttgaatatttcttacttaccaattctgaattctcatctcag

SEQ ID NO: 72359 - DNA, 601 bp, Human
aatagctgaactttctgaagatgatcaggtaaatcacgttaatattttgaatatttcttacttaccaattctgaattctcatctcagacaaccaaagtttagatgaaggaattttagcaatactagtccacaattgtattttatagttgagataatatcctcagtggtttagtgaaaagacataataaaaacttagttattggcaaactaaaacgaaaacataagtttctggattctttgttcttgagtgtgtggaagcatctgtatttgatgggttggacttttggaaaatgtgattacktaggagagaactgttggagaagggtgctcacaggtgttacttcataaaacaggttctgtgattaaatgagtttggagactaatgattgagtgaaggagaaggaggatcttggaatttgggctttctggatctggatctatgagtgagacgtgcctgctagctttctccaagaggcaggcagtattgttggacataatttttcaaactgattgaatcctacaacctttttaataggcatccttcatgataaatgcttttagaagcgtgcactggtggagtggctttcaaattgtggtcctg

SEQ ID NO: 72360 - DNA, 601 bp, Human
tcctcattgatccattggtcattctgggacatgtttataattctcatgggtggtttttttttttttttacagttttgaaagtatctcttggtattgatttctagttttattccactgtggtctgaaaagatacttggcaatttttaaaaattgatgagatttgttttgtggcctaacatatggtctatcctggagaatgtttcatggactgaggagaggaatgtgttttatgcagcggttggatgacatgttctgtagatgtttggtctacagtgcacttttttttttattttatttttgttttttttttgagatggagtctcgctctgtcactgaggctggagtgcagtggcacggtctcggctcagtgcagcctccacctctgaggttcaagtgattctcctgcctcagcctcctgagtagctgggattacaggcgtgcgccaccacaccgagctaattttttgtatttttagtagagagggttttaccataccggccaggctggtcttgaatttatgacctcaagtgatccgcccaccttggcctcccagagtgttgggattataggcgtgagccactgcgcctggcctacagtgcac

SEQ ID NO: 72361 - DNA, 601 bp, Human
agtgcacttttttttttattttatttttgttttttttttgagatggagtctcgctctgtcactgaggctggagtgcagtggcacggtctcggctcagtgcagcctccacctctgaggttcaagtgattctcctgcctcagcctcctgagtagctgggattacaggcgtgcgccaccacaccgagctaattttttgtatttttagtagagagggttttaccataccggccaggctggtcttgaatttatgacctcaagtgatccgcccaccttggcctcccagagtgttgggattataggcrtgagccactgcgcctggcctacagtgcactttaaatccagtatttgttgattcttttttgcctaggatctgtctaatgttgcgagtctgatgttgatgtccccaaatattattgaccccttttattattatataatgaccttcttgtctctttttattgtttttgacttaaaatctgctttatctgatagaagtatagctattcctacttgcttttagtttccatctgcgtagaatatctttttgcatctcttcattttcagtctatgtgtgtcttaatgtctttacaggttaagtgaat

SEQ ID NO: 72362 - DNA, 601 bp, Human
ttagtagagagggttttaccataccggccaggctggtcttgaatttatgacctcaagtgatccgcccaccttggcctcccagagtgttgggattataggcgtgagccactgcgcctggcctacagtgcactttaaatccagtatttgttgattcttttttgcctaggatctgtctaatgttgcgagtctgatgttgatgtccccaaatattattgaccccttttattattatataatgaccttcttgtctctttttattgtttttgacttaaaatctgctttatctgatagaagtatagcyattcctacttgcttttagtttccatctgcgtagaatatctttttgcatctcttcattttcagtctatgtgtgtcttaatgtctttacaggttaagtgaatttcttggatactttttcatgttttcatgatagtgattattgtcttcgcttccagatgtaggactttcttaagtatatcttgtaaggctggtctagtagtgacgaattctctgtttttgcttttctcggaaagaatttatttctcccttatttctgaaggatagctttgctggatgtaatatagttggctggcagtcttct

SEQ ID NO: 72363 - DNA, 601 bp, Human
aatgccagcatgtattcacttaatgttgtcccataaatcttataggcttccttcattctttttcgttcttcctgctttttttctctctgactaggtagtttcaaatgacagagattttttttctgcttcatccagtgtgctgttaaaactgtctattgtattatctcatccattgaattcttcagctacaggatttctgtttgactcttttttacaatttctgtctcagtttaagttcttgttcatatcatgaaattgttttcttgattttgttgaattatctatctgtattttgtttctmattgagtttccttcaaaaaaattattattttgaattctctttctggcaattcattgatttccttttcattagagtctgttcctagagagttaatattcctttcatgatttcttatttccttgctttttcatgtttcttgtgtccctgcattgatgtctctgcatctggtagaacaggagcctcttttatactttcttctagagtggctttcatggagaggttttcacctcacttgggttttactgtgccatttgggaagagaaccgtgactttctggataggagcagtgacattgtttct

SEQ ID NO: 72364 - DNA, 601 bp, Human
cccataaatcttataggcttccttcattctttttcgttcttcctgctttttttctctctgactaggtagtttcaaatgacagagattttttttctgcttcatccagtgtgctgttaaaactgtctattgtattatctcatccattgaattcttcagctacaggatttctgtttgactcttttttacaatttctgtctcagtttaagttcttgttcatatcatgaaattgttttcttgattttgttgaattatctatctgtattttgtttctcattgagtttccttcaaaaaaattattatkttgaattctctttctggcaattcattgatttccttttcattagagtctgttcctagagagttaatattcctttcatgatttcttatttccttgctttttcatgtttcttgtgtccctgcattgatgtctctgcatctggtagaacaggagcctcttttatactttcttctagagtggctttcatggagaggttttcacctcacttgggttttactgtgccatttgggaagagaaccgtgactttctggataggagcagtgacattgtttctgtgcagcttcctcacctccatgaaatgtt

SEQ ID NO: 72365 - DNA, 601 bp, Human
aaaaaattattattttgaattctctttctggcaattcattgatttccttttcattagagtctgttcctagagagttaatattcctttcatgatttcttatttccttgctttttcatgtttcttgtgtccctgcattgatgtctctgcatctggtagaacaggagcctcttttatactttcttctagagtggctttcatggagaggttttcacctcacttgggttttactgtgccatttgggaagagaaccgtgactttctggataggagcagtgacattgtttctgtgcagcttcctcacytccatgaaatgttggcaataactgggtggctcagtggcctcagctctggaagtttgtgccagcggtggtgtatgtttttaaggtccttggtgtcaggggcttttggggtcctgctattcttgtttttcccgcaatgggggacttatctgaggggatctttcttggtgtcaggtctgacatggtctgcaagcagctgccacagtgctgggtttcagctacaggtactcagggtagctgtgggactggggtcctagccttagggtcttgtgtgcctatcatggcctggccttggggtgcagg

SEQ ID NO: 72366 - DNA, 601 bp, Human
tatgtgaccattctgggcatttcccaggaagcagggcactgcttcagctcaggcagcagggagacaacgttccctgagaggccacggtgctatttaccaggaggcagggtaccgttgggtgctagagcaagggctagtagaggggctccacctccaccaagccctgctgggaaggggtagcagctgctcacagctggcttggggatgttgggccaccaggtttgggtagtttggaggcagtttagcctcagggatgaaggggagctgtggccacttcccctgagcaagacatactccagcygcagttccagtcccaagatgacggagtatagccgccccatgggcccaacagacagggcccagtgtcagctccttctgtgtgggagcacagctgtgaggatgccagggggctccggtggtgagggctgtgggtgtccagagtggtggcagggctgctgccatcctcttgcttaccccctcaccgtagggagaacctcctcctgggtcccgttgcatcccagctgtagggtgggttgctggcggcccagtgtgttttttttggtttgtttgtttgtttgtttgttttaagacggagtctcgc

SEQ ID NO: 72367 - DNA, 601 bp, Human
cctcccatccagcttcacacactcgcaggtggatattgtgggtgggcctcagtttcaccttcttgcttacataaaggatcgagaaggtgaagaaagtgcagaacgccacatggcacccgtttcccactgcatgacgtggtcactgttagtttatccttccagaaatgtttctgatatagaagattaatttctaaaaagttctttaaacacagatggaaatctgtttcattctttaaattttcatttttttggctgggggaagtagctcacgcctgtaatcccagcactttgggaggccaaggtgggaagattgcttaagcccaggagttcttgaccagcctgggcaacatagtgggaccctgtctctataaaaaataaataaaataaattttcattgttttgtccattgtgaatgggcacacatcgttacgctgtgtcttcatgttttactgcaaatgtgtctgcacttcaccatgtggtgttgacaacgttcctgtcccacagacgccttcctggtgtgtgctgcactgacgctggaggctgtgtccttccctctgtctttccttgtgtcctcggcgtggtcgggcactgactgtcagtc

SEQ ID NO: 72368 - DNA, 601 bp, Human
agagtctgagaccagcctggcaatcatggtgaaaccccatctctgctaaaactacgaaaattagtcgggcgcgcacctataattctacctattcaggaggctgaggcaggagaatcgtttgaacctgggaggcggaggttgcagtgagccgagatcactccactgtactccagcctgggtgacaagagtgagactctgtcaaaaaaaaaaaattatcttttatactagcattaaaaattagcttttttggatagtcttcaccgtgtcttgagttggttatgttgtgagggtggaggttgcrctccgtttcaagtggtcggcatttctgacctgagtattggaaattttatgtttccattgaattcttatatgcacttgagtttatgtctaaatttctttcatctgttgatccagtgttatttcttaccactttcttcttccataatttttcatgataatcatgatttctgtttttcctggataaactttggaatcactttgtggagtcctcctggtctctgtgctcaaagtgaccctgaacccactcctctcccctaaaataatctgttggttgttaattggtctcggtatgaacccactc

SEQ ID NO: 72369 - DNA, 601 bp, Human
cccctaaaataatctgttggttgttaattggtctcggtatgaacccactcctctcccctaaaataatctgttggttgttcattggtctgggtatggttttctgttccccttgcacgtagggaatttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcrcccagtgttctcatggggggaggcaggctgtgtgtgcccatcgtgggggcctggggcatcgaacaggagccgcgggtgcccagacactggccccgtcaggctgcggacacagcagtgagtccccctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaa

SEQ ID NO: 72370 - DNA, 601 bp, Human
aaataatctgttggttgttcattggtctgggtatggttttctgttccccttgcacgtagggaatttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcgcccagtgttctcatggggggaggcaggctgtgtgtgcccatcgtgggggcctggggcatygaacaggagccgcgggtgcccagacactggccccgtcaggctgcggacacagcagtgagtccccctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaaggctggccccgcagacagggagataagaaacagccttcctaccagaaatggaaggtgaac

SEQ ID NO: 72371 - DNA, 601 bp, Human
ttgtttctactttttcggctttgtaagtttctcattcagcaggcatttcacataaatattttatatgggatcttctcaggagaggccccctttcatccctgaaggagtggtggctcgcaggaagaggatggaaactgaggagtccaggaagaagagggtatgctgccgaagctctcgcccagtgttctcatggggggaggcaggctgtgtgtgcccatcgtgggggcctggggcatcgaacaggagccgcgggtgcccagacactggccccgtcaggctgcggacacagcagtgagtcccyctgcagaagcctctctcatggggctctttggcctgagggaagatggccgtgaaccaaatgcatgagtgggatagacagtccccagatggccagaaacagcctcttcctaccagaacctaaaggccggccccacagacagggagataagaaacagcctcttcctaccagaacccaaaggctggccccgcagacagggagataagaaacagccttcctaccagaaatggaaggtgaaccccactgatactgagaggattggagaaaagattgtttcaagtgacaaggggcagagcatttctg

SEQ ID NO: 72372 - DNA, 601 bp, Human
atagcactcagtgggggttcttccattgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgtttccctgttgttttgggatggtggggtgatttttgtagctttctccacgtgtgggtgttgaatgaggctgatgtgttgatgctgctgcatgtggaattgcacgtcgtgctctcttytgcagtggagtcgttgatttgccgtcagtcacaactcattttgcgcacgtagtacttgaagatattaaaaactgctgtaaacgtaaccaccttttttttaactttagagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcc

SEQ ID NO: 72373 - DNA, 601 bp, Human
cctgtaatcccagcactttgggaggccaaggcgggcagatcatgatgtcaggggttcgagaccagcctggccaacatggtgaaacccagtctgtactaaaaaaaatacaaaaaattagccgggcgtggtggcgtgtgcctgtaatcccagttactcaggatgctgaggcaggagaattgcttgaacttgggaggcagagattgcagtgagctgagatcgtgcccctgtactccagcctgggcgacagagtgagactccatctcaaaaaaaagaaagaaagaaaccagggttttggaaagcygtgggaacgtgggaaattacagcaaaaagaaatgagagcttccagtttttctcttttgagatttgctggccctgggactgacttgaagtgatgggttgaggattccctgaccctgggtctgggttgaagtggtggattgaggctgcactccagcctgggcaacagagcaagactgtgtctcaaaaaaaaaaaagctccacagccagcacgagacagcaccatgacgtgcccagggtgtggctgcagaccctgtcctctagatgtgcagtctgcagtttccgtctgatggtttctgtctga

SEQ ID NO: 72374 - DNA, 601 bp, Human
tttatatctgaaatataaattgtgatgctatactataataatcacttttaaatgagagttctaagtttctttaagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggwgcggggctggggtcctgagctctgagcctgggagcggggctggggtcctgagctctgagcctgggagtggacctggggtcctgagctctgagcctgggagcggggctggggtcctgagctctgagcctgggagtggacctggggtcctgagctctgagcctgggagcggggctggggtcctgagctctgagcctgggagtggacctggggtcctgagctctgagcctgggagtggacctggggtcctgagcgctgagcctgggagcggggctggggtcctgagcgctgagcctgggagtg

SEQ ID NO: 72375 - DNA, 601 bp, Human
ctttaagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagcggggctggggtcctgagctctgagcctgggagyggacctggggtcctgagctctgagcctgggagcggggctggggtcctgagctctgagcctgggagtggacctggggtcctgagctctgagcctgggagcggggctggggtcctgagctctgagcctgggagtggacctggggtcctgagctctgagcctgggagtggacctggggtcctgagcgctgagcctgggagcggggctggggtcctgagcgctgagcctgggagtggacctggggtcctgagcgctgagcactgagcctgggagtggacctggggtcctgagcgctgagcctgg

SEQ ID NO: 72376 - DNA, 601 bp, Human
taagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagcggggctggggtcctgagctctgagcctgggagtggrcctggggtcctgagctctgagcctgggagcggggctggggtcctgagctctgagcctgggagtggacctggggtcctgagctctgagcctgggagcggggctggggtcctgagctctgagcctgggagtggacctggggtcctgagctctgagcctgggagtggacctggggtcctgagcgctgagcctgggagcggggctggggtcctgagcgctgagcctgggagtggacctggggtcctgagcgctgagcactgagcctgggagtggacctggggtcctgagcgctgagcctgggag

SEQ ID NO: 72377 - DNA, 601 bp, Human
aagtggagttaaaatcagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagcggggctggggtcctgagctctgagcctgggagtggasctggggtcctgagctctgagcctgggagcggggctggggtcctgagctctgagcctgggagtggacctggggtcctgagctctgagcctgggagcggggctggggtcctgagctctgagcctgggagtggacctggggtcctgagctctgagcctgggagtggacctggggtcctgagcgctgagcctgggagcggggctggggtcctgagcgctgagcctgggagtggacctggggtcctgagcgctgagcactgagcctgggagtggacctggggtcctgagcgctgagcctgggagc

SEQ ID NO: 72378 - DNA, 601 bp, Human
cagctttcttacgtaaagcagcttccgttaagtgaataagaatatttgaccaacaactaatgtgaaattgttactaatgtgaacttgaaatggtgtcactaatatgaaaatactgcgtgtattttcaagacctttagcccatgtgttaatggttcagacgctcctctcctcccctcttgctggagtgacctcatgcctgtcgctgagcctgggtgcggggctggggtcctgagctctgagcctgggagcggggctggggtcctgagctctgagcctgggagtggacctggggtcctgagckctgagcctgggagcggggctggggtcctgagctctgagcctgggagtggacctggggtcctgagctctgagcctgggagcggggctggggtcctgagctctgagcctgggagtggacctggggtcctgagctctgagcctgggagtggacctggggtcctgagcgctgagcctgggagcggggctggggtcctgagcgctgagcctgggagtggacctggggtcctgagcgctgagcactgagcctgggagtggacctggggtcctgagcgctgagcctgggagcggggctggggtcctg

SEQ ID NO: 72379 - DNA, 601 bp, Human
agcaagccccccatgggaggaacagcagagggaactcctgggttgattggcgggtgatcctgctcatccttaggttgcaggattgttccccccaggtggagagcttgagtcacatttagtttatttgtagcgtcttttggcaaagacacttaagatggacacagtctgtcttgctgaaacgtccttttattaaacacaacaacttttagtttcagcgttgtggtaatggagatgcaggagagtctgtgtataaactgcagtctccttcatggaagcctgagcttcactcctctgtgccatkgccatcttgaaacctggctgttaatattggcattgccacttgtcagtcagacctgaggaaaacaggttcatgggcctgagtccttagcttgtgtaagagggagttaaaacagatgtgtgctaaccttctaggtctaaagtgtatctagtcctgggtataaagcttgtcctgggtatgattttcatccagtctttatacaaaaatactcattgagttcctgcagataactgtgctgggcttaagagaaaagagatgtaacagggataactgtgctgggcttaagagaaaagagatgtaaca

SEQ ID NO: 72380 - DNA, 434 bp, Human
cagagactgagacaggatgccacccccaacacctgccactgcccaacggctccagatccggcctcttttcctcccaacacagaacagcaaaacctccaaacccagtttgggaggcagaaaaagaaggaaacaggccgggggtggtggctcatgcctgtaatcgcagcactttgggaggccgcggcgggtggatcacctgaggtcaggagttcagaatcagcctggccaacatggtgaaacctcgtctccactaaaagatgcaaaaattagacgcgcctggtggcgggcacctgtaatcccrgctactagggaggcttgagacaggagaatagcttgaacccgggaggcagaggttgcagtgagccgagattgcgccattgcactccagtctgggcaacaagtgcgaaactccgtctcaaaaaaaaaaaaaaaaa

SEQ ID NO: 72381 - DNA, 601 bp, Human
aagaagccctcacacaggaaggagccccccctgcaggggtttccaaccccggccccctcccagggaaattccctcgaaccaaccaccaggaacaggaggcgcccagcgctgggtccctccgccctgacgcgggcgcggctctttccccaggttcttccagggacagaggctcccgcttctctggaaagggtgggagcctgggagcccctcggctgacccagacggcttcctggagaggcttaggctaagcagggcttatccatgagctctctatccccttaccttcccatttctggggggaaaaaaaaaaagcaaaaaacacctccttctttgccatgagttccaccgtaagtgccatctttgtgggtccacattgctccacagcttcttccacaaatgcaggactgccacccactcccggtctccggtccttctccgcagcctccgaggctgtggttccctccccgcttcccccattcctctctaaccaagactagctaatccctaaaggaagcagggaggtggggactctggggaaaacatgaaagaaaagggaaaggggacagagggcagacttggccccggtagaaccagaaaccaa

SEQ ID NO: 72382 - DNA, 601 bp, Human
cactactgaccggggccaaacctctctaggaagggtcaggcagcccagacaggcaagaggaaatccaatgtgacaccggccccatgacagaggctgtggggataggggagggtggctgggggcagcggggtgggcaggggcagggatttgttcagacatgcccagggccggggctttgaaactcactaaccccactagcaaatggaatgttccagctacacaggaaggaatctggaggctcctgatttcagctgggtgggtagaaggacaaaggttcctcacagtcctgcagccccccctyagattgacaggaggctgaggtctgtgcccaagtgagagggctcaccgctaccaggcttctgaagggttaacctggcatggagggccctccctttccagcctaggcctggctctagaagtagcacagggctcaatcggagaagaaaagaagccctcacacaggaaggagccccccctgcaggggtttccaaccccggccccctcccagggaaattccctcgaaccaaccaccaggaacaggaggcgcccagcgctgggtccctccgccctgacgcgggcgcggctctttccccaggttctt

SEQ ID NO: 72383 - DNA, 601 bp, Human
agcctggcggagggatacactcccggggtcttccctagacctagtcctgccattgggcacctcccactgatccaccccaggttctctgccaggctcagaggccatagacaaaacctaagaccctaggtactgtccccactctatttccaagtaaagtccaggtagctgccaataagtgctaccctccctagagggtaaggagataggagaaaccggggcatagaacctatgcaagatggattcagagggtaaagccctaaggtgggggtaaagaaaccaagtcaatgcttcctttgggccytggagcatgagggatctgcctcagaagccccattcctcaaggccaggaccggagaaggactcaaagggtggacagagctccaggcaggctgggagcagggatggcctggtttgtggagatgggagctgggctctgagggtggtcttgaagaccgcctcctgaagtgacatggccctcctacctgggctgaaggcccccaggctggggcgtgaaatgctgccacccccactactgaccggggccaaacctctctaggaagggtcaggcagcccagacaggcaagaggaaatccaatgtgac

SEQ ID NO: 72384 - DNA, 601 bp, Human
aagatacacacagctggtgaggtcccctccctgggaaagtcactcccaccacccctgcccctcacatcctgaccactgccctgccaggggtgccagaggttcctgggggatcaggaataaaagcccttgtaggggacattctaggcccagagaccaggtgtcaggaccatcctgttcccagagaggcaactggagcctggcggagggatacactcccggggtcttccctagacctagtcctgccattgggcacctcccactgatccaccccaggttctctgccaggctcagaggccatagmcaaaacctaagaccctaggtactgtccccactctatttccaagtaaagtccaggtagctgccaataagtgctaccctccctagagggtaaggagataggagaaaccggggcatagaacctatgcaagatggattcagagggtaaagccctaaggtgggggtaaagaaaccaagtcaatgcttcctttgggccctggagcatgagggatctgcctcagaagccccattcctcaaggccaggaccggagaaggactcaaagggtggacagagctccaggcaggctgggagcagggatggcct

SEQ ID NO: 72385 - DNA, 601 bp, Human; identical to SEQ ID NO: 30054

SEQ ID NO: 72386 - DNA, 601 bp, Human; identical to SEQ ID NO: 30055

SEQ ID NO: 72387 - DNA, 601 bp, Human; identical to SEQ ID NO: 30056

SEQ ID NO: 72388 - DNA, 601 bp, Human; identical to SEQ ID NO: 30057

SEQ ID NO: 72389 - DNA, 601 bp, Human; identical to SEQ ID NO: 30058

SEQ ID NO: 72390 - DNA, 601 bp, Human; identical to SEQ ID NO: 30059

SEQ ID NO: 72391 - DNA, 601 bp, Human; identical to SEQ ID NO: 30060

SEQ ID NO: 72392 - DNA, 601 bp, Human; identical to SEQ ID NO: 30061

SEQ ID NO: 72393 - DNA, 601 bp, Human; identical to SEQ ID NO: 30062

SEQ ID NO: 72394 - DNA, 601 bp, Human; identical to SEQ ID NO: 30063

SEQ ID NO: 72395 - DNA, 601 bp, Human; identical to SEQ ID NO: 30064

SEQ ID NO: 72396 - DNA, 601 bp, Human; identical to SEQ ID NO: 30065

SEQ ID NO: 72397 - DNA, 601 bp, Human; identical to SEQ ID NO: 30066

SEQ ID NO: 72398 - DNA, 601 bp, Human; identical to SEQ ID NO: 30067

SEQ ID NO: 72399 - DNA, 601 bp, Human; identical to SEQ ID NO: 30068

SEQ ID NO: 72400 - DNA, 601 bp, Human; identical to SEQ ID NO: 30069

SEQ ID NO: 72401 - DNA, 601 bp, Human; identical to SEQ ID NO: 30070

SEQ ID NO: 72402 - DNA, 601 bp, Human; identical to SEQ ID NO: 30071

SEQ ID NO: 72403 - DNA, 601 bp, Human; identical to SEQ ID NO: 30072

SEQ ID NO: 72404 - DNA, 601 bp, Human; identical to SEQ ID NO: 30073

SEQ ID NO: 72405 - DNA, 601 bp, Human; identical to SEQ ID NO: 30074

SEQ ID NO: 72406 - DNA, 601 bp, Human; identical to SEQ ID NO: 30075

SEQ ID NO: 72407 - DNA, 601 bp, Human; identical to SEQ ID NO: 30076

SEQ ID NO: 72408 - DNA, 601 bp, Human; identical to SEQ ID NO: 30077

SEQ ID NO: 72409 - DNA, 601 bp, Human; identical to SEQ ID NO: 30078

SEQ ID NO: 72410 - DNA, 601 bp, Human
aaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagargcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagtt

SEQ ID NO: 72411 - DNA, 601 bp, Human
tctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattctyaagatctgaaaaattgggggccctacatttcatttcacaatttacttttttactacgatttgttccatgctgatttcgagcattaaaaaaaaaaaaaattaaatggaggctatttggtggtaacttctcatgaggccattctaccaagaaagatatggcgacctgctgcttcgacattctgatttcctttccagctgaaacactgattctgtggcagaacccaaaagcgtatttattggaaacttgatttctttaagtggaaagaaaagctaaattgattaaccaagtggggtaatataa

SEQ ID NO: 72412 - DNA, 601 bp, Human
ctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattcttaagawctgaaaaattgggggccctacatttcatttcacaatttacttttttactacgatttgttccatgctgatttcgagcattaaaaaaaaaaaaaattaaatggaggctatttggtggtaacttctcatgaggccattctaccaagaaagatatggcgacctgctgcttcgacattctgatttcctttccagctgaaacactgattctgtggcagaacccaaaagcgtatttattggaaacttgatttctttaagtggaaagaaaagctaaattgattaaccaagtggggtaatataatctgt

SEQ ID NO: 72413 - DNA, 601 bp, Human
tagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattcttaagatctgaaaaattgggggccctacatttcatttcacaatttacttttttactacgatttgttccatgctgatttcgagcattaaaaaaaaaaaaaattaaatggaggctatttggtggtaacttctcatgaggccattctaccaagaaagatatggcgacctgctgcttcgacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctgg

SEQ ID NO: 72414 - DNA, 601 bp, Human
gcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttyaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtg

SEQ ID NO: 72415 - DNA, 601 bp, Human
aggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattckaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttct

SEQ ID NO: 72416 - DNA, 601 bp, Human
tatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtgraggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtc

SEQ ID NO: 72417 - DNA, 601 bp, Human
aaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtggaggtggtrgcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaa

SEQ ID NO: 72418 - DNA, 601 bp, Human
cttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaawaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtga

SEQ ID NO: 72419 - DNA, 601 bp, Human
gggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgtyttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattccc

SEQ ID NO: 72420 - DNA, 601 bp, Human
gtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttgttttgttttgtttctttttcatgtcatatgggtaatgtgccgacgtcataacaaggtttcagagtggcacctctcacaccttcatttgaatacccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgcccaggctggagtgcagtggtgcagtggcatgatcttggctcactgcaatctccgcctcctgggt

SEQ ID NO: 72421 - DNA, 601 bp, Human
cccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgccsaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttaccttta

SEQ ID NO: 72422 - DNA, 601 bp, Human
aggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgattttttttttttttttytttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatat

SEQ ID NO: 72423 - DNA, 601 bp, Human
gattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccytcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagaga

SEQ ID NO: 72424 - DNA, 601 bp, Human
taccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccrgaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaa

SEQ ID NO: 72425 - DNA, 601 bp, Human
tacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgccctyggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggt

SEQ ID NO: 72426 - DNA, 601 bp, Human
cgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcrtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttt

SEQ ID NO: 72427 - DNA, 601 bp, Human
tctttctcatgatgggtacatttgggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcartggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcag

SEQ ID NO: 72428 - DNA, 601 bp, Human
gggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcwacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcagcaatagttttcacatttgtttgt

SEQ ID NO: 72429 - DNA, 601 bp, Human
tttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgytcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggc

SEQ ID NO: 72430 - DNA, 601 bp, Human
ggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcrggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgtta

SEQ ID NO: 72431 - DNA, 601 bp, Human
gagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttamcttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttg

SEQ ID NO: 72432 - DNA, 601 bp, Human
tctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttwtctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtac

SEQ ID NO: 72433 - DNA, 601 bp, Human
accatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccagtcccatcatgggggagtttggaggccaggagattcactggatgcttcttttctagtgtrtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagact

SEQ ID NO: 72434 - DNA, 601 bp, Human
gctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttrtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctg

SEQ ID NO: 72435 - DNA, 601 bp, Human
aaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccagrcctttctccatgctgctgtcagagagatctaaacataggtggcctcctgcccttccctgaaaaccctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcct

SEQ ID NO: 72436 - DNA, 601 bp, Human
tggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatggrtgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatc

SEQ ID NO: 72437 - DNA, 601 bp, Human
agataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttatraagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcag

SEQ ID NO: 72438 - DNA, 601 bp, Human
gtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccrtgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttagg

SEQ ID NO: 72439 - DNA, 601 bp, Human
tgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcrtggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaag

SEQ ID NO: 72440 - DNA, 601 bp, Human
cctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggktttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgtt

SEQ ID NO: 72441 - DNA, 601 bp, Human
aggtattttttaatagcatgacattctgttacatggttgattatataatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaaygtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcat

SEQ ID NO: 72442 - DNA, 601 bp, Human
ggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccrtttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttaca

SEQ ID NO: 72443 - DNA, 601 bp, Human
gcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcrggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgtt

SEQ ID NO: 72444 - DNA, 601 bp, Human
ggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcrgaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgcct

SEQ ID NO: 72445 - DNA, 601 bp, Human
atgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagyccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgctt

SEQ ID NO: 72446 - DNA, 601 bp, Human
gttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaatttatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgtt

SEQ ID NO: 72447 - DNA, 601 bp, Human
gctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatasagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatc

SEQ ID NO: 72448 - DNA, 601 bp, Human
tcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaac

SEQ ID NO: 72449 - DNA, 601 bp, Human
ttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaaaaaggaaattggaccccttccctacaccatgyacaaaaatcaacaaaagatggattaaagactgaaatgtaaaacccaaaactataaaaaccctgcaagacaacctaggcaataccattctggacacaggaactgacaaaggtttcatgaagaaaacacaaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaa

SEQ ID NO: 72450 - DNA, 601 bp, Human
gtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaaaaaggaaattggaccccttccctacaccatgcacaaaaatcaacaaaagatggattaaagactgaaatgtaaaacccaaaactataaaaaccctgcaagacaacctaggcaataccattctggacacaggaactgacaaaggtttcatgaagaaaacacmaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatca

SEQ ID NO: 72451 - DNA, 601 bp, Human
agtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattac

SEQ ID NO: 72452 - DNA, 601 bp, Human
tatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacag

SEQ ID NO: 72453 - DNA, 601 bp, Human
ttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtkttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctgg

SEQ ID NO: 72454 - DNA, 601 bp, Human
tgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataattt

SEQ ID NO: 72455 - DNA, 601 bp, Human
aacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgtygcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattt

SEQ ID NO: 72456 - DNA, 601 bp, Human
atactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggagg

SEQ ID NO: 72457 - DNA, 601 bp, Human
cactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgccyttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactg

SEQ ID NO: 72458 - DNA, 601 bp, Human
atcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggartattaaaggaaattcagatagaaagaaaataatatttgatgggaaaaatttttatttatatatattttggagacaggatctcactctagtgtccaggctggagtgcagtgggtgtgatctcggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccaccca

SEQ ID NO: 72459 - DNA, 601 bp, Human
taaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgckcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaatactattataccgctgttcagttagcaggaattaaaaagtttggcaattgttgttgaaaaagttaagcaacagaaactctctcatacccttctgatggga

SEQ ID NO: 72460 - DNA, 601 bp, Human
gtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaatmctattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatat

SEQ ID NO: 72461 - DNA, 601 bp, Human
gttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttktttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaac

SEQ ID NO: 72462 - DNA, 601 bp, Human
gcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagagg

SEQ ID NO: 72463 - DNA, 601 bp, Human
catttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctygccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccatt

SEQ ID NO: 72464 - DNA, 601 bp, Human
tgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacackcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctgg

SEQ ID NO: 72465 - DNA, 601 bp, Human
taattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccsggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttc

SEQ ID NO: 72466 - DNA, 601 bp, Human
agataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggyggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataac

SEQ ID NO: 72467 - DNA, 601 bp, Human
ggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgta

SEQ ID NO: 72468 - DNA, 601 bp, Human
actgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccagatagctgggactacaggtgtgcaccaycacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttt

SEQ ID NO: 72469 - DNA, 601 bp, Human
ggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagsctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctga

SEQ ID NO: 72470 - DNA, 601 bp, Human
acaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcytctcctcttgaggtcccaagatggcgtggggttcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcaca

SEQ ID NO: 72471 - DNA, 601 bp, Human
gtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcctctcctcttgaggtcccaagatggcgtggggytcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtag

SEQ ID NO: 72472 - DNA, 601 bp, Human
ccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgygcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccat

SEQ ID NO: 72473 - DNA, 601 bp, Human
tcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatamgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtga

SEQ ID NO: 72474 - DNA, 601 bp, Human
cctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtyataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcct

SEQ ID NO: 72475 - DNA, 601 bp, Human
agtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatwgaaggtcacggggctgccggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtg

SEQ ID NO: 72476 - DNA, 601 bp, Human
tctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatagaaggtcacggggctgcyggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcggg

SEQ ID NO: 72477 - DNA, 601 bp, Human; identical to SEQ ID NO: 27114

SEQ ID NO: 72478 - DNA, 601 bp, Human; identical to SEQ ID NO: 27115

SEQ ID NO: 72479 - DNA, 601 bp, Human; identical to SEQ ID NO: 27116

SEQ ID NO: 72480 - DNA, 601 bp, Human; identical to SEQ ID NO: 27117

SEQ ID NO: 72481 - DNA, 601 bp, Human; identical to SEQ ID NO: 27118

SEQ ID NO: 72482 - DNA, 601 bp, Human; identical to SEQ ID NO: 27119

SEQ ID NO: 72483 - DNA, 601 bp, Human; identical to SEQ ID NO: 27120

SEQ ID NO: 72484 - DNA, 601 bp, Human; identical to SEQ ID NO: 27121

SEQ ID NO: 72485 - DNA, 601 bp, Human; identical to SEQ ID NO: 27122

SEQ ID NO: 72486 - DNA, 601 bp, Human; identical to SEQ ID NO: 27123

SEQ ID NO: 72487 - DNA, 601 bp, Human; identical to SEQ ID NO: 27124

SEQ ID NO: 72488 - DNA, 601 bp, Human; identical to SEQ ID NO: 27125

SEQ ID NO: 72489 - DNA, 601 bp, Human; identical to SEQ ID NO: 27126

SEQ ID NO: 72490 - DNA, 601 bp, Human; identical to SEQ ID NO: 27127

SEQ ID NO: 72491 - DNA, 601 bp, Human; identical to SEQ ID NO: 27128

SEQ ID NO: 72492 - DNA, 601 bp, Human; identical to SEQ ID NO: 27129

SEQ ID NO: 72493 - DNA, 601 bp, Human; identical to SEQ ID NO: 27130

SEQ ID NO: 72494 - DNA, 601 bp, Human; identical to SEQ ID NO: 27131

SEQ ID NO: 72495 - DNA, 601 bp, Human; identical to SEQ ID NO: 27132

SEQ ID NO: 72496 - DNA, 601 bp, Human; identical to SEQ ID NO: 27133

SEQ ID NO: 72497 - DNA, 601 bp, Human; identical to SEQ ID NO: 27134

SEQ ID NO: 72498 - DNA, 601 bp, Human; identical to SEQ ID NO: 27135

SEQ ID NO: 72499 - DNA, 601 bp, Human; identical to SEQ ID NO: 27136

SEQ ID NO: 72500 - DNA, 601 bp, Human; identical to SEQ ID NO: 27137

SEQ ID NO: 72501 - DNA, 601 bp, Human; identical to SEQ ID NO: 27138

SEQ ID NO: 72502 - DNA, 601 bp, Human; identical to SEQ ID NO: 27139

SEQ ID NO: 72503 - DNA, 601 bp, Human; identical to SEQ ID NO: 27140

SEQ ID NO: 72504 - DNA, 601 bp, Human; identical to SEQ ID NO: 27141

SEQ ID NO: 72505 - DNA, 601 bp, Human
ggggttcaagctgttttcatgcctcagcctgccactacatggggctaatttttgtaatttagtagagatggggtttcaccatgttgcccaggctggtcttgaactcctgacctcaagtgatctgcccaccccggcctcccaaagtgctaggattataggtgtgagccaccatgcccacccagaaagtacttctttaatcagtgacagtgattatttttcctatctatacttactcagatattcagggattagctcctcacagttatccatgatgaaaactctgcgtacatacaatttgatrttgttctttttctttctgttttcaaacagatcaaaaggagcacgtcgtgggacaaatagaagggctctgaattccaactgtccttcaactgaaaaatgctgtaataaaacagatacactaagtaccaatgaacaatgcattatagaagatatttggggtggtggagaaagatgataatctaaggacaagcttgaagcacccatcagtcactcaccttcactgccaagtgatcttcccagtcattggtcaagctcttatagaattctccgtactcctcattagtaatatcgtcgggatttc

SEQ ID NO: 72506 - DNA, 601 bp, Human
cgggatatgtttagagggagatcctccgagtctaccacccctctaatgaagtctgaaaaaaatataaaccaaatgcactgagtcattccaaggacaaaactggtactatgtaaactcccaaaatcaaagataacctgaagatgatgggacgtatttttgagacagtctcactctgttgcccaggctggagggcagtggcgcaatctccactcactgcaacctctgcctcccgggggggttcaagctgttttcatgcctcagcctgccactacatggggctaatttttgtaatttagtagaratggggtttcaccatgttgcccaggctggtcttgaactcctgacctcaagtgatctgcccaccccggcctcccaaagtgctaggattataggtgtgagccaccatgcccacccagaaagtacttctttaatcagtgacagtgattatttttcctatctatacttactcagatattcagggattagctcctcacagttatccatgatgaaaactctgcgtacatacaatttgatgttgttctttttctttctgttttcaaacagatcaaaaggagcacgtcgtgggacaaatagaagggct

SEQ ID NO: 72507 - DNA, 601 bp, Human
aagcattttttgaccaaattcttcctgataactttcaaaattttgctttgttgcaacatctcacgggatatgtttagagggagatcctccgagtctaccacccctctaatgaagtctgaaaaaaatataaaccaaatgcactgagtcattccaaggacaaaactggtactatgtaaactcccaaaatcaaagataacctgaagatgatgggacgtatttttgagacagtctcactctgttgcccaggctggagggcagtggcgcaatctccactcactgcaacctctgcctcccgggggggttcaagctgttttcatgcctcagcctgccactacatggggctaatttttgtaatttagtagagatggggtttcaccatgttgcccaggctggtcttgaactcctgacctcaagtgatctgcccaccccggcctcccaaagtgctaggattataggtgtgagccaccatgcccacccagaaagtacttctttaatcagtgacagtgattatttttcctatctatacttactcagatattcagggattagctcctcacagttatccatgatgaaaactctgcgtacatacaatttgatgttg

SEQ ID NO: 72508 - DNA, 601 bp, Human
acaattttttttttgagatagagtctcgctccatcacccaggctggagtgcagtggtgcgatcttggctcactgcaacctccgcctcctgggttcaggcgattctcctgcctcagcctcccaagtggctaggattacaggccgtgccaccacgcctggtttatttttttctatttttagtagagactgagtttcaccgtgttagccaggatggtctcgatctcctgaccttgtgatccgctgcctcagcctcccaaagtgctgggattgcaggcgtgagccaccgcgcccagccacacacracatagttttctgttttaagttgaaaacatgcgaaaatgggctatgtatgactaagcttgaaagcaccttagaagtatcaatgatcaggaaatgctgtattcacataccttttcaacttttttctccaatatgtctttcatgattttgcagaggttctcaaactttgtttttttctcttcctgcttctttttctcttcttcatcctctggaagttccaggccttctttggtgactgacactaaagtcttcccctcaaattccttcagctgttggacacagtactcatcaatgggctcaat

SEQ ID NO: 72509 - DNA, 601 bp, Human
agcacaggttataatttcatgttttacatgcacaattttttttttgagatagagtctcgctccatcacccaggctggagtgcagtggtgcgatcttggctcactgcaacctccgcctcctgggttcaggcgattctcctgcctcagcctcccaagtggctaggattacaggccgtgccaccacgcctggtttatttttttctatttttagtagagactgagtttcaccgtgttagccaggatggtctcgatctcctgaccttgtgatccgctgcctcagcctcccaaagtgctgggattgyaggcgtgagccaccgcgcccagccacacacgacatagttttctgttttaagttgaaaacatgcgaaaatgggctatgtatgactaagcttgaaagcaccttagaagtatcaatgatcaggaaatgctgtattcacataccttttcaacttttttctccaatatgtctttcatgattttgcagaggttctcaaactttgtttttttctcttcctgcttctttttctcttcttcatcctctggaagttccaggccttctttggtgactgacactaaagtcttcccctcaaattccttcagct

SEQ ID NO: 72510 - DNA, 601 bp, Human
ttaaagtagttgtcatgccatacagactttttaatattaacaaaaataaagaaaaacatccttgaaaatatattatcagaggaattgtagagtactgaacaggtaagtcatccctcagccagagattagtctacttcttccatgcgtgatgtgtcgtcatctccttcaaggggtggcatttcttcagttacagcagcactggtatcatcagcagtagggtcatcttcatcaatacctgtttccaaaataaaatcctcatattacaaagatttcttaaagccagctattagggtaatactcytggtttctatctgctttcaagacagtattacaggacatatgagtctcaatttcatttctttgctcttgtaagaccttacttatccctaaaaaaaacatactttaatacctccaagcagcaagcaggacaaggtgctccaagtttggataactgaaagtttaccattttcttcaatgtcacgtgtgtttattttctttttaacattacatagtataaggcttacccagaccaagtttgatcatcctgtagatcctgttagcatgtgtctggggatcttccagactgaagccagaagacagg

SEQ ID NO: 72511 - DNA, 601 bp, Human
aagcattactagctctgctttagtgcctaaggtatcacagcatcacttagtagacagaaatcttatcttccccttaaagtagttgtcatgccatacagactttttaatattaacaaaaataaagaaaaacatccttgaaaatatattatcagaggaattgtagagtactgaacaggtaagtcatccctcagccagagattagtctacttcttccatgcgtgatgtgtcgtcatctccttcaaggggtggcatttcttcagttacagcagcactggtatcatcagcagtagggtcatcttcrtcaatacctgtttccaaaataaaatcctcatattacaaagatttcttaaagccagctattagggtaatactcttggtttctatctgctttcaagacagtattacaggacatatgagtctcaatttcatttctttgctcttgtaagaccttacttatccctaaaaaaaacatactttaatacctccaagcagcaagcaggacaaggtgctccaagtttggataactgaaagtttaccattttcttcaatgtcacgtgtgtttattttctttttaacattacatagtataaggcttacccag

SEQ ID NO: 72512 - DNA, 601 bp, Human
ctgtgccttgagggcggaccccaccggcatggaggcactgcaggactgggactttggcctctggagaatattctaggaggcagggagtgggggggaacctaggggagcttggtcccatggtcccagccaggctgtgtcctgggagggatgggaggcacccctgtccccacagcccttgtgatgcccagcagtgggtggtcttcccaggaagcgcctgctccatgcccttcccccaaagccttgccttgtcctggtgcctaaagctccatctttagaacactagggaaagtgtccccaacacccccccctctacccaccatccgggtccctggcctgttaggaagtggccgcccaggaagaggcgagcccactcctgcctggctctgcctcccttcagatcagatcagattctcctagggacccctattgtcactgcgccagcgaggggcctgggtgggtgtgcactccttaagtggctgacatctgagatgggacagcttaatcctgaaaccttccccactcccatcagtccatggaagaactgtcttccacaaaactggtccctggtgccaaaaaggttggggactgctgccctagggga

SEQ ID NO: 72513 - DNA, 601 bp, Human
agggtgactgtggggcctgcaggccaagcctctgggcaaaagcttccttccagccccttcacagccactcctgggctgcgtcctcatcctgtcacctgcacacctgccagctcagtcactcctgagtgagggtcactggtgagctgggtcggggtgtcggctccagatgtggggtccaggcctggggcccccgcgtgtgcgggtggggaggatggctcaatgggcttggcctggcccattcctgccccatgcggggtcagggaccctgggcctcatttccaccccagggccgcttggttcmttccttcaggttttccaaagctgccttaacccaaaagctgccacgcactggggagggcacccacagcaagatggcgacgctcccacccgggaaacaggaggagggcagggagagggaggcggttgccccttgtggcccggcccccagaacccacgcataaccttggcaaccaggcagcccgagtgaggggggcactgggagctgatgggggacctgtgggcagaggagtcaggctgggctgggggttccagggcatggatttccccctactcccctcccctgccggcctccttactttca

SEQ ID NO: 72514 - DNA, 601 bp, Human
ccttccagccccttcacagccactcctgggctgcgtcctcatcctgtcacctgcacacctgccagctcagtcactcctgagtgagggtcactggtgagctgggtcggggtgtcggctccagatgtggggtccaggcctggggcccccgcgtgtgcgggtggggaggatggctcaatgggcttggcctggcccattcctgccccatgcggggtcagggaccctgggcctcatttccaccccagggccgcttggttcattccttcaggttttccaaagctgccttaacccaaaagctgccacrcactggggagggcacccacagcaagatggcgacgctcccacccgggaaacaggaggagggcagggagagggaggcggttgccccttgtggcccggcccccagaacccacgcataaccttggcaaccaggcagcccgagtgaggggggcactgggagctgatgggggacctgtgggcagaggagtcaggctgggctgggggttccagggcatggatttccccctactcccctcccctgccggcctccttactttcatgatctcctttggaagcacttgggctctgaaaggaggcaatactc

SEQ ID NO: 72515 - DNA, 601 bp, Human
tgctcactgtggacttgcctgcagtgtcctgtgctgaacagaaaccttcattttaatcgacctaatgcaaaacgccttaccttagaactgtgttttttctgtttcgtttgagaatcgcgtctgctcctcagtcacaatggtaatggactgtgtacctatggggcacgtgcaccagcgagggctcctgctgtgtttctctccttagagtgaacccagcttccagcatcctccgccttgcccttttgttctagcactgctggaatccgtcgtgtgcctgggtgttgtgggtctctctgagccytgtcttcaagtccacaggccgctttgccgaccctacactatccacacagtggctctgcaggatggcttaatatccatccccttcactcctgctccaaggttctttgtggatctcattgttgcagataaattgtagaataggtttgccaggtaacaactaccaccaccaccaccaaaaaaaccctggattttttttttttttttttttgagatggagtcttgctctgccacccaggctggagtgcagtggtgtgatctcggctcagtgcaacctctgcctcccgggctcaagcgattctcc

SEQ ID NO: 72516 - DNA, 601 bp, Human
gtttgagaatcgcgtctgctcctcagtcacaatggtaatggactgtgtacctatggggcacgtgcaccagcgagggctcctgctgtgtttctctccttagagtgaacccagcttccagcatcctccgccttgcccttttgttctagcactgctggaatccgtcgtgtgcctgggtgttgtgggtctctctgagccttgtcttcaagtccacaggccgctttgccgaccctacactatccacacagtggctctgcaggatggcttaatatccatccccttcactcctgctccaaggttcttygtggatctcattgttgcagataaattgtagaataggtttgccaggtaacaactaccaccaccaccaccaaaaaaaccctggattttttttttttttttttttgagatggagtcttgctctgccacccaggctggagtgcagtggtgtgatctcggctcagtgcaacctctgcctcccgggctcaagcgattctcctgcctgagcctcccaagtagctgagactacaggaattttgattgggataaataacagccttatgctgtcaagccatccattcaagagcatggacggactctctct

SEQ ID NO: 72517 - DNA, 601 bp, Human
tgtgtttctctccttagagtgaacccagcttccagcatcctccgccttgcccttttgttctagcactgctggaatccgtcgtgtgcctgggtgttgtgggtctctctgagccttgtcttcaagtccacaggccgctttgccgaccctacactatccacacagtggctctgcaggatggcttaatatccatccccttcactcctgctccaaggttctttgtggatctcattgttgcagataaattgtagaataggtttgccaggtaacaactaccaccaccaccaccaaaaaaaccctggattttttttttttttttttttgagatggagtcttgctctgccacccaggctggagtgcagtggtgtgatctcggctcagtgcaacctctgcctcccgggctcaagcgattctcctgcctgagcctcccaagtagctgagactacaggaattttgattgggataaataacagccttatgctgtcaagccatccattcaagagcatggacggactctctctaaatatttcaggtcatccatggcctctttagcatcttaaagttttccctgtagaggtcttatattgtattggttaattcatca

SEQ ID NO: 72518 - DNA, 601 bp, Human
tagagtgaacccagcttccagcatcctccgccttgcccttttgttctagcactgctggaatccgtcgtgtgcctgggtgttgtgggtctctctgagccttgtcttcaagtccacaggccgctttgccgaccctacactatccacacagtggctctgcaggatggcttaatatccatccccttcactcctgctccaaggttctttgtggatctcattgttgcagataaattgtagaataggtttgccaggtaacaactaccaccaccaccaccaaaaaaaccctggattttttttttttttytttttgagatggagtcttgctctgccacccaggctggagtgcagtggtgtgatctcggctcagtgcaacctctgcctcccgggctcaagcgattctcctgcctgagcctcccaagtagctgagactacaggaattttgattgggataaataacagccttatgctgtcaagccatccattcaagagcatggacggactctctctaaatatttcaggtcatccatggcctctttagcatcttaaagttttccctgtagaggtcttatattgtattggttaattcatcaatactttgttaagt

SEQ ID NO: 72519 - DNA, 601 bp, Human
tcacggctcactgcagccttgacctccctgggcgcaaacaatcctcccacctcagcctcccgagtagctgggactacaggcttgtgccaccacgcccggctaatttttgtagtttttgtagagatgggggtctcactatgttggccaggctggtcttgaactcctgggctcgagtgatatgcccgcttcggccttccaaagtgttgggattacaggcatgagccaccgctcctggccttaagtttggtttctattataaatgttgccctatatttaaaaattatatcctctttttattttkaaattttttgtagagatggagtctcactatgtttctcaccaggctgatctcaaactcctggccttacctactgtgctcgtctgttcaactattatgttacgtttctatttttccccttcgttctttaaaaaacggtgttcttggtatgcttcctcctgggaacccctccctgttcctgaggcgctttgagctatgacacattccgtccccacggctccacctctgcacctgtggggggacttgccctgctggcagtgccacaccctcaggtgtgcacggaactgaagtgtgacctcacgt

SEQ ID NO: 72520 - DNA, 601 bp, Human
gtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggtgagcgaggccgcagtggagtcgcgggggccgcgcg

SEQ ID NO: 72521 - DNA, 601 bp, Human
tcatcctttctaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaaggtacttgcgtctgtgctttgggaatttttgccaacaaacttccttagaggattgtaagataaaatgttaaacacacttagaaaagatagcggcagggtgtgttcatgaaatccttttgtcttgttgaagtctttggcccttagtgcrtgctgaatattttatgcttgtttgaaatatttagtttattacttctccaaactaaacctttgttcattttgttcttccttttcgctatggatggaaaagagaaaaggttatttgtcaagttaatagtttcttacatagttatatgttaaaacataaagagaatcagaatacatacattaattgttataaagacctaactttttccaagcaaacaaataacattggcttatttggaacatcatcatctttgccaagagattgcttatttattaattttctcaaatccaaacacagtcatgt

SEQ ID NO: 72522 - DNA, 601 bp, Human
attttatgcttgtttgaaatatttagtttattacttctccaaactaaacctttgttcattttgttcttccttttcgctatggatggaaaagagaaaaggttatttgtcaagttaatagtttcttacatagttatatgttaaaacataaagagaatcagaatacatacattaattgttataaagacctaactttttccaagcaaacaaataacattggcttatttggaacatcatcatctttgccaagagattgcttatttattaattttctcaaatccaaacacagtcatgtatcacatgkcaaagttgatcagtcagcagcagaccacgtgtacagcagtggtcccataggattataacactgtttttactgtaccctttctatgtttagatacacaaatacttaccatcatgttatagtcgcctacagtgttgagtacagtaacttgaaagtttgtggcctgggagcaataggctataccatctagcctagatgtggggtaggctatgctatctgggtttatatgatgtttgcacaacgactttttttttttgagagagagagtctcactctgtcatccgggctggagtgcagtggtgc

SEQ ID NO: 72523 - DNA, 601 bp, Human
gcggctttggtgacagtgtgcagacagcaatgatagcaaataatgtacgaatgttttttgcattcaaaggacatccacatctgttggaagactttgagtttttgttcttagataacccactttatttgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttattt

SEQ ID NO: 72524 - DNA, 601 bp, Human
cagtgtgcagacagcaatgatagcaaataatgtacgaatgttttttgcattcaaaggacatccacatctgttggaagactttgagtttttgttcttagataacccactttatttgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcascagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctc

SEQ ID NO: 72525 - DNA, 601 bp, Human
cagacagcaatgatagcaaataatgtacgaatgttttttgcattcaaaggacatccacatctgttggaagactttgagtttttgttcttagataacccactttatttgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgarctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaa

SEQ ID NO: 72526 - DNA, 601 bp, Human
cagcaatgatagcaaataatgtacgaatgttttttgcattcaaaggacatccacatctgttggaagactttgagtttttgttcttagataacccactttatttgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcwggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatgg

SEQ ID NO: 72527 - DNA, 601 bp, Human
ctggctctacgccggcactcacctcgtcgatctcacactggaccacggactccacggaggggtgcttcaccacctcccgcaggacacctccatctccgcccccgatgatcagcacctgggaggagggggcagtcaaggcaggggccctggcaggactgggagcccccaggcccctgaagcagaccccctgacccctcggacccacgggcctcatctttttctaccctcggaaacgctttcgtgccggtgtcccctttcctggaagttccttccagggctgccctaggattccgaggccgcrtcagtgtcggcccccacccctccgcgggacgcccctggcctcgctagcactttctctgacaaccatgcaggcagcatctgggaagagcccggagcacacctggggccgcccctcgtccggcactgttccaggggacactggggtacctttcgcgggttggggtggctgcagagaggcaggttggcgatcatctcctggtaggagaactcgtctctctccgtgcactggatgacaccgtccaacaccagcacgttgccataggtcttactgcgggcggagtgacagtcggggacctgggtt

SEQ ID NO: 72528 - DNA, 601 bp, Human
cctggggctcagattaaaaatcagcttagtcggctgggcgtggtggctcacgcctgtaatcccagtactttgggaggacgaggctggcggatcacctgtggtcgccaggtccgagaccagcctgaccaacatggagaaaccctgtctctactaaaaatacaaaattagccgggcatggtagcgcatgtctgtaatcccagctactccggaggctgaggcagaagaactacttgagcccaggaggtggaggttgcagtgagccgagatcgcaccatcacactccagcctgggcaacaagagsgaaactctgtctcaaaaaaaaaaaaaaaaaaaaaatcagctcagttttagtaagagctcgccacgcaggtgccctcaccacctgccaggccctctgccatctggttttcctactgaaccctccccgaccaggtgttttccagatggagaaacaggccctacctgccttgctcgggggtgtgcagccatttcagggcacagctggccgctgggagaaccaggactcaaacctggctctacgccggcactcacctcgtcgatctcacactggaccacggactccacggaggggtgcttcacc

SEQ ID NO: 72529 - DNA, 601 bp, Human
aatgtgtaaagcggggagaactctggtacctccatttctccttgagagctggctcctgccggcggcttgggctcctctctcccatccctaccccctccttccagaccaaatcgccccatctgagtggctttcttgtcgcttcctattttatttatttttcgagacagtcttgctctgctgcccaggctggagtgcagtggcacgatctcagctcactgcaccctcctgcctcagcctcccgagtagttgggattacaggcgcacgccaccaagctgggccatttttttttttttttttttwtttttagtagagaccttgtgatctgcccgcctcagcctcccagagtgctgagattacaggtgtgagccaccagcgcttggcctgtttcctattttagaaggatgcaattccaacctctggccaggagaacctccccctccctgcacacggccacctgcttttcactgaggtctcagctcaaacgccacctcctggaggcctgccctgaccaccccccatgcattcacaggaaccctgccttctcctgtcccccagcccctgtcttgccttcatcagaccatcctttgatgtctctatttt

SEQ ID NO: 72530 - DNA, 601 bp, Human
gagcacatcggccaccactgcaggggggcacaagccggtggcgcgctcgaggaagcccgccggcccagacgcccccgcccccgggcccgcaggtccagcctccctaccttggccaaagttgaggtcttgtcgtgtgagcgtggtcatccttcccgctacctgagtgttggggcaagggcagagggtagttccagagacccaggagcccagaacccgctcgcttccaccgtctcttccctccccacagtctgtgggaactggggaaggacctcccgcttcgcacaggctcagggcagctggmagaacctccacccccacgctggcgtccgtgcttgggggcatcagcctctatccactggccgcccgcgccccctcgccccgctgtctcgcggggtggaaagaccacagctgtgcccccgaaaagggcagggccgcggacgcagagggaaacagcgggatgcccagggccgggagcgcaaagcgggacatgcggaaagcgaagcggggttggaataagactccgccccctgctacgccggatccctcccggcgggaatcccgccccctctcccctcccccagtaccggctctgcgctcggtt

SEQ ID NO: 72531 - DNA, 601 bp, Human
actctgtggttctgggacgtgcctcacctggaccggcacgttgtacttcttgcgtttctggaagatgcccacggggtagacctcgcgcacgtagaggatgagatgcacagccacctccaggaactcgcagagcacatcggccaccactgcaggggggcacaagccggtggcgcgctcgaggaagcccgccggcccagacgcccccgcccccgggcccgcaggtccagcctccctaccttggccaaagttgaggtcttgtcgtgtgagcgtggtcatccttcccgctacctgagtgttgggrcaagggcagagggtagttccagagacccaggagcccagaacccgctcgcttccaccgtctcttccctccccacagtctgtgggaactggggaaggacctcccgcttcgcacaggctcagggcagctggaagaacctccacccccacgctggcgtccgtgcttgggggcatcagcctctatccactggccgcccgcgccccctcgccccgctgtctcgcggggtggaaagaccacagctgtgcccccgaaaagggcagggccgcggacgcagagggaaacagcgggatgcccagggccggg

SEQ ID NO: 72532 - DNA, 601 bp, Human
taaaaatacaaaaattagccagatgtggtggcacacgcctgtaatcccagctactcgggaggctgaggcaggagaatcacttgaacccaggaggcggaggttgcagtgagccaagatcacgccactgcactccagccagggcgacagagcgagactcagtctcaaaaaataaaataaaataaaatataaaataaaaaataaagtgctgactacctcaagtaatgtcttgaataccatactggaagtgagaaaacaatggtggtgtggggacttgaagcggggaccacctggatgtcctttragcttctaccacttattctcatgtttcctgagtgccttccagagacaggcacttctagggactggagctacagtgcgatgcacactgctttgtctgccttttagccttaacccattgagtttaggataaatggtagggagaagatttggaggtttttggaaataccctcctcacaccaaggttcaccagcttcacgagctccttcaaagtgccaccatgcccccagggtaacttttttttttggagacatagtcttgctctgtcgcccaggctggagtgcagtggcacgatctgggctta

SEQ ID NO: 72533 - DNA, 601 bp, Human
cacggcgaaaccttgtctctactaaaaatacaaaaattagccagatgtggtggcacacgcctgtaatcccagctactcgggaggctgaggcaggagaatcacttgaacccaggaggcggaggttgcagtgagccaagatcacgccactgcactccagccagggcgacagagcgagactcagtctcaaaaaataaaataaaataaaatataaaataaaaaataaagtgctgactacctcaagtaatgtcttgaataccatactggaagtgagaaaacaatggtggtgtggggacttgaagcrgggaccacctggatgtcctttaagcttctaccacttattctcatgtttcctgagtgccttccagagacaggcacttctagggactggagctacagtgcgatgcacactgctttgtctgccttttagccttaacccattgagtttaggataaatggtagggagaagatttggaggtttttggaaataccctcctcacaccaaggttcaccagcttcacgagctccttcaaagtgccaccatgcccccagggtaacttttttttttggagacatagtcttgctctgtcgcccaggctggagt

SEQ ID NO: 72534 - DNA, 601 bp, Human
aattccttaacttctctgggcttcaatcacttcatcataaagaagaagtgagtaaatgtcaattgttttttcctttcccctctaaaggtgaccttcaacttactatgggtttatgtttggataaaccaatcaaatatcgccagcggaaaatgcagttaatacacataacatacagaacatcatagcttagccaggcctacctaaacacactcaaaacacattagcccacagttgggcaacattatctaacacaaaacctgtttcataataaagtgctcacgcctgtaatcccagcactttrggaggccaaggcaggtggatcaccagaggtcaggagatcgagaccagcctggccaacacggcgaaaccttgtctctactaaaaatacaaaaattagccagatgtggtggcacacgcctgtaatcccagctactcgggaggctgaggcaggagaatcacttgaacccaggaggcggaggttgcagtgagccaagatcacgccactgcactccagccagggcgacagagcgagactcagtctcaaaaaataaaataaaataaaatataaaataaaaaataaagtgctgactacctcaagtaa

SEQ ID NO: 72535 - DNA, 601 bp, Human
atcgcttgaacccgggaggcggaggttgcagtgagccgagatcacgccactgcactgcaacatgggcaacagagcgagactccatctcaaaaaaaaaaaaaaaaaaccagaggctaagaactgtgaacttatccatagagaaagaagttagaagataagaactcaggctgggcacagtggctcactcctctaatcccagcactttgagaggatgaggtgggtggatcacctgaggtcaggagtttgagaccagcctggccaaaatggcaaaaccccatctctactaaaaatacaaaaattrgccaggtgaggtggcacctgtaatcccagctacttgggaggctgaggcaggagaatcacttgaacctgggaggcggaggttgcagtgagctgagatcaagccactgcactccagcttgggcaacaaagcaagactccatctcaaaggaaaagaaagataagaactcaatcccaatatgagcatttaatataccattaggggttcttaatgtggggtccatggactcctccagagtctgaaaaatccctaaagttgtatctttgtgcacttgggcatttttccagaaaaaggatccaggaa

SEQ ID NO: 72536 - DNA, 601 bp, Human
gactagatggggaagaaaccctgaggggctcagctcagacagaacgtttagcgtggagaacaggggacggatgtgagaagaaccccgaaccctctggggcagcccctacttagagccagctccaacccgggctcccaggcccaaggcaccctgaacatggcccgcatgccttggggcctgcccctgggttgggatggtctccagagtgcagggaacaggcttctgggtattggagccatgaagaccccacagagtcctagcttcaccccatcccagagttggactgtgagcacacagggaygggggtgagcatggggtgagatggctggggagcccagtgcaccctcaccttctccaggagtggcttgacgcagtgcagcgtgtcctggatatactgattcagctccgggtggcaggacatctgcacacaataccatgcggctcgtgaggcccaaagcacagatggggaaaccacccaacacaaccaggagcctaaggccccatctgccttcggtccgaggcccagcagctctccagggctccctacccaggagaccccactttccctcaagaggctaagaactggccgggcatggtggct

SEQ ID NO: 72537 - DNA, 601 bp, Human
tgctcacaggctgtccccttgtcatgctggtgcttcttgccctttctcctcccaggcctttaccaaggtattcaagggccgccttaaaggggtgggtgtgttgccagagacacacctgatgccagctagtgggcgaggggcaggggcagcccacctgatggacagcagtggaggctgggtgatctcaaagacgaatttctccactgggcggtgctctttatccaaaatcaccaccaccactttctccacatcattctgcaaagagaggaacccccactgcagagccaggcaccccaccccsactacaccaccctgcctccacccccttgcccaaggaaggaggagaaacggcccactcacagccctgctcagctgctaggctgggggtccccaagaggccagatagcgagtttgagaagccggcaccctccagcatgagtggtgtaggctgagagaatgcccgggccccatagggaaggtcccaggaagtctgagatcaggactagatggggaagaaaccctgaggggctcagctcagacagaacgtttagcgtggagaacaggggacggatgtgagaagaaccccgaaccctctggggca

SEQ ID NO: 72538 - DNA, 601 bp, Human
cctgaggacctgctgggtgccaggcgctgccacaccaatgtaatgggtggctggccacaggcagtgcccctgcccgcctggaactgcgacatcacgtttctagagcctgcgcccagacccagacccatctcatctcaccttgatgacctggatcttctccatgttgcgagtggcggcttctctcgtgtgcaccaggactgtgaaggtacagcctggagaggcaagaggttggtggaggctcccccaccgccctggtgccagccactgggcccagcctcttcccacttcccttgctggctcrgcagcacccccagagcagatggcaaagcaagtgctaagaaaagccccagtcaatagggagatggaagccaggtagaatcaatcagggaagcttcccagaggaggtggactctcagggttaggaagagatgagtctcagaacagccaaacatggacctgggaacacagaccaacccgagataaccatggaaatgccaagggaagagagggtggggagtggacacacctggggggttgtggtccaggacggcatcgcacacgctgatcttcaggatgaaggcccggagcagctgctccacat

SEQ ID NO: 72539 - DNA, 601 bp, Human
cactgccccaagtgcccagatggagcagtggacaggcctgaggacctgctgggtgccaggcgctgccacaccaatgtaatgggtggctggccacaggcagtgcccctgcccgcctggaactgcgacatcacgtttctagagcctgcgcccagacccagacccatctcatctcaccttgatgacctggatcttctccatgttgcgagtggcggcttctctcgtgtgcaccaggactgtgaaggtacagcctggagaggcaagaggttggtggaggctcccccaccgccctggtgccagccamtgggcccagcctcttcccacttcccttgctggctcagcagcacccccagagcagatggcaaagcaagtgctaagaaaagccccagtcaatagggagatggaagccaggtagaatcaatcagggaagcttcccagaggaggtggactctcagggttaggaagagatgagtctcagaacagccaaacatggacctgggaacacagaccaacccgagataaccatggaaatgccaagggaagagagggtggggagtggacacacctggggggttgtggtccaggacggcatcgcacacgctga

SEQ ID NO: 72540 - DNA, 601 bp, Human
tgttggtgatgcagaccccaggaccccccccatcccccacagaggccaagtccatagaacccaagtgacgaacaggctccaggcaccaacgctgaacctggtgggctaggacccctccctggagagcccccacttcagaagagccaggatgagctgggggccccagtaggtggctccacctgggctcctcactgccccaagtgcccagatggagcagtggacaggcctgaggacctgctgggtgccaggcgctgccacaccaatgtaatgggtggctggccacaggcagtgcccctgcccrcctggaactgcgacatcacgtttctagagcctgcgcccagacccagacccatctcatctcaccttgatgacctggatcttctccatgttgcgagtggcggcttctctcgtgtgcaccaggactgtgaaggtacagcctggagaggcaagaggttggtggaggctcccccaccgccctggtgccagccactgggcccagcctcttcccacttcccttgctggctcagcagcacccccagagcagatggcaaagcaagtgctaagaaaagccccagtcaatagggagatggaagccaggtag

SEQ ID NO: 72541 - DNA, 601 bp, Human
ggtggggcctcgtggccatagccatggtggagaagagtagagatgggaggagccctccaccaggcactcccccgttctctcccgcaagccctctagtaaggcctcagcaccgggcctcacttcgttaagcagcccctaaataaagcttcccgggtccccacgaagctcacctttaaaatgtccgacgtcatggtttttagtggtatcagccgggggtcatgcatgtggacatcctgctcatccgccaggatccaggggaaatcctagggaggagacaaaggtcaggggggtgacggggctrggccctggcctgccctcactttgctgtccctcccactccagaccaggggcctccaacctgagcctcagaatcactaggaagctgttggtgatgcagaccccaggaccccccccatcccccacagaggccaagtccatagaacccaagtgacgaacaggctccaggcaccaacgctgaacctggtgggctaggacccctccctggagagcccccacttcagaagagccaggatgagctgggggccccagtaggtggctccacctgggctcctcactgccccaagtgcccagatggagcagt

SEQ ID NO: 72542 - DNA, 601 bp, Human
caccacaggtggggcctcgtggccatagccatggtggagaagagtagagatgggaggagccctccaccaggcactcccccgttctctcccgcaagccctctagtaaggcctcagcaccgggcctcacttcgttaagcagcccctaaataaagcttcccgggtccccacgaagctcacctttaaaatgtccgacgtcatggtttttagtggtatcagccgggggtcatgcatgtggacatcctgctcatccgccaggatccaggggaaatcctagggaggagacaaaggtcaggggggtgayggggctgggccctggcctgccctcactttgctgtccctcccactccagaccaggggcctccaacctgagcctcagaatcactaggaagctgttggtgatgcagaccccaggaccccccccatcccccacagaggccaagtccatagaacccaagtgacgaacaggctccaggcaccaacgctgaacctggtgggctaggacccctccctggagagcccccacttcagaagagccaggatgagctgggggccccagtaggtggctccacctgggctcctcactgccccaagtgcccagatg

SEQ ID NO: 72543 - DNA, 601 bp, Human
acccaggcggaggctctgcggccgcctccaccccggccacatcccgaggccggcgccgggttcggagaactgtcaagggacctccaggcccccacacgcctgcgagatccggcgcttgccttgccccagccacagtttctgtttccgagaaaccggtgaagtaacaatgccactagagcttgctgggagggtgggtgcggagaaggcgagcacgagacgccgggccgggcagttggggaccccgatcggtgtgagagggcttcctagggctggcatggacttccccaccacaaaatgcccmgggccgggggggggaaggggcgcaagaaaatgcggactgggccagagaccagacttcggtcaccacggtgggaagctattggtgcctagatgcctctagcttggagcccagtgacttttatttcgtctagagtctagacagtgcctttagaagctgccagcatttatttatttatttatttatggcagagtcttgctctgtcacccaggctggagtgcagtggcatgatcacggctcactgcagcctcgacttcctgggctcaagcgttcctcctgcctcagcctcctgcatagctggga

SEQ ID NO: 72544 - DNA, 601 bp, Human
aggctctgcggccgcctccaccccggccacatcccgaggccggcgccgggttcggagaactgtcaagggacctccaggcccccacacgcctgcgagatccggcgcttgccttgccccagccacagtttctgtttccgagaaaccggtgaagtaacaatgccactagagcttgctgggagggtgggtgcggagaaggcgagcacgagacgccgggccgggcagttggggaccccgatcggtgtgagagggcttcctagggctggcatggacttccccaccacaaaatgcccagggccggggsggggaaggggcgcaagaaaatgcggactgggccagagaccagacttcggtcaccacggtgggaagctattggtgcctagatgcctctagcttggagcccagtgacttttatttcgtctagagtctagacagtgcctttagaagctgccagcatttatttatttatttatttatggcagagtcttgctctgtcacccaggctggagtgcagtggcatgatcacggctcactgcagcctcgacttcctgggctcaagcgttcctcctgcctcagcctcctgcatagctgggactacaggcac

SEQ ID NO: 72545 - DNA, 601 bp, Human
tagagtgtgacctcggcaggcctcatggactgtaaggtagaaaaatctgaggggctgggttcggtggctcacacctgtgagctactgcagccttgacctcctgggctcagaagatcctgacgccatagcctcccaagtagctaggaccataggcactcgccactatgcccggcgaattttttcactatttatagagacggggcctccctgtgttgccaaggttgcaaagccttttttcttttctttttttttttttttgagacggtgccttgtactgtcacccaggctggagtgcagtggygcaatctcggctcaccacaacctccgcctcccaggttcacacgattctcctgcctcagcctcctgagtagctgagattacaggtgcacaccaccacgcctggctaatttttttgtatttttagtagagatggggtttcactgtgttggccaggctggtctcgaacttctgaccttgtgatccgcacccctcggcctcccaaagggctggggttacaggcttgagccaccgcacccggcctgcaaagcatttttcacgaggcacaagtacctcacctgttttctctgccatgtaaagtgtt

SEQ ID NO: 72546 - DNA, 601 bp, Human
tccagtaagtggcagacacagggtgcagtgggcacaaaggtgagtgtgttgtttttgtgaccagagactctgtccttacctatggccaagatgccacctttcctctcattggcatctgagctggaaaccaattcaaaaatgtgatggttcagttggtcatagaagcgagtagactcctcttgactcatctgcaaaagaagatataatcagaacaatttctaataattctctaactgtggtggtgggagtgggctggcatctaaagattagatcctgagaggcaggaggtatagttcaaacsaaagaagacaagttactgcccatttctataggattacactgtagagtacctgaacttgcaatcatctgattatttaacaaatatttattaggtatctactctgtggcagaaaatgtcctgtcctaggttctttctagtaccagggataaaaggagaaacaagatactgtctctgacctcaagtctggtctctatttagaaagcccctagctctcaactctccaaacccatcccaatcactgttatcagacagaaagcatttgagggtgtggtatgtggtaaggaaaaaataaaaagttaa

SEQ ID NO: 72547 - DNA, 601 bp, Human
ggctaatttttgtatttttagtagagacagggcttcaccatgttaaccaggctggtctcaaactcctgacctcaagtgatccacccatctcagcctcccaaagtgctgtgattacaggtgtaagccaccacgcccagccccagcttcaattctcataataagcctttgaggaagataccatcatcatccctatttaacagctaaaaacacaggctcaaagaatttaagtgacttgtccaagatcacacagcaaaggcaagactggaacccgcatctcccaatcccatgttcagagctcttattctaatataagactcactgataagttccctctgcagcagtaatcagcacaggcctcattatactagagcagagagaaatggcactttctaaattagtatcatttgtatctcactgattttgagacacctatttttccgtattttaacatctctgaaaagagatgtcttttttttttttttgagacagagtctcactctgttgtcaagtctggagtgcagtggcatgatcatgactcactgcagccttgatctcttgggctcaagcaattctcccgcctcagcctcccaaatagctggga

SEQ ID NO: 72548 - DNA, 601 bp, Human
aaagtaaatgctatgtaaatatttgttgcactgtatttttaaaaatttgtattatctttaaattgtttgttttttccttgattttttttttctttttaaaaagttaaaaaaatttttttgtagagacacggtctcaccgtcttttgcccaggctggtcacgaactcctgggatcaagtgatcttcccacttcagcctcccaaagtgctgaaattgcaggtgtgggccactgcacccagccctgggtatttgtgaaccatgactagttgaatccagatgtagaactcatggatatagagagycaacatcatatagaaaccgcacaagagcccaatgaggtaggtaagagcccctgtccaaagggagaaaaatgaggctaaacaggtaacttgcctgagtcgcacagtcatcagagcggtggggatctgaagccagactcctcctgcttctgcacactgctgcatgcgctgctcccacatctgggcatggctattatctaacaagcactgtgtctattataagcaggaatccccggggtaaaatttcacagctcattttctacagccagtctcacagatggagctttacctcccaaatatatc

SEQ ID NO: 72549 - DNA, 601 bp, Human
tccactgctcaaagcccacttatagcttcccgcttcccacacaaaggccctatgtgatatgccccctccttcccttaggtgttcctctgaccccatatccccacacacttctcctgctcactctgctcagccatggtaggggagctgctactgcagtatttgctgctcctctaatacaccagcacgctcctgcctcagggaccactgcctagaatgctcttccccagatacctgtagggcttttttctaacctccttcatggctgtgctcaaatagcaccgtgttttaaaatgtaatcctyaatccaggtgagcatactctattccccttccttgccctacttttctccatagctcttataaccatatgatatataataggtttttacttgtatattatctatcttcccttataagaatggaatctattttgttcactgctggattattctagctcttaggacacagtgtagctggcatatactaggtgctcaattaatatgtgttgaatgaatgaacaaattatgaaattttaataccttatatttagatagtttctttttttttttttttttttagtgacaaggtctcattatgttgcc

SEQ ID NO: 72550 - DNA, 601 bp, Human
gggctcctcacttcccagtaggggcggccgggcagaggcgcccctcaaccagtgagtcttaagctgctaaatccaatggtcaattcttagtcctcatcttatttgacttatctgcagcatttcatccaactgatacttccacctccttgacgccctttcttcacctggcttctcagactctaaactctcctggctctcctcctccctccctggctgttccttccccatctgccttggtcctcttcatctcctgacctcaggtttgcagactccatctcttctccaactgtactagttccctgtgcttctcacccagtctcatgatgaaataacatctatacgctgacaatgcccaaatccatcccccttgcccagctctctccccagaactattcagtatcctcactcaggtgcccaacaggtctctaagttaacaggttcaaaaccaaattcccagtcttctcccgcaagcctgctgctcccatttcagtcttcccactgcagtgaatggcaacttcatcctcctaatactcaggccaaacaccttgacacttctttctctccatctacctccaaaccatcagcaaatcccaaattcaga

SEQ ID NO: 72551 - DNA, 601 bp, Human
aaaatacaaaaaattagctgggcgtggtggtgggcacctgtagtcctggctactcgggggctgaggcaggagaatcacttgaacccagcaggcagaggttgcagtgagccaagattgcaccactgcactctagcctgggcgacaagagggaaatctgtctcaaaaaaacaaaaaacaaaaacttaaccaaataattttctcagaatcctaggattccacaggtagtatggaataagctgactgagaactcatgtctattacctttacaatgggctgcttaatcactcatcctgagtcaggygcaagggctcacgcctgtaatcccagcactttgggaggcctaggtgggcagatcatgaggtcaggagttcgagaccagtctgaccaacatggtgaaaacccgtttctactaaaaatacaaaaattagctgggtgtggtggcacatgcctgtactcccagctactcgggaggctgaggcaggagaattgcttgaacccaggaggcggaggttgcagtgagccgagatcacaccaactgtactccagcctgggcagcagagcaagccttggttttgggggccaggggaggggggttggggac

SEQ ID NO: 72552 - DNA, 601 bp, Human
gtcctcacccaacacgttctacttctttcgaacagcgtgtttaacacctgaccagctacatttctcctgtggtttgtctgggctgggtggcgtgaagtgagtctgtgtgctagggaatagggtctgctgagggccaggctggccttttgcttatgttcctggctctcaatgggtcctgaatgcttcactaagcacaggcaatgagcaccacggtaaagtgggaagagatgttcaagactgggtgcctacactcagcaagtagagaggtaagacaaggacattaagtatgaacaggcaactrgagcattataaattttacctctaccctatttccaaaacatatttgaagtagcttgaggaggctgtaataatatataatggtttccacttattagggctctgtgccaggcactatagtagatgctgagacattaatgctgctcatcttgggaggcagagattgttattctgattttacaagtcaggaagctgaggcccaggtaggtcaaataatctgtccaaaacctcatggttaagggcggaggtggggttcatctcaggtctgatgccaaacctttccacagctgagggctatgatgga

SEQ ID NO: 72553 - DNA, 601 bp, Human
ccagactttgatcaaatttggcctagttattagttccttttgaaccacagactttcaatccaagatcatttaaagctctactgaacagcagcctgtctggtcattaaaaaagagaaaagctgctgggtgccaggccagaacaatagaaactaacaaaatacgggtgattttccttctgttatttctctctggttcagtggttttatgtggcgaattgtcatgtcctcacccaacacgttctacttctttcgaacagcgtgtttaacacctgaccagctacatttctcctgtggtttgtctgggctgggtggcgtgaagtgagtctgtgtgctagggaatagggtctgctgagggccaggctggccttttgcttatgttcctggctctcaatgggtcctgaatgcttcactaagcacaggcaatgagcaccacggtaaagtgggaagagatgttcaagactgggtgcctacactcagcaagtagagaggtaagacaaggacattaagtatgaacaggcaactagagcattataaattttacctctaccctatttccaaaacatatttgaagtagcttgaggaggctgtaataatatataatg

SEQ ID NO: 72554 - DNA, 601 bp, Human
aagagagtataattttctttcctggatttagcatcctgagattagaaatctgactgtagagattctagttcagtcttggagtatttttttatatttctaaagcttataacattgagaagtttaagcaataacttccaaactgcaagctttaaacaaatagtacttatgcaatgaagcaaatacttatacggtgtgcccaggctgaatgtcactggcatattttagcatatttaataaaacaaccttgactaaccttaaaaaagagagcaacaacaataacaaacacccacatcaaaagaasaaatctagggccctctgagcctttgtatcctgctgctaggcagccttctgaacttacaagggtaacttacaagggtaatgtgccagactttgatcaaatttggcctagttattagttccttttgaaccacagactttcaatccaagatcatttaaagctctactgaacagcagcctgtctggtcattaaaaaagagaaaagctgctgggtgccaggccagaacaatagaaactaacaaaatacgggtgattttccttctgttatttctctctggttcagtggttttatgtggcgaattgt

SEQ ID NO: 72555 - DNA, 601 bp, Human
agacttctaaaatagcacatgctatgactgcatttactctgagaaatgttttctcccatggctcttgtggtcaaatgacaatgaggcatgctggggcttgaagacaggtgaccaaggagatacaaccctaaaattagagtgggtcaacaagaaaaactaaggggatagcatttcggcaggaaacggggtaaaatcaagagtataatttcctggcaaggcgccacagctcatgtctgtaatcccaagcactttgggaggccaaggcaggagaattgcttgagcccaggagttcaagaccagcctgggcaacacagtgagatcccaaatcatctctacaaaaaataaatttaaaaaattagccaggagtggagactcatgcctgtggtcctacctacttgggaggctgaggtgagaggatcgcttgagctcagtaggtcatggctgcagcgagctgagatcgcattactgcacttcagcctgggtgacacagcaagaccctgtctcaaaaaaaaccccaagagagtataattttctttcctggatttagcatcctgagattagaaatctgactgtagagattctagttcagtcttggagtatt

SEQ ID NO: 72556 - DNA, 601 bp, Human
agctactcggaaggctgacgcaggagaatcacttgaacccgggaggcagaggttgcagtgagccaagatcgtgccactgcactccagcctgggcaacagagcaagactctgtctcagaaaaacaaacaaacaaacaaaaaaacagtacagtcgtgtgccacttaacaacgtttgggttaacaatggaccatgtatatgatggtggtcccataagattataatacagtatatttttacatatcttttctatgtctatgtttagatacacaaacatttaccactgttttacagttgcctagartattcattacagtaacatgctgtacaagttgtagcccaggagcaataggctacaccacagagctaggtgtagagtaggctataccatctgggtttatgtaaatacattctatgatgttcacacaaggacaaattctcctaagacgcatttctcagaatgtatccccatcgttaagcaatatatgactgtaatactgagcactgtttgcaataaacaggccattccattcagcataggcctggaaatcattttgctattacctagagatttttatgacagttatatttaatagaagaagat

SEQ ID NO: 72557 - DNA, 601 bp, Human
caaggcaggaggatcacctgaggtcaggagtttgaaaccagcctaaccaacataaagaaaccccatctctactaaaaatacaaaattagccggacataagggtgcatgcctgtaatcctagctactcaggagactgaggcaggagaatcgcttgaacccgggaggcggaggttgcggtgagccgagatcacgccattccactccagcctgggcaacaagagcaaaactacatctcatttaaaaaaaaaaaaaaaaaaaagaccccatctcaaactaataaaaaaccagtacagggtcgggsgcggtggctcacgcctgtaatcccaacactttgggaggccaaggcgggtggactgcctgagctcaggagtttgagaccagcctgcacaacatgatgaaaccccgtctctactgaaatacaaaaaattagccaggcatggtagtgcgcctgtaatcccagctactcggaaggctgacgcaggagaatcacttgaacccgggaggcagaggttgcagtgagccaagatcgtgccactgcactccagcctgggcaacagagcaagactctgtctcagaaaaacaaacaaacaaacaaaaaaac

SEQ ID NO: 72558 - DNA, 601 bp, Human
tattttacagatgaagagaacttagtttaggaagcttaagcaacttgctcaataataatatacacaatatttgcaaatatttattgagtacttcctatatgccaggcatggtgctaagagtgactataccatgaacccacagcaaccctaggcaataagaattactactgcacccacttttcagattaaaaaaaaaaaatgaggccaggcgcggtggctcacacctgtaatctcagcactttgggagccgaggtgggcggatcacaaggtcaggagatcgagaccatcctggctaacacastgaaaccccaactctactaaaaatacaaagaattagccaggcgtggtggcaggcgcctgtagtcccagctactcaggaggctgaggcaggagaatggcgtgaacccgggaggcggagcttgcagtgagccaagactgggccactgcactccagcctgggcgacagagcgagaccccttctcaaaaaaaaaaaaaaaaaaaaatgaggctcggggaaattaaataacttagtcaagatcatatagaaagctagtgatgaaactaggattcagtactagcctgtgtgtttagtctaagctat

SEQ ID NO: 72559 - DNA, 601 bp, Human
cgcgcctatagtcccagctactcgggaggctgtggcaggagaatcgcttgaacccaggaggcagaggttgcagtgagctgagattgtgccactgcacatcagcctgggcaacagagagactttgtctcaaaaaaaaaaaaaaaagaaagaaaaaagaaatcatactgccatagacatggaaacacccaaaagcccctacttatacattttaaagcattacataccatctcagctacaaagaagtggaaaagtgaggatgtgagggggatctgtctctgaagcattatttccttggatcaaygtatactttccctcaaaccatttgcccccaaactcagtatgggacaaagaaacaaaagtaggaattaccaatacgtggaaagagtctaggaaggatgagctgctacagaatcagctaccctgtctttagcaccccagcaagatccaggaatcctagataccttcattcctttcccaaagtttccagcatctctcactatcttggcaagagccgttgtaatttcttaccttcaaattcaaagctgccaagcgttcggagggcaagagtgatgctgcccacatcgctggcctcagggagggt

SEQ ID NO: 72560 - DNA, 601 bp, Human
cagataaaaggtatcccccaatcctagcctttttatattccctttaaataataaattattttgttttattccaactcaaccccttacattctcagaggataatacaattcttgatcaaatttaccttgcctcttttagttcccggatttaaataccagacaaagagtctgtgtaggctgggtttaaacatagctactttctattcactagaaataaattatcatgggtgtgaatcaatgttaagtggaggaactgcaatagagaaaccatgggtggctgtctccagacagcatgttcaggytttctgtacttgcttgtttccccacattcttgaccaatactacctatatgatcttaaatttcaaaagtatcaacttctccccctgaaatatatctctgtggggtattattatgggtttatttgcagtttagaactacacagtatggtacttttagaaatcataccgccagccgggcacagtggctcatggatataatcccagcactttgggaggtcgaggcaggcagatcacttgaggtcaggagttccagaccaacctggccaacatggtgaaaccccatctctaccaaaaatacaaaa

SEQ ID NO: 72561 - DNA, 601 bp, Human
tggaaacggtctcacactggttatttttgtgaagaacaacggcctccgtgcttgacctggcaccagcaagaaaagcaggagagctgaaggatagggaggcgctgggaagtctgacaccatctgcagcagatcaacccagcaagcaaagagggccaagaaatgggatcactggtgacttgccaggaaaaagaaagagctgcatgagaggactctgaaccaccttagagtcatattgacaaagggctcatgaggtgatgagcactggaactgccattataaagccagggaaacatttggaccyttgcagacaaatgcggcttttaccaggtacctcaatctttctcccccatccttgtcctcaactccgcttcctcaagcagttctcacagcgagagtcctgtcttccctgcctgtgggtctggccatcacctcggttacctggatgagcatcttgcgcaggaaaggcatgacaaaggcagggttcatgctactgagtcggcccacagtgcagatggccagctcccggatctcaaacacctggtcattcagagccacaaacaaggcctgcaagttctccgcctgggccaggtgtgcatcaaag

SEQ ID NO: 72562 - DNA, 601 bp, Human
ccccaggtgatctggccacctcggcctcccaaagtgctgggattacaggcatgagccaccacgcccggccttcaacaatgatttctattccttcctataactgaggaatgtttttaagacttaaaatggcaggcacttctaacgcaggccggcagttaaataaatcattacgctaaaaatagaagtgccaacataagtacaacttcctaatttgttgactgatgatataatttacagccactttataacaaattgtgaacaaacatttctctagagtgagttacatatattaatgattttgtatgtttaagttccttatatgttataaaaagtgtttacttcaaaacaaaccatgaaggaggatcaggaagcaaacagtgagcaatggggacaggaaatgactgggtgagcaacatagagacccacaagaggcaggtggaaataacttcaccaggcaggactggtgtattggcaggactccatgtattgctcaccaggaggccacagatcttactcagtaggtgaagacaaaaactgaggagccatgtctccagagcaattctaccttacgctacagaccaagcagctgagcttggcattc

SEQ ID NO: 72563 - DNA, 601 bp, Human
ccagcctggacaaagtgaaactgtctcaaaaacaaataaataaaataaaaaaatttttttaaaaaagccctctcttcctttctccaccatcatggtgtgtgcctgactctgattcttgccattcttctcacaagactttcagaattaagcaattcctggccaagaaacaaaagtaaaatcgtcccattccccagtggattcggatgaaaactggtaataaaaccaggtacaactccaaaaaaagacattggagaagaaccaagcagggtctataaggaattgcacatgagatggcacacayatttatgctgtctgaaggtcacaatgatattaccatatcaagctgaaaatgtcaccactatctggagagttggacatgttttattgagaatatattatttctctctgaatctgttatgaatgcattgttggctgggttccgcaataaatatgtgagacctttcatttaaaaaaaaaaatagtattttgacttccttagaggttagtttcttttccaccctatctccgctatggaaaaagtagctgcccctttacctgtgccaattctcctattgttgccaggacattattgatcacacct

SEQ ID NO: 72564 - DNA, 601 bp, Human
acttgaacccaggagatggaggttgcagtgagccgagatcacaccactgcactccagcctggacaaagtgaaactgtctcaaaaacaaataaataaaataaaaaaatttttttaaaaaagccctctcttcctttctccaccatcatggtgtgtgcctgactctgattcttgccattcttctcacaagactttcagaattaagcaattcctggccaagaaacaaaagtaaaatcgtcccattccccagtggattcggatgaaaactggtaataaaaccaggtacaactccaaaaaaagacaytggagaagaaccaagcagggtctataaggaattgcacatgagatggcacacatatttatgctgtctgaaggtcacaatgatattaccatatcaagctgaaaatgtcaccactatctggagagttggacatgttttattgagaatatattatttctctctgaatctgttatgaatgcattgttggctgggttccgcaataaatatgtgagacctttcatttaaaaaaaaaaatagtattttgacttccttagaggttagtttcttttccaccctatctccgctatggaaaaagtagctgcc

SEQ ID NO: 72565 - DNA, 601 bp, Human
gttaaaataaaaacaataaaaggcaatgggcaacagaccaccagaaattattccacctgtctaactggaaccttgcactcattcaccaacctctccctattccccctccctgagtcaattaaaaataaaacaaacctttaaaaaaaaaaaaaggcgtccaggcacagtggctcatgcctgtaatcccagcattttgggaagctgaagcaggcagatcacttgaggtcaggagtttgagaacagccaggccaacatggcaaaacccctccctactaaaaatgcaaaaattagccaggtgtgstggtgtgcacctgtagtcccagttacctgggaggctgagacagaagaattgcttgaactcgggaggcagaggttgcagtgctgtattccagcctgggcaacagagtaagactctccatctcaaaaacaaacaaacaaaaaaaggcagtgcagctcttgggccagaccatttcacggaaaaaagagccccaaatttctgattgctgctagttttccctatggccctgagcctcgcctctgatttccctatcaattaaaacaggaagaatcaattctatcctcttcttctgtagataccatg

SEQ ID NO: 72566 - DNA, 601 bp, Human
caaaaagtatcgaggtgtggtggcacacgcctgtagtcccagctacttgaggggctgaagcaggaggatcacttgagcccaggaggtcgaggctacatcatgccactgtacttcagcctgggtgacaaagtgagaccctgtctccaaaaaaataaaattaagttaaaataaaaacaataaaaggcaatgggcaacagaccaccagaaattattccacctgtctaactggaaccttgcactcattcaccaacctctccctattccccctccctgagtcaattaaaaataaaacaaacctttaaaaaaaaaaaaaggcgtccaggcacagtggctcatgcctgtaatcccagcattttgggaagctgaagcaggcagatcacttgaggtcaggagtttgagaacagccaggccaacatggcaaaacccctccctactaaaaatgcaaaaattagccaggtgtggtggtgtgcacctgtagtcccagttacctgggaggctgagacagaagaattgcttgaactcgggaggcagaggttgcagtgctgtattccagcctgggcaacagagtaagactctccatctcaaaaacaaacaaacaaaa

SEQ ID NO: 72567 - DNA, 601 bp, Human
gtacagtggctcactcctgtaattccagtgctttgggaggccaaggtgggcagatagcttgagcccaggagtttgataccagcctgggcaacatggcgaaacccaaaaaatcagctgggtgtggttgtaaatgcctgtagtcccagctactcgggaggctgaggtgggaggattatttgagcccaggaggtggaggttgcagtgagcccatatcacctattgcaacctctgtgtcaccagcttgggcaacagagctagaccctatctcaaaaaccaaaaacatggtagtagaggtcttatkacttttttagtacttattacttttccttactgtgtcactaagtggtggtttacaagattaaaactaaaaaacaaaacttccttttttaatttttcttccccccacccccgcccccgcccccgcccaccagactatataattatatagagtaaaaacctgagagaatttacaggtaaattattagagttaataagaattccggccaggcgtggtggctcatgcctgtaatcccagcactttgggaggctgaggcagttggatcacctgaggttaggagctcaagaccagcctggcaaacat

SEQ ID NO: 72568 - DNA, 601 bp, Human
atctaccaaaaagctacaacaaatattatacttcatggtgaaatcttaacagcagtcccattaaaatcaggagcaaggttatagatttccactatcactgcatctaattaacatggaagtaggccgggtacagtggctcactcctgtaattccagtgctttgggaggccaaggtgggcagatagcttgagcccaggagtttgataccagcctgggcaacatggcgaaacccaaaaaatcagctgggtgtggttgtaaatgcctgtagtcccagctactcgggaggctgaggtgggaggatyatttgagcccaggaggtggaggttgcagtgagcccatatcacctattgcaacctctgtgtcaccagcttgggcaacagagctagaccctatctcaaaaaccaaaaacatggtagtagaggtcttatgacttttttagtacttattacttttccttactgtgtcactaagtggtggtttacaagattaaaactaaaaaacaaaacttccttttttaatttttcttccccccacccccgcccccgcccccgcccaccagactatataattatatagagtaaaaacctgagagaatttacagg

SEQ ID NO: 72569 - DNA, 601 bp, Human
taaaatgtaagagaacagtgtgaacaatttcatgtcaacaagttttatcacttagacaaaatgaacagcttcctaaaaaaaagtagccaaaactgcttcaaggagatacagaaaagctaaacagatctttgagcccatagttaagaaagagaaaattatagaccaattcaatcaagaacacagatccaaaaattctaagctgaactgacataagatcgaaatttaaaaatacattataaccaaggtggttttaatataagaatgccagcattcttacattagaacacgttatcagtgtgaytcaacatatttaacacattaaaagagaaaaaccatatgactattacagactaaagaattcaatatacattcataataaaactctttagtattctctttatatgagaatatttgacctttataaagctatctagtgctcattttggcagcacgtatactagcattggaacaatctagagaagattagcatggcccatatgcaaggataacaggcaaatttgtgaagcattccgtatttttttaaaaataaaaataaaataaaaagatatctaccaaaaagctacaacaaatattatacttc

SEQ ID NO: 72570 - DNA, 601 bp, Human
aaaaagatcttaaaaaaattaaaatgtaagagaacagtgtgaacaatttcatgtcaacaagttttatcacttagacaaaatgaacagcttcctaaaaaaaagtagccaaaactgcttcaaggagatacagaaaagctaaacagatctttgagcccatagttaagaaagagaaaattatagaccaattcaatcaagaacacagatccaaaaattctaagctgaactgacataagatcgaaatttaaaaatacattataaccaaggtggttttaatataagaatgccagcattcttacattaraacacgttatcagtgtgactcaacatatttaacacattaaaagagaaaaaccatatgactattacagactaaagaattcaatatacattcataataaaactctttagtattctctttatatgagaatatttgacctttataaagctatctagtgctcattttggcagcacgtatactagcattggaacaatctagagaagattagcatggcccatatgcaaggataacaggcaaatttgtgaagcattccgtatttttttaaaaataaaaataaaataaaaagatatctaccaaaaagct

SEQ ID NO: 72571 - DNA, 601 bp, Human
gatggtggaaataaacgcaaacatggccaggtgcagtggttcacacctgtaatcccagcactttgggaggccgagacgggtggatcacttgtggtcaggagtttgagaccagcctggccaatatggtgaaatcctatctctactaaaaatacaaaattagctgggcatggtagcatgcacctataatcccagctacctgggagggtgaggcaggagaatcacttgaacccaagaggcagaggttgcagtgagccgagatcacaccattgcactccaccctggcaacaagagcgatactccrtctcaaaataaaataaaataaaataaaataaaataaaataaaataaaataaataggccaaatataacagcaatcacaataaatgcaattggcctagaatgcactggttaaaagacaaacatttttaaattggattaaaaagataatctagctatatttacaagacagcatccaaaacaaaaagtcacaagacagttaaaagtaaaagaattggaaaagacatatacctccaaaaaaaagctggtgcagctatattaatgttacgtaaaatacgttttaaggtattattaaagataagaag

SEQ ID NO: 72572 - DNA, 601 bp, Human
aaaattaaaggtggccaatgagtgaaggcaaaagatgaaataaaaaataaaggctcaaacaaatccagaaaaagacaaaaaagaaagataaacagacaaagcaggacaaaaagaatgcactaagtaagatggtggaaataaacgcaaacatggccaggtgcagtggttcacacctgtaatcccagcactttgggaggccgagacgggtggatcacttgtggtcaggagtttgagaccagcctggccaatatggtgaaatcctatctctactaaaaatacaaaattagctgggcatggtagsatgcacctataatcccagctacctgggagggtgaggcaggagaatcacttgaacccaagaggcagaggttgcagtgagccgagatcacaccattgcactccaccctggcaacaagagcgatactccgtctcaaaataaaataaaataaaataaaataaaataaaataaaataaaataaataggccaaatataacagcaatcacaataaatgcaattggcctagaatgcactggttaaaagacaaacatttttaaattggattaaaaagataatctagctatatttacaagacagcatcca

SEQ ID NO: 72573 - DNA, 601 bp, Human
tgtggatgaatataaacaaacacgacataaaacgacaataatgtttaataagatggaggaagggggcctaggaacgcaggcaccctctaaaacaagcttgtccaactcctcgtgctctagaagctagaaaaagcaaggaaaacaattctcccctagagcttccagatgggaacacagtcctgtcaacatcttgattttagcccagtgagacctcatgtcagaaatataacctagagagctgtaagataagaaatctgtgttaagccactaaatttgtggtaatctgttatagcagcaatargaaataataaaggaaggaagaaaacgaggtataaagatggtgacagaagctagacgttgctagataagattttatttatagttctagctctggaactatgttaatgtcttatataactaaaacaaaagtaatttttttttttttggagatggagtcttcctctgtcgcccaggctgaagtgcagtggtccaatcttggctcactgcaacctctgtctcccgggttcaagaaattctcctgcctcagtctcctgagtagctgagactacaggcatgcaccaccatgcccggctaatctttg

SEQ ID NO: 72574 - DNA, 601 bp, Human
aataaattttttaatttaatttttaaatctccaaatgaagatttaaaaagagggtgaaataaagacttattcagataagagcagtttatttcaatgaatgctcctaagaggaatttgtcctatgaagaaagaatatgattctaggagaaagctctaatatggaagacagggtgatgagacatgaaatatgtgtggatgaatataaacaaacacgacataaaacgacaataatgtttaataagatggaggaagggggcctaggaacgcaggcaccctctaaaacaagcttgtccaactcctygtgctctagaagctagaaaaagcaaggaaaacaattctcccctagagcttccagatgggaacacagtcctgtcaacatcttgattttagcccagtgagacctcatgtcagaaatataacctagagagctgtaagataagaaatctgtgttaagccactaaatttgtggtaatctgttatagcagcaataggaaataataaaggaaggaagaaaacgaggtataaagatggtgacagaagctagacgttgctagataagattttatttatagttctagctctggaactatgttaatgtctt

SEQ ID NO: 72575 - DNA, 601 bp, Human
gggcacggtggctcatgcctataattccagcactttggaaggctgaggcgggtggattgcttgaggacaggagttcaagaccagcctgggcaacatggtaaaaccctgtctctattgaaaatgcaaaaaacaaaaaaaattagccagcatggtggtgcacgcctgtagttccagctactcaggaggctgaggcatgaggatcactcgaacatggaaggtggaggttgcagttaaccgagatcgtaccactgcattccggcctggcagcagagtgagacttgatctcaaaaaaaaaaaaaaraaaagaaaagaaaagaaagaaaaaaaaaaatagaagggtataaggacaaaattccaaaaaagataatagatgagaatttctcaggaactgataagataccaatcctcacattcaggaagccctccaagtctcaaacaggataatcaaaagaaattcacatctagatatataatagtaaacacttcaggataacaaaacaatgagaagtaaagccacagaaaaaatatgtaaaagggattcacgatttctcaacggcaacaaaaagaagtcagaaagtgggatcgtatctacagttgtagg

SEQ ID NO: 72576 - DNA, 601 bp, Human
tcccttgcccctcctcccactaagactagccatcggcctctttagcattctgcctaaatcctccttgtacagaggcttctgtggtaagagtcagggaatagagcagcttttaattatttatacatgtagggaggttttcagttctgagatccaggtgctgggaagttccatttgaaaccagccattttgattttagtcctgctaaaatcaaatagtccagccattttgattttagtccaaactaactacaaaggtctggtgtgaaagaacagaaatcttccaactctttgaggacatgccrtccctgtgaagcaatcttccccgtagagacatttaaattatatagaacacaaggaaaaatgatattgcccatggggtgtcttctggcacctacttaatgcatgttataaaatcctggaacctgagccttttctcatgtgccactgcagtcaaaaggtgatatgtatggttttggaggtagcagggtaaagcatcaccttgttccttggtgcccaacacgtgtccatcatatttaacagccctaagaaaacccaatcccttcatggtttatgagcagtaacaaagagggctttcatgaaaa

SEQ ID NO: 72577 - DNA, 601 bp, Human
atttcctggcttttctggatttagattttgctattaatagatagcatctgatatctgtcccttcccaaaaatctatccatcaggcctgaacagtgccacaaaatgagcccctttctacacccacatggttattttccacacaagttactaaaataaaaacttggccaactggccacagatcctgcctcagtgctgcaaagcaaattagtccaagcctctaactccaggaaaagatatcatttctatcaactcaaaaagacagctgcctaccaccatctttaaaagttctggagtaggaaayttaatgataatagaaaccctactaatgatggcaacacatgaatgttaatattcttggagcctctaaatagttcaaagtagaagtccataacaacaaggataactcctcagatgaaaggctttataaaaagatatagtatttttatttaaaaaggtatctttaaaagcataatggtttagaaagcaaaaactatactagaagatgctggtaaaacttcctttctctctacttggagagaagtattctctctgaaaaagctgtgttttctaggttaaaagtgttgccaaagaaacaccacag

SEQ ID NO: 72578 - DNA, 601 bp, Human
gcatggtctgcgccgagatcaactcctcactcccctcctcccactgggcccttcttgtgtcctatgttgcagctacactggacaaactcaattgcatttccccagatgcaccaggctacctcagtcctctgggctttgctcatgctgcttcctctgcctagaatcccacttcttgctcagctaagccctgtctgtctttctagacctggctctagcctcacttctcccatgcaggctttcttcttctccttccatgatccacttgggtcctttgcactccctttgatagcgatagcagttrtaagacttcctttgctttgctgtcctccctctagactgtaggctacttagggacaagtatcctatctctgtatccccagaatctatcaatcagagcatctggaatattctagaatgaacagatgactaagtcactcaaaaaactctgaagtggtccagggtggacttggaccttactttggtatcacctgatctctaccagagggtgactccagtattacaaatatttcctggcttttctggatttagattttgctattaatagatagcatctgatatctgtcccttcccaaaaatctat

SEQ ID NO: 72579 - DNA, 601 bp, Human
caccaaaaacttccagtcttgctcagagtaaaagccaaagtacttacaatggcccacaatagtgatttgcatattttagtgggcgtcagaatcacctggacagctcatgaaaccagagactgctgggctccacagctagaggatctgattcagtaggtcttaggtgagatgaggtcttgctctgttgcccaggctggagtgcaatggcacaattatgggggtcactgcagtctggaactcctgggctcaagcgatccctctgccttagcctcctgagtagctgggaccacaggcacgtgtycctacgcctggctaagttttaaatttttttgtggagacagggtcttgctatgtctggagttggtctccaactcctgatctcaagcaatcctcttgcctcagcctcccaagttgctggaattacgggtgtgagtcactgtgcctagctcaagaatctgcatttctaacaagttctcaggtatgtagacactgatactgcttgtccaggaatgatattttgagagctccaggcctacaaaatctagtctctactattctgccttatctccatcaccttaactacaagcacttccccattgct

SEQ ID NO: 72580 - DNA, 601 bp, Human
gtgagctgtggaggattctgtctagagttttgaacttgatctactttctcaggtgagataaactaagagtctttcttttgtctatctggcaaggtttatgcttattttttccaagtctgggtagaaagcaaaacttcctggaagcaaactagattactgaggaatttcctaaaatagagagaacaaagctctaaagcagggtggacggctgcctggttggaaggacattctgaacctagtcaggatgaaaacatctgggtggaaatgtacatctggcctcctgcctggcccctccctccastgtgaggtgtcagcagggtggcctcaatgattacctgggaatgccaagtgactgataacctttttcttcctcctaaagtctcagagtagcagttacaaaatccccagagggaaagcagcatcactcctgacccaggaatattttactacctccatcttaacccagcaaacgtttcttagcagtggtcacttgaagctgtttgtgtgagtaaagactctgaaacaacagtaataaacccccagtgctccgcaaagctgggcgtgagcccgtacacatgcacaaaggactgtgttcaaatct

SEQ ID NO: 72581 - DNA, 601 bp, Human
agggagactagataccaaagactgatttttagaccttgctctgttgagcacaatgggaacatccagtcctttcctgcccacagatacctggtttcttccctacaagatgggtttgtgtgtagctgtattatattatacagcaattgttaaaagctgcacataaacagggaagtattactagtttctttttccctctaatgaaatgaggttgggcctgggtaaggcagacacaattcaacacagtggttaagagagtgggctctggagtcatgctatctaggtcaaatcccagctccaccaytgatgctagttgacactgggcaaattacttaacccgtcagtgcctcacggtccacatctgtaaagtgggacagcaacgacagcacctaactcatggggttatcatgaagattaaatgagttaatatagtgttccaccacagtgcttgacacacggaaagcactcaataaatgtcagttgttactattacttgataaatggcagtaaataggttttcaaaaaatcatagcttaatttattgactaggtcaagtcccccatgtggccctttccccctgctctgtaaaacattatcaactctc

SEQ ID NO: 72582 - DNA, 601 bp, Human
cagaaatgttacaagagacaaactaaataataccactgaccatacaacgagaacctctgaatgagaaggaagagggagactagataccaaagactgatttttagaccttgctctgttgagcacaatgggaacatccagtcctttcctgcccacagatacctggtttcttccctacaagatgggtttgtgtgtagctgtattatattatacagcaattgttaaaagctgcacataaacagggaagtattactagtttctttttccctctaatgaaatgaggttgggcctgggtaaggcagasacaattcaacacagtggttaagagagtgggctctggagtcatgctatctaggtcaaatcccagctccaccactgatgctagttgacactgggcaaattacttaacccgtcagtgcctcacggtccacatctgtaaagtgggacagcaacgacagcacctaactcatggggttatcatgaagattaaatgagttaatatagtgttccaccacagtgcttgacacacggaaagcactcaataaatgtcagttgttactattacttgataaatggcagtaaataggttttcaaaaaatcatag

SEQ ID NO: 72583 - DNA, 601 bp, Human
gagtgaaaagacccccaggtgctataccatcaaggactcaaccatcacctccctgggatacactggagatgtgctgttgcttctaaagagttatggatgaatagaattagacaacctatcactttatgtcaaaaaccgaagcagaaatgttacaagagacaaactaaataataccactgaccatacaacgagaacctctgaatgagaaggaagagggagactagataccaaagactgatttttagaccttgctctgttgagcacaatgggaacatccagtcctttcctgcccacagatacstggtttcttccctacaagatgggtttgtgtgtagctgtattatattatacagcaattgttaaaagctgcacataaacagggaagtattactagtttctttttccctctaatgaaatgaggttgggcctgggtaaggcagacacaattcaacacagtggttaagagagtgggctctggagtcatgctatctaggtcaaatcccagctccaccactgatgctagttgacactgggcaaattacttaacccgtcagtgcctcacggtccacatctgtaaagtgggacagcaacgacagcacct

SEQ ID NO: 72584 - DNA, 601 bp, Human
ggatcacttgagcccaggaggttgaggctgcagtgagccgagatcgtcccactgcactccagcccgggcagcagagaccctgtttccaaaacaaaaacaaaaacaaaaaaccaggcggggcgtggtggctcacgcctgtaatcccagcactctgggaggccaaggcaggtggatcatttgaggtcaggagttcaagaccagcctggccaacatggtgaaaccccacgtctactaaaattacaaaaaatagccgggcgtggtggcgtgtgcctgtactcccagctactcgggaggctgaggcaggagaatcgcttgaacccaggagacggaggttgcagtgagccacaattgcgccactgcactccagcctgggtgacagagcaagactccatctcaaaaacaaaaacaaaaatgaaaacaaaaaaaccaaccaaacaacaacaacaaaaaaagatgtctaaagtgatgaatatcccaattatcctgatttgttttattacacattatatgaatgtatcgaaatatcacatgtactttgaaaatatatgtacatctattatgtatcaataaaaaaaattttggccaagtggctcatgtctgt

SEQ ID NO: 72585 - DNA, 601 bp, Human
ttttaaaaattaaaaaaaaaatggtgatgactcatgcctataaatcacggcacttttggaggctgaggcaggatgactgcttgagtccaggagtttgagatcagcctgggcaacatagtgagacctcgtctctacaaaaaataaaattagctgggcctggtgcgtgtctgcagtcccagctactcaggaggctgacgtgggaggatcacttgagcccaggaggttgaggctgcagtgagccgagatcgtcccactgcactccagcccgggcagcagagaccctgtttccaaaacaaaaacaaaaacaaaaaaccaggcggggcgtggtggctcacgcctgtaatcccagcactctgggaggccaaggcaggtggatcatttgaggtcaggagttcaagaccagcctggccaacatggtgaaaccccacgtctactaaaattacaaaaaatagccgggcgtggtggcgtgtgcctgtactcccagctactcgggaggctgaggcaggagaatcgcttgaacccaggagacggaggttgcagtgagccacaattgcgccactgcactccagcctgggtgacagagcaagactccatctcaaaa

SEQ ID NO: 72586 - DNA, 601 bp, Human
tgagaaacagcctataatctccaaagaaagaataagtctccaaggagcacaaaaaaatcatatgtaccaaggatgttacagtaaacaggatgaactatttaaacccactgggtcctgccacatccttctcaaggtggtagactgagtggggtctctctgcccaagatccctgacatagcagtagcttgtcttttccacatgatttgtctgtgaaagaaaataattttgagatcgttttatctattttctctacggcttaggctatgtgagggcaaaacacaaatccctttgctaaaaagamccatattattttgattctcaaaggataggcctttgagtgttagagaaaggagtgaaggaggcaggtgggaaatggtatttctatttttaaatccagtgaaattatcttgagtctacacattatttttaaaacacaaaaattgttcggctggaactgacccaggctggacttgcggggaggaaactccagggcactgcatctggcgatcagactctgagcactgcccctgctcgccttggtcatgtacagcactgaaaggaatgaagcaccagcaggaggtggacagagtctctcatggat

SEQ ID NO: 72587 - DNA, 601 bp, Human
cctgaactggaggtgaggtcattacagtcactggccatgccctaatacctgtccttcaccccctcaaggggactacaacaacagggccattcacagtttaaagaaaggaaaattcggctgggcgcagtggctcacacctgtaatcccagcactatgggaggccgaggcaggtggatcacttcaggtcaggagtttaagaccagcctggccaacatggtgaaaccctgtctctactaaaaatacaaaaaaattagccaggcatggtggtgggcacctgtaatccctgctacacaggaggatygcttgaactcaggaggcagaggttgcagtgagccgagatcacgccactgcactataatctgggagacaaagtgagactccatttcaattaaaaaaaaaaaaaaaaaaaaggaaaactcaaacacaagcaaacacaccaaacaccacagagctatgcaaacactcagtttatgccctgcactccaaacccaggcatctgtttggccccttcaaatcattatcagtcaaacaacaagccttctaacatagatcagatcattcttataaccaccacataacttagtttaaatctcttgccatg

SEQ ID NO: 72588 - DNA, 601 bp, Human
acgactgatttgttatagtggcggctgtctaagaagtctgaatctatctgacaggagtatctgttacgtggccctcatacactgtaacatttctagaattcatggcccagctatagcagaataatttatttcagagttaacctgaaaccacctgttggaacgtcccactaatgctatccaggtgaagggcttccctacccctctgctccaccgctagtaaagccaaaatacaccccctctggatctccccatatccacctctcccaaatgcagacactgatgggtaattaacaccactgagaatcccagggtagaaataaaggctcagtctctaaacactcaactcagatggagccactgggtctaaatgctcaccctgtggtttgttctcttgtagatgccatctacgactgctcttccctctaccagaagaactaccgcatctctggagtgtataagcttcctcctgatgacttcctgggcagccctgaactggaggtgaggtcattacagtcactggccatgccctaatacctgtccttcaccccctcaaggggactacaacaacagggccattcacagtttaaagaaaggaaaattc

SEQ ID NO: 72589 - DNA, 601 bp, Human
cttggtggggtggacatgtgatcttgtcctgcaacccctgacaaggtcttatctctagctaagggtgatttactgaaattgcaatataatggacatttgatttccctttggggacagatgagctttgttaggttactggggataaaatatggggactacagctgcccagaaataaggcaggttttttttttttttttgacggagtcttgctctgtcgccaggctggagtgcagcggtgcgatctcggctcactgcaacctctacctcccgagttcaagcaattctctggcctcagcctccyaagtagctgggactacaggagtgtgccaccacatccagctaatttttgtatttttaatagagacggggtttcaccacattggccaggatggtcttgatatcttgactttgtaatctgcccgtcttggcctcccaaagtgctgggattacaggcatgagccaccttgcccgcccgaaataaggcagtttttatggggacatgttactttcttcattttgtcaacattagctgttgcatgcagcccctagggccagtgcaggttgaagtaatcagacatgtcatttacactggcttctggaa

SEQ ID NO: 72590 - DNA, 601 bp, Human
tgatatcatcactgcatgaacagtcagaggtggccatgaggcagagcccagcacctactagatttcatcagttctaagacacacatttttttcacaccttaacatctctgaaattgggatgcagcatacaattcaaggtttcagagcactgggacacagtgtaactgctagcactttctttccctcccccagtgttatataaaaatcagaagcagtttctctaagtcagcataagagcagtcccattaaatctccaggtagtctgaaggataagctagcttttgtagaagagtttagggayaccactgaaatacagcaagtttctccccttagaagggtcttgttttgtaacaatagcccctctgtccttttggccagctttaggagaaaccccagaactctcctcttcttacaattcctcgctgatggcgaggtttctccactgaagagccttccctggggttcataagacgctctgcaagagcaagctgttacagtgaccctgggggaagtcttgacagcagctagaagtaaatgcatgctctactgataactggtgagagatgtggcctcttgggctgaatctaaaagtgcatttgaa

SEQ ID NO: 72591 - DNA, 601 bp, Human
acgacttttgctggccaggtttgcaactgaggagcctgtcagaggcgtgttgtaaaaatgatgaatggctgtcacatttccaaggctctggctgatttagggagctattggcaggcacaccgctcccagcatgtcagccagttaattacttccaactttatcttacttgtcaacacttcttgacaaattggccattatctttttattctacaacaatgagcactgctccttttcttgtgatgcctgcaggttcttctccccctttctgcttcttcacatccagagagaaacaaagagctcygagagagactactagaaagaagcagcagtcaggaaaaggatggggaaaaggagcaaaaggggtgggctgatagagtgactccaaagctaatgttcatctctcttgactcaaaactgaggtgatattttgggtaaagtcctgatttcttggcttctgaatgtccaagaactctgactcagtccattatgtggataaagttgggaaacaaaacttaaacaagctggcacctagtgatctggcagcttgtaactcttcacatttaattgtagaagcagatgtgagctggtcttccactctatt

SEQ ID NO: 72592 - DNA, 601 bp, Human
atgtgagaaagtgtgagcccttagaataaagagggtagaatgttaacagtttttgagattaggaagtgcgtgggggaatgggggcgcgtgtgcaaaaaaactcatcttttcaagattggtgagtggaagtaccactttttaaaaagaaaaaaatggaggagggaagttgattgtaatataatcacctttccaagatacttttacctgcgcatattctgcataaatgcatattttatacatactggtgatgaaagtatagatacaattttgtatgctgccttttcacataacacaggtattytccactccattcagtcttcataattgcttttactggctgcatacccgtttcctcccactgatagatcccatggctggttagcagcagcacttgttagataccaggccaccaggagtgctgctgatggctcccattcagcactctctatgctaagtgaactgtcctgcagaagtttacaaagtcagctctgggaatcctagtgcccagcctcggagaggaatactgcccagcgatgagctggcaagctggcccatttgactcaccgtctccaggcatctcctggttggatatagggcccag

SEQ ID NO: 72593 - DNA, 601 bp, Human
gagaaacctggagaacattgtctctggaagtgccctcagtcacggctccacaggcttctggacagatgctgagtccacagtaacttgacatggcagtgcctccttgagtggcccacttggttatcgccctcatccctcagtcttggtgccgcgtgacctctggggttcagagcaaagtgatgcaagcctcttccacacaaggcggcgcctgtcggaaagtcctcaggcagcaaggagcatctgcaggcacagctggggcaacgctcaggcttccccagcgctcccatcaggaatgtatgaraacacacccactggcttcccaaatggctgtggaccttctttctcctgtctatttctagtgcagaccacagtctgagtttcatttggttccctgtcaagtgagaattctctgaattcccctggcgccaggctggtgacacatgcatcacagctgatggggctgtggcaggtctgactgaagtggcctgaccagccacactgaggccaccctggacactgctttgggtcctaaccactgtatcaagcagtttctctcatggagtggtaactgcttgagattctcctgtcacttctcccagca

SEQ ID NO: 72594 - DNA, 601 bp, Human
actgccttttattggaggaggatgagattgactgaaatagtgggtcattaactgctcaaggacttaatgctgacccacagcaaagcagtctaaacgcctttcctgccacctgaagagaaacctggagaacattgtctctggaagtgccctcagtcacggctccacaggcttctggacagatgctgagtccacagtaacttgacatggcagtgcctccttgagtggcccacttggttatcgccctcatccctcagtcttggtgccgcgtgacctctggggttcagagcaaagtgatgcaagmctcttccacacaaggcggcgcctgtcggaaagtcctcaggcagcaaggagcatctgcaggcacagctggggcaacgctcaggcttccccagcgctcccatcaggaatgtatgagaacacacccactggcttcccaaatggctgtggaccttctttctcctgtctatttctagtgcagaccacagtctgagtttcatttggttccctgtcaagtgagaattctctgaattcccctggcgccaggctggtgacacatgcatcacagctgatggggctgtggcaggtctgactgaagtggcct

SEQ ID NO: 72595 - DNA, 601 bp, Human
gaaagttcttggcaatcaaggaaaacattttctagagctgagcagaactaatactaagaaattgccttgctgccttcctatagcaaacatcacaccattacgctgaacatcttatccccactatccagaaaccttgttcccaaggcagggcaagcatgcgagctgagcagcgggtggttcagctgtgcagacacttcccccggcaaaggccctgtcaggagtgacggtagagcagctcacgtgggcagtggcgcctgctgcctccccatagccctttcctctcaggctctccctagcaggttttttttttttttttgagacagggtctcactctgtcacccagactggagtgcagtggcgcaatctcggctcaccgcaacctctgcctcccaggctcaaggattctcatgcctcagtctctccagtagctgggattacaggtgcgcgccactactgcccagctaatttttctatttttagtagtagagatgtgttttcaccatgttggccaggctggtcttgaactcctgacctcaaatgatctaaccgcctcagcctcccaaagtgctgggattacaggcatgagccactgtgcccagcc

SEQ ID NO: 72596 - DNA, 601 bp, Human
atttttagtagaaatgaagttttgccgtgttgcccaggctggtcttgaactcctgagctcaagtgatctgcctgtctcagcctcccaaattgttaggattacaggcatgagccaccacgcccagccacacctactctcttgattgttcaaagaataaagagatttttagtgaaccagctgctatcagcctgtgtatttatttcctcttccccctttttcactttaatttcctacaggactttctccctaagctacatttctcttatttccttctgaggagttcccatgcacgcctctaaarctgctggagaatactaattatggatgtggatgctctggacagtgaagtcagcaggcttattaatcctggtgatcaagagagtctgttatcttgtttgggatcttaattttttcttcttcctccatgccttctggcactccatcacgggaggcaacaagaagaagatacaagaagaagataccaaaataagaagagagctcaccatatgtgccaggcactgcgcttattgtttctatgtattatttcgaccctgtgaaactattattaatattctcattttatatatgaagaaaacacagc

SEQ ID NO: 72597 - DNA, 601 bp, Human
aacattctattttcttttcttctttctttcttttttaaagagacagggtcttgctctgttatccaggctgaagttcagtggcacaatcatggctcactgcagcctcaatctcctggctcaagcaatcctctggcctcggcctcccaaactgctgggatgacaggtgtgaggcactgcacctggcctccagcctatttttaaattttaacattaccgaagctcgattcattccgaggagaaaacaacaaaaacaaaaacaaatacaagtcttttcctaatccactctcccaattatcacagygcataaaaaatgagttttacaacaaactgatcaaaattaggaagtagtgattagggacctcgaaagagaaacaaattttaccttaatacagctacagccttgatataccacctctaaggactgaccagcatagctttgcaaattaaaaatgtaaaaacatatggccttaactcctttaagagagagtccaggccaggcacggtggctcatgcctgtaattccagagctttgggaggccaaggtaggaggataacctgaagtcagtagtttgagaccaggctggccaacatggtgaaaccc

SEQ ID NO: 72598 - DNA, 601 bp, Human
cacatttcttccaataaaaccaaaggaaattgcccagaaatctaaagaagctaacatttgtgaaagtaataatctaatgcctcatgtttacaaagcgttttcaaataatctttccaatccatcacttctttgaccccatgcatccctaagagtgggaagggagaggtgttatcagacctgtttcactaacggggaagctaaagcccaggaaaggcagggattttccccaaggcccacaggaatcaggaaagtccccacagtaaatcaagcaccttatgcctctttgttaaggaaaagttgrgggtgaaacagccttggatttggagtcagaagatggggtttttccccatgtcagactgatcacatgctgacgtgataacaagtttgagggagacacatctcaccacatgtgatggtaaaaacccaatcatcatgcataaatgtatacaaaaggattgaaacttgggtttaactttctggaggtctaattctgccacttataagctgtgtgatcataaataagtcgtttcaaaaattttaatttttaatttttttaggtacatagtaggacatatttaactcatcttttttgaatgtaaat

SEQ ID NO: 72599 - DNA, 601 bp, Human
tattattaatgctgagaaaacaaagggaaaaggtagttacactcaacaggtctgagggtaggagatgtgggggtcatttgtgggcagatggttcaccagcactttgaggacaatgtcttgcagatgctgaaagagtatcaattatctattaccatccagaaagctcagtttaaatcgtttcatctgaaagaggtttgtgctctcctcccatgattctgggggtcagtaatgggaacactcatcttgctgctctgtggcccttcctttaagagcagagactaggctgggtgtggtggctcaygcctgtaatcccagcactttgggaggctgaggcggttggatcacgaggtcaggagatcaagaccatcctggctaacaaggtgaaaccctgtctctactaaaaatacaaaaaaattagccgggcgtggtggcaggcacctgtagtcccagctactcaggaggctgacgcgggagaatggcgtgaacctgggaggcagagcttgcagtgagccgagaccgtgccactgcactccagcctgggggacagagtgagacactgtctcaaaaaaaaaaaaaaagagcatagactggtttcctctca

SEQ ID NO: 72600 - DNA, 601 bp, Human
tctggctccacgtaaggcaaactatctcaacttcatttttcaagcctgtccaaaataatatctattatgcctaaatacaaaataggaaacttagaaaagagtgactacaaaaactgtaaaatttaaaagcactggtagatttctcatttcaaatttctatactgggtggaaaagaaaaaaaaaagagctggtgactaatgtgtggcatacactcagcatgaacaagcagaggggagagggggcagcatatggagtgggtcagttagagggtaggatattttgaattgcaatagattgcagaaactataaggtttaagcaatgaatcacacaaaattctaatgagattgctgttacataaattttgctgagaaagcacaggctctgccaagaaaaagcaaaccattgtcaagcttaatatgattcagctacctaaatataacagaaaatccaccacgggtttagcaataatcctggagctaatggccacctttggaacctgaagatggagaaagtttcattgaaggctggcattctgagtatggggtataaaccatctgctggcagatcacctgaataccagatgtctgcggagtccttgtc

SEQ ID NO: 72601 - DNA, 601 bp, Human
ttatctctctctctatatatatatatatgatccaatgcctaaggctaagttcactaacattaaattttcatgcaaaacattataacatcttctatcttggggatgtagtaataactttatattaagaaataacagccaaacttggcaacataatgagaccctatccctacaaaaaataatttaaaaaaattagccaggcatggtggtgcatttctgtagttccttctactcaggaggctgaggtgggaggattgcttgagtccaggagttcaagaccacagtgagctgtgatcacaccacygtactccactgagagacagattaaagtcctgcctcttaaaaaaaaaaaagaaggctgtgcacagtggctcacacctgtaatcctagcactttggaaggccaaagagggaggatcgcttgaaccccaggagttcaaaaccagcctagactgcactgtgagactccgtctctacaaaaaataaaaaaaattagcccactgtggtggtgtgtgcctgtagtctcagctacaagggaggctaaggtagtacagaaagactacatgtagtgaaagatcattcttttagaagacttgctttgattt

SEQ ID NO: 72602 - DNA, 601 bp, Human
agcggatttgaaaagacatgcttcctaaatttattgaggtaaatgaacatggaatttttgttgttgttgttgttgcccaggctagtgtcaaacttctgggctcaagcaatccgcctgcctcagcctcccaaagttttgggattacaggtgtgagccaccacactcagccttttaatgttaatttataaaaataaataacacttcctataaataaaaaaataaaaataaataaaaatcttcctaatgatggttaaatcagacaagccactttcaaataattgtggaatattatctctctctmtatatatatatatatgatccaatgcctaaggctaagttcactaacattaaattttcatgcaaaacattataacatcttctatcttggggatgtagtaataactttatattaagaaataacagccaaacttggcaacataatgagaccctatccctacaaaaaataatttaaaaaaattagccaggcatggtggtgcatttctgtagttccttctactcaggaggctgaggtgggaggattgcttgagtccaggagttcaagaccacagtgagctgtgatcacaccactgtactccactga

SEQ ID NO: 72603 - DNA, 601 bp, Human
gacaagagcattgctcttccacaaacatttgttacaaaaaataatgcagaatataccgagtcctacctctcaagggcggttgggtgaggggcaaaaccaaataaataaaaaacatgagattgtttatggggcaacaactaggatatgtttttctgatacctttcactacacatagggaggactgggtaaaaggtgcaccctctgagactttgattttctcacctagcgttctggcaaaaaacgcagaaagtgcttgctttggcagcacatatactaaaattggaacgatacagagaagatrgcatggtccctgaagatttaaaacaaataaaaagcttaggaagtattctttcatttggaatggctccatggctcctcttagggttgagggcctatgatctcactcccgaggaatctgttctcaatacctagctgtgtggggaacagtttgaggagggggttcactttagttcactttggctgcaggcgtggctgcctgcaccatagggctgggcagggcagggggtgcgggttgcctagctctcacagcctcctggaggcagataagaatggggaaatgggaagggtctcagctcactgt

SEQ ID NO: 72604 - DNA, 601 bp, Human
taaacttgagcctcatgtaccaaaatcctgcagagcccctatacacactatgcaggttgacgtaacaaaaaaagccacatctgtcttccaaacacaggactccatggctgcccagggagcatcttgacagatgaggggaagtgcatgagtgtgaagtctgcacatcaagtgggctgaatgcagcacctcattatcctagagaactctctcaggtttctccaggtgcaacaaaattgctttcttccttactactgagacagctcacagttcaatggtatgttgggaaattacattttcctcyaaacaattgaaaatagccattacacagatgataggggacaggattagacaaatagcttgcccatttcattctggcaatatctttgcctcaggagggaggagataaatattttaagcgactccattataacaaaaagatgggctaggtcacagcacagtgctctctgtgtcatattagacaggggaaatagctgcatccgggaagaggtattcacttctcctggtggggtgagtatgtatcaaatgccaggatttccaagaccatctgcagaaaagatatcagcttcattagctgcaaact

SEQ ID NO: 72605 - DNA, 601 bp, Human
tgccttaggcaagacagtcaaagacttggaggctatacataggagggaaaccagactatactcagatccagcaccttctgtttttctcatttgcctggaggaggtcaggctttgaatcagaaatgctctggcctgggaggctcacagagactgaaaaataaaacaaaacaacaaaaaaacaaataaaatctccaagctgcatatttgaagaaggaaacttaggtcattggtactgcagtaaatcccaaagaccaggtgcctgggtacaggctggctgatcccactctgggtggtattcacrgccactctgattcagtcatgtataaaattagtcaatttctagacccagtccccagatctcctaagtgtgccttctgcagaaacacaacttctattttatgagatcttcccacagcagaggctccagtggctgggttttattcctctctcatctcaggtacttcactgtgggggtcacaatggggagagaaggctagtgagactccctcttccttttaagaaggaggaaggggaagccaaagcaggtgatgactttgcctccagggcctactgtttattagtcctcagcatcatccaggca

SEQ ID NO: 72606 - DNA, 601 bp, Human
acccatctgcctggtcccaacacctagcccacggcctgacagagaaccagtgctcaatgcttgaaggaagaaccgctggtgcttatttggataaaggaatactactctctctggggttctgagcggcaatgactctacagcgtaccaccacttggtttagcgagtgtgaggcagagtttgcttccaggcatggtaactttgcagtgatagtaggacactacgtgacccattaatagctgaactttctgaataattgggaaattcgtttgtatgccttgccaaaaaccttgaacacaggtgyatccgttttctcaactaaggagaatagattgatcacaactaacctttacttgatgagtaagaattctacaatgacccaggtttcagttttcccataccttcatttattcactgaatatctcttgtgtatctgctatgtgcctggcaatgacctggggtcaaggtgaacaagacaaacagtcctggcatgcatacagggccatgacgttgatggtagaatacatcataaaacaaaagggacccacattaggaaaagcttttaaaaactaaaactaaagttcctgaaaccaacttttttctt

SEQ ID NO: 72607 - DNA, 601 bp, Human
ctgttctgtgtgtccataaagcaaacacttcaaggagacactcagaaatggctgttttactaaattcaacatgatccactcactttgtggagcactaactatataacgtactatgagtgcactgcgagaagggcacagcaagaggagcaggagagagctcttgcctcaagggatctcccggcctcctaggggagctcacgcacaaacctgaagacctaggtactctgcaaggcacaatgggagtagcaaggacaggcatttggaaagctttgtcaagaagagggatttggggtaggtctgraagagagctgcagaagggcaaggagggaaacaagaaggcagcggtggggactacttggcaagggggaagaataaggccagagatgtgcagattggttcacgggaaacaagcccatgaatgtgaccgtgcaggggatacatgcaggcgaggagtgagagcgaggccagcaaagcacgcctggagcaggcacagggctggcactttcacccagaaagcagagctgcactgggtataaagtgtacatttaggggagagcagaaatggcaagcagaagtgggggcaagcagcagtcatcacaat

SEQ ID NO: 72608 - DNA, 601 bp, Human
cagggaagcttgacaaggagcttgctcttcagcatagaggctgcgtcagctccccaaacacaaatattcacacacaaagccctatctcaggcagtgctggatggtagataggcagtattttccagctccatctggcacttcagatacagcctcaggttccttttaagcttaacaacgattccatttctcagagagcctggcaccttggttggttgttaataaggaagaagggaagggtacctcagtgaccttcttctgcagcggcgatggggtggggctgttctcggtgctctcggcctcrctctcactgttgctgccctcggtgctggcagtggtggtggcagtggcggccgtggtggcggcagtggtggcgttggtgatgttggccccgctggcatgacgcagtttcttcttctcatcgcgggcttggttctgatgtttgtagtgtagcacagcttcgaagttcatcactgcccacgcatgccaggcctggttggggagaaaggcaaggacagacactggagctgtgaccaacagcagggctcagaggagcgcaaggtcgatgctgaggaacagctgctcctgcctgttctgtgtgtcc

SEQ ID NO: 72609 - DNA, 601 bp, Human
aattcttttaacttgtttcggttgatgctctgaaatggttcattcccttccctttagtttctaaaagaaaataaagaaaatatggacacttgacactgggaccgagccctacttccttagcactgtattaacacacactgccttgtgacactgaacacagcatgcttgtaagaggagacacacagaagagagacttggagccaccttcacctgtaaccaagtatcctcacctgtagccaggtatcaatctggatggctttcaccccctccactaaggcctcattgacatctggccagtgaccataatcaaaccataaggtgagaactctgaaaaagaaatgagaaagtcacagaaaatttagtttcccagtttttgcctgcctgtttttcatctctaaggctcctgagaagagagctggcagggactccaaccagtaactctcaaatgtgtttggcctcccatgggagcaggtgtctgtgatgggtggcagtgctcttgactgaacaccgtaagagtcaccctgagcaaatgagcatttcatcccaggtcaccgaggggtcaccatggcatgtatgcaaacatcaaacagacgagccagga

SEQ ID NO: 72610 - DNA, 601 bp, Human
tgttttttttttcttttttgagacagagtcttgctctgttgcccaggctggagtgcagtggcacaatcttggctcactgcaacctctgcctcctgggttcaagtgatcctcctgcctcagcctcccgagtagctgggactacaggcgtgtgccaccatgcccaactaatctttttatttttggtagagacggatttcaccatgttggccaggatggtctcaatctcttgacctcatgatccgcctgcctcggcctcccaaagtgctggattgcaggcctaagccactgcacccagccctattttttttttttttttttttttttagatggagtcttgttctgttgcccaggctggaatgcagtgtcactattttggttcactgcaacctctgcctcctgggttcacgcgattctcctgcgtcagcctcccgagtagctgggattacagatgcacaacaccacacccggctaattttttgtatttttagtagagacggggtttcactatgttggccagactggtctcgaactcctgacctcgtgatccaccctccttggcctcccaaagtgctgggattacaggcgtgagccaccgcgcccg

SEQ ID NO: 72611 - DNA, 601 bp, Human
ctaagttaataggaaatttgtaacatatataaaaaagacaactatctttaattctttaatatataaagagttctggaggaaatattaaactactcattctaactctgtgaacttgtcttgctcacccatttcatttttgttagaaaagtctggacacgctctacagccaatcacagcaaagaagagccgctgtgtgcacatgaacagatgggagggccatcctattgcgagtgggggttccaggagagcgcaggtctgcagggcccagtggcctacctcggagctggggcttttcagccayagcagcttggccaggtcgtccccagctgtattattgacggcatgctcaaacacctccaccttctgcatcagagtcaagtggtcatagtccggagccatctgcatcaggacacaactgttcagtaagagagcagcctaagacatgtagtttgggtccaggaagaaacaaggcttggggtccaggcagagctgagttctaatttccccatcatagccaaaggagaagggaaataagaacatggcaaaaggagaaacgaagtgaccactctaacctgatgaccactggaaccccaaggcataa

SEQ ID NO: 72612 - DNA, 601 bp, Human
tcccgcctgtaatcccagcactttgagaggctgaggcgggcggatcatgaggtcaggagattgagaccatcctggctaacatggtgaaaccccgtctctattaaaaatacaaaaaaaaaaattagccgggcatggaggcgggtgcctgtagtcccaactacttgggaggctgaggcagaagaatggtgtgaacccgggaggcggagcttgcagtgagccgagatcgcgccactgcactccagcctgggtgacagactgagattccgtctcgagaaaaaaaaaaaaaaaaaaaaaaaaaagccgggcatggtggcacgcgcctgtaattccaggtactctggaggctgaggcaggagaatcacttcaacctgggagacggagtatgtagtgagccgagatcgtgctgctgcactccagcctgggtaacagagtaagaccttgtctcaaaaaaaaaaaacaaaacaaaacacacaaacaaacaaacaaaaaaaacaaaaacaaaccaaaggaagaaactttaaagaaaaggattaaaaatttggtaacttctaactttaaaaaatgcctgtacagtcatatctctaagttagggcccccatcg

SEQ ID NO: 72613 - DNA, 601 bp, Human
tagcatgggatgtgaaacccagggggacactctatactgttgatttggacttagacaatgtaatacagataatataaggtcaaagtatgatttaatttcaatggattagaagctcttttggtgaacatcccctaaggtggcagaacaaagggtagatgaagatactgctgtcccaaatcataactgtttgcgtttcttattaaaatttcagcttactactctatataaagcccagagaaaaatcactaggatacttggttaatactgaagaatattttagtatctaaattgataatggcattttctgttttagttaataaaaatacttgaagttcttttccaggtgtcagagttactctgtgcaaatgtaatgcaatagctctgcaatgtatcccaggctgcaggcttgaaggggcataggtttgtaaaatgttatgtgctggatattgctaatttgggaggctgccaaccccagcttccacacacttgattttattttttatttgttttcttttatttttaaaattaaattttttatttttttatttttttgagacaaggtctcacgctgtcacctaggctagagtgcagcagtggcatg

SEQ ID NO: 72614 - DNA, 601 bp, Human
gccactgttggtgttagcatctaattctctacgcactctattcctttaacgcctgccctacctaccctaaaggggaaaagagaaggaaagttttatgttactctttatgtatttcaaagttttaagctggacatagctgtaatctcagctactcaagaggctgaggtggaaggatcacttgagtagctgagttcaagaccagcctgagactccatttgcaaaaaaaaaaaaaaaaaatttttaaatctgtaaagccattttcaaatgtgagttaataattattgaaaaaatttggtgcttmtcagaattgaaacatggattttcaggcaaattgcattaacaaaataaactcataggaataagaacaggtcaaaagcctcgtgacaaaatgtgtttggacaaaaactgataaagaaaattaacttcggaatgtgtcacacacaaggttgaaatgttattccttggaggaattttcatatcagctctgggtagaaaaagtcctcaggtgttaggttcaccctccactgattatggcttttagcagagaagagtctgaaatcagaattatgaagttttttgaatgctgtccttgtacatcaca

SEQ ID NO: 72615 - DNA, 601 bp, Human
gggctggctctccaagttccacaccgtccaaaatttctatgggaaaagaaatcaattaacagaaaattcaaacaccaaaaagccactgttggtgttagcatctaattctctacgcactctattcctttaacgcctgccctacctaccctaaaggggaaaagagaaggaaagttttatgttactctttatgtatttcaaagttttaagctggacatagctgtaatctcagctactcaagaggctgaggtggaaggatcacttgagtagctgagttcaagaccagcctgagactccatttgcaaaaaaaaaaaaaaaaaatttttaaatctgtaaagccattttcaaatgtgagttaataattattgaaaaaatttggtgcttatcagaattgaaacatggattttcaggcaaattgcattaacaaaataaactcataggaataagaacaggtcaaaagcctcgtgacaaaatgtgtttggacaaaaactgataaagaaaattaacttcggaatgtgtcacacacaaggttgaaatgttattccttggaggaattttcatatcagctctgggtagaaaaagtcctcaggtgttaggttcaccc

SEQ ID NO: 72616 - DNA, 601 bp, Human; identical to SEQ ID NO: 40309

SEQ ID NO: 72617 - DNA, 601 bp, Human; identical to SEQ ID NO: 40310

SEQ ID NO: 72618 - DNA, 601 bp, Human; identical to SEQ ID NO: 40311

SEQ ID NO: 72619 - DNA, 601 bp, Human
ctggctaatttttttttgtatttttgatagagacggggtttaccatgttggccaggctggtcttgagctcctgacctcaagtgatctacccacctcggcctcccaaagtactgggattgcaggtgtgagccaccgcgtcgagcctcttcagcctcttttaatcagcaattcttcagtctttatttgccttttcagggccttgacatttttgaagagtaaataattattttgtagaatgtctctcaatttgtgtatgtccagtatgtccttaacggttagattcaggttatgcagttttggyagcaattccacagaagtgtttttcagaacatagtgtcagtgaagttattatttttcccttcataactaatatatttcttgtagagagatacattgagactgtataggtatcctccttcttacactttttgccctcctgttgtagcatccattgataattcttgcctgtgacaagtgataaggacagtatatgatcttttcattccaactgtgatggttatcaaatggggatttttttaaaatgccatcactctgtctatgtatcttgtttggaattctgtaagtaagagctctttttttt

SEQ ID NO: 72620 - DNA, 601 bp, Human
gccttgctaatttttatgtttttagtagagatggggttttactatattggccaggctggtcttgaactcctgacctcaagtgatccacccgcctcagcctcccaaagtgctaggattacaggtgtgagccaccacgcccagcccacacatgagttttaaacataaaaacaattacttaatggccttgtgaaaattagtgttttatgaaaattggtattttaccccacagtaaaatagtagtaaggaaagtgtattgttaccttttagtaacttagtgagacacttaagtttctgtcttgcrtaaaatactcttttaagataattgttggatttgggatttgcagatggtactataaagttagcattcttctttcttggcaattagctaaaaacaacaaagagagggaaaaactgacacacaaacccagcattccactaaactagaagacagttaaaaaccccaagccacaaaataggtggaaatgttgccaggagcagtggccatcaggctggctgcatgtgggaagaagtaggtaggatgccgtggctgtggagctcagagacaacaagaaacacccatgaaactgcaaggcccccctga

SEQ ID NO: 72621 - DNA, 601 bp, Human
aaatatctcgaccagtttttttgtttgtttgtttgcttattacataggagtgtttgataaaagatagtattaggtttctttttctgctgtgacaggatcacatggtggtccttaggtacttatctaagtaattggtagcatagatggaattggtaagcatggaaattagatcctgtagaaattagttatactaattttatataatctgattaaataggcacaattcgctttaagttttttatttttttatttaccctgttttatgtaccttttgactataaaaagggtgctttaaaaactrttttcaaataaaaacctagaaaatgaatgtaaaaccatttttctacttcagactgggtcacaacatatttcttaatctattttaagacttataattgttaaaatatgtgaaaatgtcttttgagggttggtatatttcaactacagttagacaaattgtggttgttatgggttgatgttatttccttagtgagctttcaaaaatacctatgacttctgctgggcacagtggctcatgcctataatcccagcactttgtgaggccaaggcaggaggatcacttgagcttgggaggtcaagg

SEQ ID NO: 72622 - DNA, 601 bp, Human
aagtggtatggtaaaatgtagcctaagttaggtagaatttaaggttaatgcactggacagaataaagtggatagtatgtaatgctggcccagtaaattaactaagcagctataacagtcataaacaagtaggcaccaaacatagaagctctctataaaagcttcaaaacacaagaaaagaattcaatgagggccaggtgcagtgactcacacctgtaatcccagcactttgggatgctgaggagggcggatcacctgatttcaggagttcaagaacagcctgtccaacatggtgaaacccygtctctactaaaaatacaaaaattagccaggcatggtggctcacacctgtagtcccagccactcgggaggctgaggcaggagaatcacttgaatccgggaggcagaggttgcagtgagccgagattgtgccactgcactgcagcctgggcgacagagcaagactctgtctcaaagaaaaaaaaaagaatttgatgaaaatacagtaatattagatttgctgcatttgttttgtagatagatagacccaaaagatacagataaaggcatagggaattggactaacaaaatcagcaaatctt

SEQ ID NO: 72623 - DNA, 601 bp, Human
cacttgaatccgggaggcagaggttgcagtgagccgagattgtgccactgcactgcagcctgggcgacagagcaagactctgtctcaaagaaaaaaaaaagaatttgatgaaaatacagtaatattagatttgctgcatttgttttgtagatagatagacccaaaagatacagataaaggcatagggaattggactaacaaaatcagcaaatcttttgaataaagacctcactactttaaaagcccatggaacaattatacagaatcaatctcagacttgacaacaacaaagtaaatcctmaattgaaaagaagtagaggttttacaatacacattcttgataatttattctttcagaaaatatgtttgacctattgtgtttcttacatatgagttcatagcagcattttttaaaaaattatacattaaagttgatttttttggtatacagtttgatttttaacatatgtattaaaacaaatgtttatggtcatataattgccaccaccacagtcagcataccaaatagttccatcatccccagagctacctggtgctatccctttctgttctattctagtctggtcctcctgcctctaac

SEQ ID NO: 72624 - DNA, 601 bp, Human
tagggtacatgtgcacctctgagactgctttcacttagcttaatgcctttgagcttcatccaagttcctgtgaattgtttgttcctttttattgctgagctatattccattgtgtggatgtaccacagttttagttggtttatctattcatcaattgtgagacatttgtgttgtttccagtttttagtgattatgaatagtcctgttgtaaacattcaggtataggattttgtatgaatactaatttttatttctttagaatacatacccagtaatggaattggtgggtcatatgataaaygcatatttaactttggaaaacagtttggccatatttttataaagtggttgtatcatttttacattcccactagcttcatatgagaattcttattcttctatacccctcacctattatatatctacgagcagccttatttaaattttaaccatattttcaaatgagtaagtaggtatgtgttcagatctcattgtggtttaatttgaattttgctaatgactaatgaggttgagtatctttttaacgtctatatgcacatttatataggctgtatatatgtatttttttgcagtgtctgtt

SEQ ID NO: 72625 - DNA, 601 bp, Human
tttcagtagccataagatttaatattgctaagaggtcagttctccccaaagtgatctatagattcaacataatccctatcaaaatcccagcaggcttttatttttaaatcaacaagctgattctaaaattcactaggaaatgcaaaggaagtagactagccaaaacaacttggaaaaaaaccaaagctttatcaccattgagtatgacattagccatgggtttttcatatatggtgtatatcatgttgaggaaattcccttctattcctagtttgttgagtgttttatcatgaaagggaaytgaattttgtcaaatgcattttctgcatcaagatgatgatcatgtgtttaaaaaccttcattcttttaatgcgatgtattactttgattcatttttcttaaagttcaactgttcttgcattctgggaataaacttgattgattactgattcaatcttcttactagttatgggtctattcaagttttctattcatgagtaaattttggcagattgtgtatttgttagaatttgcccatttaattatgttatccatttcgttgacataacggttgttcatagtattctcttatgatcctttt

SEQ ID NO: 72626 - DNA, 601 bp, Human
ggaaaaaaaccaaagctttatcaccattgagtatgacattagccatgggtttttcatatatggtgtatatcatgttgaggaaattcccttctattcctagtttgttgagtgttttatcatgaaagggaattgaattttgtcaaatgcattttctgcatcaagatgatgatcatgtgtttaaaaaccttcattcttttaatgcgatgtattactttgattcatttttcttaaagttcaactgttcttgcattctgggaataaacttgattgattactgattcaatcttcttactagttatgkgtctattcaagttttctattcatgagtaaattttggcagattgtgtatttgttagaatttgcccatttaattatgttatccatttcgttgacataacggttgttcatagtattctcttatgatccttttttttctgtaaaattggtagtaatgaccctgttttcatatctgagttttgtaatgtgaaccttttctctcactctcttttttttttgaagttaatctagtttaaaagtttgtctattttgttgatctttaagaaaaaacaactttggttatcagttttccttattgtgtttt

SEQ ID NO: 72627 - DNA, 601 bp, Human
caccattgagtatgacattagccatgggtttttcatatatggtgtatatcatgttgaggaaattcccttctattcctagtttgttgagtgttttatcatgaaagggaattgaattttgtcaaatgcattttctgcatcaagatgatgatcatgtgtttaaaaaccttcattcttttaatgcgatgtattactttgattcatttttcttaaagttcaactgttcttgcattctgggaataaacttgattgattactgattcaatcttcttactagttatgggtctattcaagttttctattgatgagtaaattttggcagattgtgtatttgttagaatttgcccatttaattatgttatccatttcgttgacataacggttgttcatagtattctcttatgatccttttttttctgtaaaattggtagtaatgaccctgttttcatatctgagttttgtaatgtgaaccttttctctcactctcttttttttttgaagttaatctagtttaaaagtttgtctattttgttgatctttaagaaaaaacaactttggttatcagttttccttattgtgttttattctctaattatctttgctc

SEQ ID NO: 72628 - DNA, 601 bp, Human; identical to SEQ ID NO: 40312

SEQ ID NO: 72629 - DNA, 601 bp, Human; identical to SEQ ID NO: 40313

SEQ ID NO: 72630 - DNA, 601 bp, Human; identical to SEQ ID NO: 40314

SEQ ID NO: 72631 - DNA, 601 bp, Human; identical to SEQ ID NO: 40315

SEQ ID NO: 72632 - DNA, 601 bp, Human; identical to SEQ ID NO: 40316

SEQ ID NO: 72633 - DNA, 601 bp, Human; identical to SEQ ID NO: 40317

SEQ ID NO: 72634 - DNA, 601 bp, Human
tatttcaataagcaatggtgccttttacatggttttacagccactaactttgagggatatgtgtttaggtagttttcatagtgtgtggattttaataagtaattctctgcacatagagaccagaccagataacagccaaacacactgaaaattactccaggctacagaaagcaaggaacaaatgtgtctcagaaactatcagcctgtgtgtctcagaatttgaagcattttccacttgactgtatcctccaacaagaaatctatcctctaagagggcttcattattcctcctcctatattaaaaaaatggactctttcattgcaaaccaatgggaagttcttaactcatttccttagatcacttgaaatgaaagtgctttctgtctttagggaaaataattgctggatgtgatgccttttgcctgctcttgagtcccacaatcaatactgtgaaggaaagaaaaaattaacccttagatacttttaggaagagtgaggttatttttaaattcaatgatggtagagttctaaaaagggagaaggaaagtcctcccttccaaggagaatgcagttgccttcctctaaacaaattggctctgtt

SEQ ID NO: 72635 - DNA, 601 bp, Human
cagggaacaagcatgaggtttagaattaaatagctccaggttggaaatcaaactccatcattttgttcatggatctgtctaaacctccatatcctcatctataaaacaaggaacatacacaaacctactttataaggttgctttggggaaaaaaaaacatatataagtgctaagaactaggcctggtatattttacgtatccagtaagggttagtgattgatttttgctattgtgattattgctgatgagatttttttccacatttgtaaatttgcaacataactgtagcatattttcttragcatcaaaacttattaaaccctctttttcccaaactaccttttcaaagtgaattccataaacccccaacttacaaacactaaacttatattttacctgtacagatggctgcacctatgctcctcccctccactcccaatgcccttttcctgccaccaggacaattatggaaattgagcttttaacatccctggattcaaaaatagggaaataaagaggccacataaaggtggaactgctgaaaacagtcgtttgttcaaaattttgaaaaagaaaggacttgactgcttagagtaacgg

SEQ ID NO: 72636 - DNA, 601 bp, Human
ctaattcttacaacagtcctataagaagccccattttatggatagagaaatgagcaatgaaggctgatttgctcaagaacacagcaagtgatggaatcagaatttgaacacagctgacttcagaacctttgctcttacccactataatgcactgtcaagagatgagaaggaactggccaggtaaaaggcaggaagatgtggccttcaagtcaagtcattccaggtggagtgggtggctcgagcaaaaccaatatagcctggcctatttttaattattccaatattagcaaagaataaaaasaaaaactgatgaaagatgacattggagaagtaatcagagccaaatcatgagagagatgtatacagcattgcttcatttatcccaaatgagcagggaacaagcatgaggtttagaattaaatagctccaggttggaaatcaaactccatcattttgttcatggatctgtctaaacctccatatcctcatctataaaacaaggaacatacacaaacctactttataaggttgctttggggaaaaaaaaacatatataagtgctaagaactaggcctggtatattttacgtatccagtaaggg

SEQ ID NO: 72637 - DNA, 601 bp, Human
caaaaaacccactataatttttcactcgagtattgattatacagtacagaccaaaaactctccaaccacctccatttgcaaggcagagaacaaaagtacaactgtatctaatattgagaagttatcatcaaaccaacaaaccgataaaacatgttctattctcctccctggacaaacaaatctgcataacaatctggaatgccaaattcaaatttagactcctgaaactccaggaagtttggtcctgcaatctggggacacagggcaagcctataccacttgcatatgtgggccccacagmaccaaatcaaagatccttccacaatgtctccctcaaagagctgtcccttagccgttccttgccccctctgatgtgtggactaggattgtacataccaggggggcaagccactctcaggaagaagattggggaaaatgccccacgcaggcaggcaggctgcagaagtagagttgggtcatttgggcaggaaattccagagtctagaaagatcccattaacaccctgcctcactgagaaagggtgaaaccagagaaaaagaaggatgtggccccttaaagtatagggcacagagcatggacc

SEQ ID NO: 72638 - DNA, 601 bp, Human
aagacagttcaacagaaagggataaaagtcgattccttcaaaactcattatcattatccaaaacagtcaaactgtaagccttggaaccccatgttacttggtttcttactgatttaaggaatgaaactaggaatctcctcttatctgtggaggatacattccaagacccccagtggatgtctgaaacttcagatggtaccaagccctatataccgttttttcctattttttcctatacatacatgcctatgataaaatttgatttataaattaggcacagtaagagatgaacaataataamtaataataaaatagaacaattataacaatatacctgcatcatcagtcttgcattttggggccactggtaaaataaaatcggtgttccttgaacacaagcacggtgatcccaccaccaagatggatattaagtgactcatgggcagcaagtgtcaacagtgtggagacgctgaacaaagggaagattcgcatcccaggcaagacatagtgggacaaagtgaaatctcatcacgctactcaaaacagagcacaatttaaaacttatgaattgtttatttctggaatttccatttaatatttt

SEQ ID NO: 72639 - DNA, 601 bp, Human
ccattagaagagatgatgtagactgcatatactattactagaaaaatatttgcaatgtactgttgaattcattatatttttgtttcatttatacacacattggcattgaatgatccagaagaatataaaccaaaatattagcgatgtttgttaaatgtcaattacttttacaaatgaaaatagtgttgcttttatcctttaaatatcaacctcaagacagtacagatctttaaagaggctttttaatttcctatgctcagctatacaacaactacatatgaagaaatcattaaagaaaaaagtctaacataaatttgtcagcagcataatctttttttaaagtatttttatggtaatacttggacaataaataattatttttccaaaataaaaaattataaagctattttttcacaagtttataaattaaaagttatttaattatatgagaaaattctaaaggtataattttgagtgaataaaagaggatataaaattaaatatacaaaatacatacaatttagtaatacacacaaacaaacatacacaaaagagactgtttacaataagtacttccgagtgagggaatttcagcaggctt

SEQ ID NO: 72640 - DNA, 601 bp, Human
aaagtgagaaattacaacataaatatccaataacagtatattaattaaatacatttgtatctatcctaacaatggaaaatcttacagccattagaagagatgatgtagactgcatatactattactagaaaaatatttgcaatgtactgttgaattcattatatttttgtttcatttatacacacattggcattgaatgatccagaagaatataaaccaaaatattagcgatgtttgttaaatgtcaattacttttacaaatgaaaatagtgttgcttttatcctttaaatatcaacctcragacagtacagatctttaaagaggctttttaatttcctatgctcagctatacaacaactacatatgaagaaatcattaaagaaaaaagtctaacataaatttgtcagcagcataatctttttttaaagtatttttatggtaatacttggacaataaataattatttttccaaaataaaaaattataaagctattttttcacaagtttataaattaaaagttatttaattatatgagaaaattctaaaggtataattttgagtgaataaaagaggatataaaattaaatatacaaaataca

SEQ ID NO: 72641 - DNA, 601 bp, Human
atgtctgggctaaagtttagtggcatggaagaaatgcttgtagtagcattcgttttaagttaataaactcaaggaacaaaaattttaaaaagattttaaaaaaagaactggcgcttcaaactaaaaagtgtgaaaagattaattctagaaatttataagcaggtaagtgtttaagatgtatacaaaaggatgatcaccacatctttattcataaaagtgagaaattacaacataaatatccaataacagtatattaattaaatacatttgtatctatcctaacaatggaaaatcttacagycattagaagagatgatgtagactgcatatactattactagaaaaatatttgcaatgtactgttgaattcattatatttttgtttcatttatacacacattggcattgaatgatccagaagaatataaaccaaaatattagcgatgtttgttaaatgtcaattacttttacaaatgaaaatagtgttgcttttatcctttaaatatcaacctcaagacagtacagatctttaaagaggctttttaatttcctatgctcagctatacaacaactacatatgaagaaatcattaaagaaaaaa

SEQ ID NO: 72642 - DNA, 601 bp, Human
attcatgatcataaaaatagtagataaactaaatttccaacaaagatcattggttaaatacatttaatgatattcatatgacagaaaattatgcaagcgttaaaatgtatgtctgggctaaagtttagtggcatggaagaaatgcttgtagtagcattcgttttaagttaataaactcaaggaacaaaaattttaaaaagattttaaaaaaagaactggcgcttcaaactaaaaagtgtgaaaagattaattctagaaatttataagcaggtaagtgtttaagatgtatacaaaaggatgrtcaccacatctttattcataaaagtgagaaattacaacataaatatccaataacagtatattaattaaatacatttgtatctatcctaacaatggaaaatcttacagccattagaagagatgatgtagactgcatatactattactagaaaaatatttgcaatgtactgttgaattcattatatttttgtttcatttatacacacattggcattgaatgatccagaagaatataaaccaaaatattagcgatgtttgttaaatgtcaattacttttacaaatgaaaatagtgttgctttt

SEQ ID NO: 72643 - DNA, 601 bp, Human
gggtatgatctgctgcagattcatgctgaagacgtttaattttagtaaataggaaaatgactcttaaaattagagttgtgaaacatagtatttctattttatccaggacacttttctttttccttgaaatctctaccttatcatgaagtaaaagttcattttcctttttaaatcacagttttatttaattgcttaagtcctagaagaaagaaagctattgctttttaaatggagataaaacaccatgctaattatcagctgtactgtaatggagctgataaccatgaaaaataaaagcacrtgtaccactgcactacataaattcctcatagctgggtctctgcaatcccaaatgaagggtttacctgccactgtacatatccagttgtatggggatcttttttcattgcctgacctattgtaaatccacctaagggaaattttataatttaatctaacaatcatagtatatctatttatgcaatcactttgcacactgaaagaggcaacaccccaaatctgcacttagccaaagccaaagattttctatgaacaatcaaagatgccagatataagaattggtgtttactgatggagggag

SEQ ID NO: 72644 - DNA, 601 bp, Human
aggtattcagacagctgtctaccagcctttcagataatctgatgtttttattcatccaatactcattagacatttagtaaggctgtgaccagggacttgagacagacatatatcaacaagacttcatttctagccccaaagcaccaaagcaacagtatgtggagccatttcacacaagtgcaagggagtagaaggacacaatacagatgatatcgagcaatgtcacagtcaccaacacttcaccaccaaaacactgacccaacaaaatatcatcatggaatttttgtgcctttttatgacrcctccacccttcaccaggtgggtatgatctgctgcagattcatgctgaagacgtttaattttagtaaataggaaaatgactcttaaaattagagttgtgaaacatagtatttctattttatccaggacacttttctttttccttgaaatctctaccttatcatgaagtaaaagttcattttcctttttaaatcacagttttatttaattgcttaagtcctagaagaaagaaagctattgctttttaaatggagataaaacaccatgctaattatcagctgtactgtaatggagctgataa

SEQ ID NO: 72645 - DNA, 601 bp, Human
taaagtgcttttcctctccagcatttcacatgttgcataggttagcaagagtccaaagatatcataccactgaactagacggagacctctgccatcgcaatcacgattcaggcaccacactgaatggaccagagtggagatttgggccctttatggactgaatcaaatacaggcagacacagctaagttctgaaagctacggcaaacctgtgtttgtttttcctcccatataaagaagtggagagactggagaatgttgctgctcctttcccattgtgtgctgcgtgcttgtttgctgtaygggggaaggcctgcgtcctcttggcctatcgctctgttctcagtaattagcattgtgcctggcacatagaaggcatcgaatatatatttgttgaataaaggaatgaaggagtgaatacatgaattagcagtgaatatttagagcctagagtcttaataatagacaataaatgaaactgtccctaaaaggtattcagacagctgtctaccagcctttcagataatctgatgtttttattcatccaatactcattagacatttagtaaggctgtgaccagggacttgagacagacatatatc

SEQ ID NO: 72646 - DNA, 601 bp, Human
ccatagttggagcagttattaggaaacaataaagtgactgtgtttttaccccaaattgagactcagctcactgcctactgactcagctcaccagagtcttgctgccggcccctccacttcctcttctttgctattgcagggtggcaggttgagttgagaacagttgcttacaaagtgagcaatccccttccaagccagcctgcctctgtctctttgattctaccagtaattgagctttgtgtttccccatgggctcatgtatctttcagcaaggttttaaagtgcttttcctctccagcakttcacatgttgcataggttagcaagagtccaaagatatcataccactgaactagacggagacctctgccatcgcaatcacgattcaggcaccacactgaatggaccagagtggagatttgggccctttatggactgaatcaaatacaggcagacacagctaagttctgaaagctacggcaaacctgtgtttgtttttcctcccatataaagaagtggagagactggagaatgttgctgctcctttcccattgtgtgctgcgtgcttgtttgctgtatgggggaaggcctgcgtcctcttg

SEQ ID NO: 72647 - DNA, 601 bp, Human
acagtacacaacagattggatctttacaaattatatgaatatattaaattatcacatgtaccccaaagctatgtacatctataatgcatctatttaaagaaagaaaaggaacttagctggtgtacaataactaagcttcatgaaggttcaaagacttatccggggaataagtataacaaagtgtgaggatttttccctcttatctgggaattacagtcaaggccccaccctgaggccaaaataggctaagtaccccatcttttatgtttaccactccacaggttttctaagaggaccagtyctggcaccacccagctgatttatactagggaaggagctgccttgggagtggcatgcttttgtggtgaggccacagcctttccacccccacggagaggggagacaagggctttccctccctgccaacacagaagaggggtagaggaatctccaaacaaatcacctgtaaagaagtgaagccgggagcggtggcttacgcctgtaatcccagcactttgtgaggccgaggcgggaggatcgcttcagcccaggagttcgagaccagcccgggcaacatagggagatcccttctctacaaaga

SEQ ID NO: 72648 - DNA, 601 bp, Human
gagcaatcttctggcttcttaattggttctttccttttgtaacagaatgctcagtgggattttatgccagaattatagtttcagtccaaggctggagatgcagcttctgagtatgctgcatgagttgggagagcccctggacatatggccctcagcagggctgggggaagagtctgactggcaatccagcgcccccactataattgcccttcaccttggcgaacatgaagggaaaattgggagcaagaaaaacctattgagaatggggattcttccctcccctgaagaagagggaggcccmaagagaatcaaagttgggggtacctagccagaggggcatcattcatcattccccatttggagtctgcttagctaggaggtgtgttgatctgaccacgagcttcctaagcaagaagaaaaggaaatttttaaaaaggcagtgaagagtgattctaaatggtgaagaaacagttcaagacattcacggtaagccccataaaaaggaggtgaggggcttgggcatctcatttgtaatgggaaaccttgatttcttgcttaagatgaaacagaatggactcagttgagcatttccatatgacat

SEQ ID NO: 72649 - DNA, 601 bp, Human
agtgatcccatagggagagaacgagggcactcaaaatggaagccatggtcttttcataacctaatctctgaagtggcgtgccatctcttccatagtatcctattctattctagtagtgagtcactaaacgcagcctccactcggagacagatgacacaagggcatgaataccaggagtggggatcactgggacccatcttagaggttgtgcatcaccatgtataacacatgttgagtgtatctagatatttctgtagacacagctgtaaaaattcatacacagtaaggagattatatatcycagtttgttggaaatagtcttagtttgtgcctgttgtcccggcataattatggcattttatctcaggtatcccagtttaaataatgaattatactctaaataggaaaacatctggaagaatagacatcaaaatgttaacattatttatctctaggaaatgaaactgataagacctttatgtttgattaatacacttgcataaggcaacaagtgaattattttaataaaaaaaatacacattggattctctctcaataactcaaaacattatcacatagattccacttcagagacagtgac

SEQ ID NO: 72650 - DNA, 601 bp, Human
ctactgatagacgttgtgggtgggaaagaggatattgttaaaaacaatttattacgtgatttgattttttatttaataaatgtggatgggttatctattatgatataacaaattaccacaaacttagcagcttaaaacagccaagacttactttctcacacagtttatgagagccaggagtatctcagctggagggctctagctcaaggtctctcatgaagtgtagtcaagctgtctgctggggctgcggtcatcggaagctaaaggatacgcttcctagttcacttacgtggttgttggyggcctcagttcctcactggctatcaaccagaactgcagttttttcgcacaagggtctctccatagactgcctgagtggcctcatagcatggcagctggtttcccccagagcgagtgatcccatagggagagaacgagggcactcaaaatggaagccatggtcttttcataacctaatctctgaagtggcgtgccatctcttccatagtatcctattctattctagtagtgagtcactaaacgcagcctccactcggagacagatgacacaagggcatgaataccaggagtggggatcact

SEQ ID NO: 72651 - DNA, 601 bp, Human
tggctgctgagcagcagttggcaacagaacaatgcttcctttgtgcacagacacatgcacggtttggaaattcccacaattgtcggaaaagacatgttttttcagtgcatcattagtgttatggggacttggctacgattttcaattgctattgctcttgttggtaaatataaattagtcattgctggattaagcaaaagcagattgtttgtatttggtgtggcaaccaagtaggggcgtcacggaaatgaaaaaaaaaaaaaaacaataaatttgtaaaaataatttggtatttaaattmctaaaagcattaaagtggtcccgatggacacaagcaaaactttactaaactgagtataccatattcttttcaatgccgaagtcttctaaaagttttaatcagaacttttagttagcttagcaaaaaactttcatttcttgtgaattactggtctaaccctttggtatacagagatgataatttacattgatattttatgccataattttggaataacttttaaatttgagacatatctgtaaaatttacagtttaaatatgaatcatctataaatgcgctggtagagtccgagctcatgg

SEQ ID NO: 72652 - DNA, 601 bp, Human
accaaggattctcattcaacattctccaaagaagcctggctgctgagcagcagttggcaacagaacaatgcttcctttgtgcacagacacatgcacggtttggaaattcccacaattgtcggaaaagacatgttttttcagtgcatcattagtgttatggggacttggctacgattttcaattgctattgctcttgttggtaaatataaattagtcattgctggattaagcaaaagcagattgtttgtatttggtgtggcaaccaagtaggggcgtcacggaaatgaaaaaaaaaaaaaamcaataaatttgtaaaaataatttggtatttaaattcctaaaagcattaaagtggtcccgatggacacaagcaaaactttactaaactgagtataccatattcttttcaatgccgaagtcttctaaaagttttaatcagaacttttagttagcttagcaaaaaactttcatttcttgtgaattactggtctaaccctttggtatacagagatgataatttacattgatattttatgccataattttggaataacttttaaatttgagacatatctgtaaaatttacagtttaaatatgaat

SEQ ID NO: 72653 - DNA, 601 bp, Human
tttatgtaggagattaattgcataaagtaggcaagacctccattgcaaaggactttaaatggctggctaggaaatttaggcttcatcccatagtcaaaaaggatgaaggtgactgtcaaaattgaggaattagtcagtgggcaagtcccctacactttttctctggtgctcctttctaaaatgttgatgctgataagcacccaacctaccaggctttgtgggtacataaaccacaactgagatgagctgatgatgttccccataaattctagtgtgttgccccaaaggtagagggttaacrttaataaaaccctccctctcctctaaataaacgtataaactaaccagctgttaaaatctcccctcctggctctttctcctggatcacctttggccaggatactgcctaccagggtcctagaataggacatgaagtgaagaaaaccaaaagacacttcttaggttctaataaatgaatggcacatctttccccagactttgatttttatttgtgatggaggaccacctagtagcaatctactaagttaattttaagagttattaaaattcagtattcaaacaccagaactgccacatgtga

SEQ ID NO: 72654 - DNA, 601 bp, Human
tctatggagaatgcacagtaagggtctttgtgtcctctgcttcaccttttgacatcagagggccaaacactccaccctcagatcatgctaacaccactgctttttgcacatgagacccaagaaggggcatgaagctcaattgtacatgtacatgtttctcctttcattaatattcatgagtctttctgtagcttattgaatatgtagatttggccactctgctcagtataaattcttgatccctttgcccctctctcaaagtatctgtttctggcttctggtgggaggctatgcttccaarcctagaagaatggccactttcaggctgcaacactttatgagaaataaagctctcctttccaaatttttgaatctcatcattctttagttggcagtagaaaggtaggtctggatcagtgaagaaaggagggcctacaggaaaaagaagaagaaatttaaaaaatatatttcgttcttactatgcacagatgctatgccatgtcctttcatatatattaccttcatttcattctcaaaacaatcctatgaattaggtacttttatttatctttacaagagttaagcagctgcacaaaatgac

SEQ ID NO: 72655 - DNA, 601 bp, Human
gcaactgaatggacactctcctggcgaaggggaccccaagataatcttgaaaactaagttcttggccatgacgagggataggaagttggacacaccttgctagacctcctccctcgctaactaccattagcttttcttccctaaagactaaagagaaaccggccctttcaaagaactccaccactgatgtccaacatccatctgacgctgcccctcctttttgcctgatgagacaccaccgactacagagtggttttggccagtctatggagaatgcacagtaagggtctttgtgtcctcygcttcaccttttgacatcagagggccaaacactccaccctcagatcatgctaacaccactgctttttgcacatgagacccaagaaggggcatgaagctcaattgtacatgtacatgtttctcctttcattaatattcatgagtctttctgtagcttattgaatatgtagatttggccactctgctcagtataaattcttgatccctttgcccctctctcaaagtatctgtttctggcttctggtgggaggctatgcttccaaacctagaagaatggccactttcaggctgcaacacttta

SEQ ID NO: 72656 - DNA, 601 bp, Human
atgaggcactacacagctgactgaaagatctttatgcttgggtggtaattaccaagcgctgggcttcatcagaggttgatccacggggactcagccatttcacaaatgtcagtctccacataacagcagtcttttctcttggcctagtcaatctccccagaaagaaaccctccaatatcttggtatggtttaagcctagttgctaacattctgccagccgggtgataagatggtctgaggtctctctcttcaggatacgacctttcctgtcttcagctaatgtcccaagtccagtgcctcyctgtttcatctccagtcttctaacagatgggaaagggcaactccttgcacctgtgggtagggggagagcagacacacttccagcccatcttcctggttttagtgacatcagcactgaatttgcaacagaactgacttccttttactgcttcccgtgttgtgagtactgaagttgtagatttctgtactctcctaatcagatatcactaggccatctgtttttcacctcctaatattttgttgatgtctttcgtctgctattttcttctcttccactatcttcattcttacaagtttatgc

SEQ ID NO: 72657 - DNA, 601 bp, Human
ccttggatatgtctttttatattcattgtgctggacacttggtgttcccttgcaaccagaaaacaggtccttcagctctggaaacagccttttattgtttctttaataacttctgccctctcttttatatttctctccctggaactcctattatccatacttctcacatttttatcactttttttcctttctgtcctttcaggagtgatttcctaaacattattttgctaatccatttgttgatgttttaatttctactatcacattttttaagaacaaaaagtctttcttggcttcaaarggttctatttgcacagattcctaccctttgtgaaagcagtatattttctttggaaggatcataactatatcatttgttgtgtattcttctgcctcctgcttgtctgttttctgtgttttttctaatgctttgtttggtctctgtttttttatgtgagaggctttctagaaatatttactgatccatagctgtccatttacatttgagaatgaggcactacacagctgactgaaagatctttatgcttgggtggtaattaccaagcgctgggcttcatcagaggttgatccacggggactc

SEQ ID NO: 72658 - DNA, 601 bp, Human
ttaagaatttccagcatactttttttttttttttttttgagatggagttttgctctgtctcccaggctggagtgcaatggcgtgctctcagctcactgtaacctccacttcccggcttcaagctattctcctgcctcagcctcccaagtagctgggatcacaggcgcccactactatgcccagataatttttgtatttttagtagagacagggtttcaccatgttggtcaggctgtcctcgaactcctgacctcaggtgacccacctgcctcggcctcccaaagtgctgggattacaggcrtgagccaccatgcccagcctagcatacatttttgtttgcatttattgaccaagcaatctcatacttatccctggcaaattctataaggtgtcaaaatttggcattggggttacctaactataaacccagcccaaaacagaatgatctttgcttgggtaatttttaataaataagacattaatattggtttaatgaaaatagctacatcttgaattatttagtaaaattaccataacttctaatcttgtggttttgggcagtctagtccacaggcagtaagaaggtttgttttgggaaagg

SEQ ID NO: 72659 - DNA, 601 bp, Human
taggaatctataaatgtacttctatcggtatgcctaatatatctctttatttatgtgctgtgtacacaatgtttcactgctaaaaatatataaaagagctctaatgaatgggcttaaagaaaaataaaagtgcttaaatcaaacattttatcagaaaaaaggatagactagtcaaatgctttttcaagtgtacatgacttaagtagaatctttaataaataagctagctttaaaattacaggtacggtaatattagaattgtcttaagaatttccagcatactttttttttttttttttttgagatggagttttgctctgtctcccaggctggagtgcaatggcgtgctctcagctcactgtaacctccacttcccggcttcaagctattctcctgcctcagcctcccaagtagctgggatcacaggcgcccactactatgcccagataatttttgtatttttagtagagacagggtttcaccatgttggtcaggctgtcctcgaactcctgacctcaggtgacccacctgcctcggcctcccaaagtgctgggattacaggcatgagccaccatgcccagcctagcatacatttttgttt

SEQ ID NO: 72660 - DNA, 601 bp, Human
tgcacagactaaactaatagaagactggagtaatatttttgactttttgcttaaaatgttgctgatcctttgttttgtttttcagagtaaaggaaactttttttttgagctattgacagcttttaacaattaagtatactcctataaataaaatttggagcatatttatttctctccacctgatttctccagaattcagaaactatttgtgaatattcttaacttatggcaatatagttatttgcataagttcaataagaatatgttttcatttgtaacaggacacagttggagaaactgrttattttaccacggctttgactggcatggtgtgctttcctttaaggaatcgaagttggcttagaaagccaataaaagccttttgggaaagctggcctcataccttgtctatgcagttcctgtacagggttcctgacctgtgttaagtaaagaatgtcactttctggcaggctcaggagccccagccttttaataccttggaacctcaagaagagagtaattcatccaactcataggtatttgatggtacaaatccatggctgggctcagctttaaaaaaatcttatctgagattcctttt

SEQ ID NO: 72661 - DNA, 601 bp, Human
tattgtcttgttttgatcctccttagaaggtggttttataatcagctgtaaaactctaacaagtgctcttgaatgaaggtgtctgataactctggagattgtgacatcagaatagtggtaaaactttcaggacccatggagagctgaaatgtttatgaatatcaagcagaataggtattaactgcacagactaaactaatagaagactggagtaatatttttgactttttgcttaaaatgttgctgatcctttgttttgtttttcagagtaaaggaaactttttttttgagctattgacarcttttaacaattaagtatactcctataaataaaatttggagcatatttatttctctccacctgatttctccagaattcagaaactatttgtgaatattcttaacttatggcaatatagttatttgcataagttcaataagaatatgttttcatttgtaacaggacacagttggagaaactgattattttaccacggctttgactggcatggtgtgctttcctttaaggaatcgaagttggcttagaaagccaataaaagccttttgggaaagctggcctcataccttgtctatgcagttc

SEQ ID NO: 72662 - DNA, 601 bp, Human
atccatggacaattattgtcttgttttgatcctccttagaaggtggttttataatcagctgtaaaactctaacaagtgctcttgaatgaaggtgtctgataactctggagattgtgacatcagaatagtggtaaaactttcaggacccatggagagctgaaatgtttatgaatatcaagcagaataggtattaactgcacagactaaactaatagaagactggagtaatatttttgactttttgcttaaaatgttgctgatcctttgttttgtttttcagagtaaaggaaactttttttttgagctattgacagcttttaacaattaagtatactcctataaataaaatttggagcatatttatttctctccacctgatttctccagaattcagaaactatttgtgaatattcttaacttatggcaatatagttatttgcataagttcaataagaatatgttttcatttgtaacaggacacagttggagaaactgattattttaccacggctttgactggcatggtgtgctttcctttaaggaatcgaagttggcttagaaagccaataaaagccttttgggaaagctggcctcatacctt

SEQ ID NO: 72663 - DNA, 601 bp, Human
ttataaattttgtatttttctgacttaattaatcctttaagatgttaggcttcctaaagtccaaagttgacatatttgacgtatttggtataaaaattatataggaagcatcgtcaaatctgaaatggtgtttggttttctttgggttgtatttgtataaatatgttattggtatgtgttccaaaattatgagacactcctatcattctgatatgacttagtgtacattttcagtaataattataattgttataataaattattgtgtgccacagaggtaataaatttctttgtcaattgygtctttgactatggctgccctaaaactttttgtcatccatggacaattattgtcttgttttgatcctccttagaaggtggttttataatcagctgtaaaactctaacaagtgctcttgaatgaaggtgtctgataactctggagattgtgacatcagaatagtggtaaaactttcaggacccatggagagctgaaatgtttatgaatatcaagcagaataggtattaactgcacagactaaactaatagaagactggagtaatatttttgactttttgcttaaaatgttgctgatccttt

SEQ ID NO: 72664 - DNA, 601 bp, Human
agtagcgtctgtcctgaaatttttccagatcctaattgtctctttcatgattcatggcatacacttctggtatttctgtgggtaagattcaaaattattttctgagaaaaactttggctttgtgctatgaaccattttcacagaatggaattccgtgtaaacacaagtcaaagattcccaactttctttacagagtattaactgtgccacctgcttgtctaaaacatatgggtctctctttactcagcacagaatatcagcatttcaggttgtcaacaacctttaactgactgtcatccastttccattaaggaacatgctagctgaatcttattctgggagctagaatctttatatttgtgaaattatgaaatataaatttgctctttgaccccgtttcctggcatacaagtcttaaaatcctcggaaactcaaaaatgatgtctttttgtatgctaatgagttgactggtggctagagacccctaggtagattcaggatgggggctgatcatttaaaaggccaaagcgggattacaggattagaactttaagctgcattccccaaactgtggggaggaaagggtggctgaagtttaagt

SEQ ID NO: 72665 - DNA, 601 bp, Human
agtgagcatgggacggactggtgtattgggggagaggctcacacagggttgggtgcatgcggcacttactctaagtgaaaaggagaagaatctgccctcccttacagatcctcaagaataaatccaactccaaaagcacagcaagacatttgaatttgactagaagttgcaatggagggtgtggggccactgcacaacagaaacttcacaaaatcttccagtggatgcctgtttctctcctggacatatttctaacattttctctaaccagccccgtcaagcccaccctctctcactcttrtctctgtcctatccacagcaaagtatccctctattagactcttcaattttgattcccctcataatcatttaacaccatgctcagatatgagaaaacccacccaagaaaatatttctgttatacatgaattcgtatctttatgaataaaattctgttcgtctgttaatggcatcacagaaaaacagggaagtgggtatctatcacatctggagagtgtgtttcagtggtctgaagtttaaaacatatgtttggagagatgcaatgaattcacttctggaggcttgagcaggagcatagggg

SEQ ID NO: 72666 - DNA, 601 bp, Human
tgtttctttcttcctagcatatggagggcagctttcacctgggagtttttaatctcctgccttcaggaagaaaaagggaagataagaatgtccttctcacatctgctgttcttcaagtgtctttagcttgaagtcatccccgtgtgatagtggtctgttttggggggcataatctgctgtccttcaaaatcattccagatagatcaaagaacaagtgcagaggccttaaagaggagcatgcctggtatgctgaaaggccatcaaggaaaccagcgaatctagaataaagtgagcatgggayggactggtgtattgggggagaggctcacacagggttgggtgcatgcggcacttactctaagtgaaaaggagaagaatctgccctcccttacagatcctcaagaataaatccaactccaaaagcacagcaagacatttgaatttgactagaagttgcaatggagggtgtggggccactgcacaacagaaacttcacaaaatcttccagtggatgcctgtttctctcctggacatatttctaacattttctctaaccagccccgtcaagcccaccctctctcactcttgtctctgtcctatc

SEQ ID NO: 72667 - DNA, 601 bp, Human
agtcctcaccgggtgatatttgagtaaagacctgaaggaggtgaagaagaaagccatgtgaatatctgaaagaagagtatagtggagtcaaaactctctgtctcctcgtagggtcctggctgggtctgagaattaaattgatacatgatagattaacaggagaaaagttttaaaatttatttaatgtaagttttacaggatatgggagccctcataagaaaagtaggactcaaagacatggcaaaacctacatgcaggccaggcactgtggttcacacctgtaatcccagcactttaggargccaaggcgggaagacagcttgagcccaggagtttgagaccagcctgggcaacatggtgaaaccctgtttctacaaaaaaaatttttaattagcctgatgtggcgatgcatgcctgtggttccagctacttgggaagctgtttggaggattgcttgagcccaggagttcaaggttgcagtaagccatgatcacactactgcactccagcctgggcaacaaagtgagaccctgtttcagaaccaaccaacaaaaagaacctacttgattttgtataaggctgaacaaagagacccatttgt

SEQ ID NO: 72668 - DNA, 601 bp, Human
agtcttttcaaagattaatcttctggataatttgccagaactacaaacacagagaaaaacaactcttatccactacttaagccagaaagtaatcttgtatttagcagtattttatttttcacatttgaaatgactgcatgataaaggaaatgtgttccaaagaaaggcagattagtgccatgtgtaatttgtgtttctctagtaagggcagagaaaattgaaagaaggaacttttgaaatataaatattttaaggaggatttgttttttctaatacatatttgttttataatttattgaasaagtacacaaaattatgtggattaaagaatatcaatgtttctaggaaggatttcaatgaatacttattttcagtcttcctactcaggcttactgatctatacagctagaaagattctagtattatcttttgagaaccacttatttgttattttagtagctggaagtgactggacccattcagacctcactcattcagtcaatcaacaaacatttgctgagcaacttctatgtgcctagtgctgttctaggcactgaggataaggcagtgaataaaccaggggcagaggtaggggggacac

SEQ ID NO: 72669 - DNA, 601 bp, Human
ttaatagttactccttctattctcaaacatgtccctttctgaataataagttgtacgttcaccatataaagagtagaagctgaaaagttaagcatctaacaaaagggggcttttctttaagtgaagaacctagtagcctacatagaaatcagagaagtttcttattctaaaaactaagcggcagatttcacatgaaagtagagtttgggccagcatatgctaattttttcccctgacttaaagaaatctgtctgaaataatcaattttgaagcaggtatttttttttttaagggtcactgytggctgatggcccagacatattttctatatgatctagaacaagaagtggcagaagctgctctgaagaatttcagtgaatgtttattttcagtctccctgtttatacctactagtctatgtagctagaaagattctaatattgtgttttgagaatcaagcagcagggtcttgctcatggagggggaatggaggcaagtggtgataatactgcctctggggcaaagacaatacctttgccccaggtattggggcaactgtattggttccctgcagtaggtaacatcattgacctaataggcc

SEQ ID NO: 72670 - DNA, 601 bp, Human
tatgaggaattatttactacctaggagagtaaattgtcagttaaaggaaatattaagtcagagcgtgtctggaatataaccttaggaaaaataccacataattattctgccaacgaatatttataaaattttaaataatataaagcagaataacagagttgagattaaataagtcaggtcttcatagaattattttacatactgacactcaaaacattagacaaaataactttgaagaactatatttaattttcagttatttaattccatttagacaatgagattttcaaggaaaaaaaaatgctaaattggaactcttcacatcttgttatgaagaactgaaagttaaatgttaaatctgccctcaaaaagttccatgaggaataaatactccaaaaataatatcatgagaaatcatctttgatccaatcacaatagagaattcctcatatccctcttccctgctttattcttctctctagcacttaaaactatttatatgctatatatttaatttatagtcttgtttattgtctatatccctaagacccagaatataaactccataaaggcagagacttctatcttctgttcactgttg

SEQ ID NO: 72671 - DNA, 601 bp, Human
tggctaaggtaaagttttatactggactgcaaacattttgtcagaagtgcatcctaggctcttattgagtcaacagaaaacacctggacatggtttaagactatctttaaaaataaggagcattatcaccagcacgatgctaaatctggggggaggataggctaaatttttagttcctatcccatgtctgctgatatcttatattttttagtcctcagagcaaccctaagagataattaagggtatggttattattattattatcatcatgattcctcccaattctcatctgaggaaacargcttagagcggttccaggacttgctcaggccacacagggcagaacaggaagccaggtccgcagagtccaggctttctcctctttgcgagctacctgctcagaaccattttgattcatttgtatctttctctgccctaaaaaaaatgctgtgtaaacactggccaactgccgcagtacaccaggtgccttcataggtatttttctactgaattctcacagtaacccatgagctggatgactttaatattcttttctcaagtaatttatctcaggtcacgtaactagggaaacggtggggca

SEQ ID NO: 72672 - DNA, 601 bp, Human
ggtagaccgagtgtctcttcttgctcctacgctggccctccgtttctcattagctgcttctctttcctcttcttctccaccctcattcatttttattggtgttttgccacccaaaaggtggcttccagagatggtaaaggttttctttgttgtttgttgttgttgtccttgttttttgaaacagggtctcactctattgcccaggctggaatgcagtcactgcaacctcaaactcctgggctcaagcgatcctcctgcctcagcctctcaaatggttgggataacaggcatgtgccaccaygcctggctaaggtaaagttttatactggactgcaaacattttgtcagaagtgcatcctaggctcttattgagtcaacagaaaacacctggacatggtttaagactatctttaaaaataaggagcattatcaccagcacgatgctaaatctggggggaggataggctaaatttttagttcctatcccatgtctgctgatatcttatattttttagtcctcagagcaaccctaagagataattaagggtatggttattattattattatcatcatgattcctcccaattctcatctgaggaa

SEQ ID NO: 72673 - DNA, 601 bp, Human
ggcaaagagaaggggctgcagaactgccctatgagactttcgttgagagttcactgagaacgtactggtagagcaaacactgaaagttcaatacgtggtaggtgttctccttcttattgtcacaccgtcccagcctcattgttgccaggaatcagcctagtcagtaaggctgcagctgcaggagccccgcggtgtgggcaagcttcctcagcctgcgggggaggtgctcttcctgccacactgtgcctccccttgcactctctgagatcttcgttggctttgccttcgtgaaggtttcaayggaaagaaggacagaagagaagggctcaaggcagacaaggggagaagagctcgggaagaaagctttcatcttatcaaacttggtagaccgagtgtctcttcttgctcctacgctggccctccgtttctcattagctgcttctctttcctcttcttctccaccctcattcatttttattggtgttttgccacccaaaaggtggcttccagagatggtaaaggttttctttgttgtttgttgttgttgtccttgttttttgaaacagggtctcactctattgcccaggctggaatgcagtca

SEQ ID NO: 72674 - DNA, 601 bp, Human
atgcgtgactagactatttcacagcaaaaaaaaaaaaaaaaagtttaagaaaaatacatcagattcattagattgtgttcagattcaggtgagatatgtcaaaagataaaaataaccattacagttgcagatgtactgattgatttaaacatccaggtccagaaaagacttggatagctaactttggagactgttgagctattcagctacagcagaggtgcatctctatcttcattaacaatcaggtggttaaattcagtgaaaagagacttccagcaagctgtatggcaggggaatacayagagtgaccctaaagagagtgcactccccaaaactggtgacaagatagagaacaatcccttgaaaatcttttgagtagaaatagaatgaaatgaatgatgtgatctcagacactggagagcaacctaccttctcactgctaaacctcatgggcctttttggttctcactttggcctctcagaagtgtttgacaccgtgatgagctctatgactttgacagaagtttctcccagctccctcagtgtctgaagcaccagcatcactggggtaacctcacccttctgggctgacttgcaggct

SEQ ID NO: 72675 - DNA, 601 bp, Human
agccaccaaaatgcgtgactagactatttcacagcaaaaaaaaaaaaaaaaagtttaagaaaaatacatcagattcattagattgtgttcagattcaggtgagatatgtcaaaagataaaaataaccattacagttgcagatgtactgattgatttaaacatccaggtccagaaaagacttggatagctaactttggagactgttgagctattcagctacagcagaggtgcatctctatcttcattaacaatcaggtggttaaattcagtgaaaagagacttccagcaagctgtatggcargggaatacacagagtgaccctaaagagagtgcactccccaaaactggtgacaagatagagaacaatcccttgaaaatcttttgagtagaaatagaatgaaatgaatgatgtgatctcagacactggagagcaacctaccttctcactgctaaacctcatgggcctttttggttctcactttggcctctcagaagtgtttgacaccgtgatgagctctatgactttgacagaagtttctcccagctccctcagtgtctgaagcaccagcatcactggggtaacctcacccttctgggctga

SEQ ID NO: 72676 - DNA, 601 bp, Human
attttagtcatagcaaagagatgggcagggtcgcagcagtcttccatttgtttcctaggagagaaaacagagagagagaaaagaacagcaggttaaatgaggagcagattcattcacttgtcattcccacagagatgtgccgccttacctcagtgccagctcacagaagcatagcatctccagggtgattagactactattaattcactcttctagccaccaaaatgcgtgactagactatttcacagcaaaaaaaaaaaaaaaaagtttaagaaaaatacatcagattcattagattgtrttcagattcaggtgagatatgtcaaaagataaaaataaccattacagttgcagatgtactgattgatttaaacatccaggtccagaaaagacttggatagctaactttggagactgttgagctattcagctacagcagaggtgcatctctatcttcattaacaatcaggtggttaaattcagtgaaaagagacttccagcaagctgtatggcaggggaatacacagagtgaccctaaagagagtgcactccccaaaactggtgacaagatagagaacaatcccttgaaaatcttttgagt

SEQ ID NO: 72677 - DNA, 601 bp, Human
aattccacaagtccctgatcattcatttcttgcttccttcagtctcataggactcaaatcagaaaggctaggaaaactgtaactctgtaacatcctgcttccacccttgcatcaaaacactgtgatttattcacacacacagatgacagatataaagaaaaacatttaaagagagaagaaagaaaacaaaaagtcaatctgatgagtaaggcaaactcaattatcccttttctatgacagcaagaaatttaagaaaccatactgaaggcaaccaactctatactaacctgtgggaagagagagtaagttgaattgtcaatggtgaatgagtataaaaactccccgtcataccacatgctcttccccataggggaattcattttagtcatagcaaagagatgggcagggtcgcagcagtcttccatttgtttcctaggagagaaaacagagagagagaaaagaacagcaggttaaatgaggagcagattcattcacttgtcattcccacagagatgtgccgccttacctcagtgccagctcacagaagcatagcatctccagggtgattagactactattaattcactcttctagccaccaa

SEQ ID NO: 72678 - DNA, 601 bp, Human
acagtggtaatctaaccacagggttaacattcaagagctctaagaagcaaacttctcaccatatggtccccactccctgagcaacatcagtcctaagaaaacattccagtatcacacaaatcctcatggtcattccacagccaacctcagaacactagaattccacaagtccctgatcattcatttcttgcttccttcagtctcataggactcaaatcagaaaggctaggaaaactgtaactctgtaacatcctgcttccacccttgcatcaaaacactgtgatttattcacacacacagrtgacagatataaagaaaaacatttaaagagagaagaaagaaaacaaaaagtcaatctgatgagtaaggcaaactcaattatcccttttctatgacagcaagaaatttaagaaaccatactgaaggcaaccaactctatactaacctgtgggaagagagagtaagttgaattgtcaatggtgaatgagtataaaaactccccgtcataccacatgctcttccccataggggaattcattttagtcatagcaaagagatgggcagggtcgcagcagtcttccatttgtttcctaggagagaa

SEQ ID NO: 72679 - DNA, 601 bp, Human
cctcttgctgcctacatgtatattagaaaaacattttatttcaatgcccagaaaaccaagaataaatattaagtaagcaaagcttgatttagaccacttcaaaagtggtcaagttgaattattcctctccatatccaccactcctccatttcacagtggtaatctaaccacagggttaacattcaagagctctaagaagcaaacttctcaccatatggtccccactccctgagcaacatcagtcctaagaaaacattccagtatcacacaaatcctcatggtcattccacagccaacctcrgaacactagaattccacaagtccctgatcattcatttcttgcttccttcagtctcataggactcaaatcagaaaggctaggaaaactgtaactctgtaacatcctgcttccacccttgcatcaaaacactgtgatttattcacacacacagatgacagatataaagaaaaacatttaaagagagaagaaagaaaacaaaaagtcaatctgatgagtaaggcaaactcaattatcccttttctatgacagcaagaaatttaagaaaccatactgaaggcaaccaactctatactaacctgt

SEQ ID NO: 72680 - DNA, 601 bp, Human
tatctaaggatgagctagtcagcatggctgttttatagagagtgtgactttggatctggtagaacctgtgcctcagctttgtgggattcctcctttaaagtctcatgggctattaacagagacacatgaaagattcagtcccactttctaaggcttaaaaattctctttctgtacaatcatctgagcaaaccaagggtggctaaaagatgtcttggggaggccatgattcatttctgaatttttccctaattgcaattttgcctaagatctcccctccccaaaactagggttccctaaaakaaaatttcccttttcccccctcttgctgcctacatgtatattagaaaaacattttatttcaatgcccagaaaaccaagaataaatattaagtaagcaaagcttgatttagaccacttcaaaagtggtcaagttgaattattcctctccatatccaccactcctccatttcacagtggtaatctaaccacagggttaacattcaagagctctaagaagcaaacttctcaccatatggtccccactccctgagcaacatcagtcctaagaaaacattccagtatcacacaaatcctcatggt

SEQ ID NO: 72681 - DNA, 601 bp, Human
ctttgacacctggaagcctcccaagggcagatgaagagagaaaacatgtagatgctggcaataaactaaagcttctacttcttatttcaaaaattaaaagaaaaaccttatcactgcattttaagaccattaaactagactaaaatatctaaggatgagctagtcagcatggctgttttatagagagtgtgactttggatctggtagaacctgtgcctcagctttgtgggattcctcctttaaagtctcatgggctattaacagagacacatgaaagattcagtcccactttctaaggctyaaaaattctctttctgtacaatcatctgagcaaaccaagggtggctaaaagatgtcttggggaggccatgattcatttctgaatttttccctaattgcaattttgcctaagatctcccctccccaaaactagggttccctaaaataaaatttcccttttcccccctcttgctgcctacatgtatattagaaaaacattttatttcaatgcccagaaaaccaagaataaatattaagtaagcaaagcttgatttagaccacttcaaaagtggtcaagttgaattattcctctccatatcca

SEQ ID NO: 72682 - DNA, 601 bp, Human
aggacatttccatgcattatctaagttgatcttttccacagctctgtaaggtaaatagggcaagtgctgctctagccatcatagagacaagacagctaaatctcagacgacttaggtaatcatccaaggaatttagttagtaagagatggagacaaaattcagttccatatatcatagctcttagttatttcctttgacacctggaagcctcccaagggcagatgaagagagaaaacatgtagatgctggcaataaactaaagcttctacttcttatttcaaaaattaaaagaaaaacctyatcactgcattttaagaccattaaactagactaaaatatctaaggatgagctagtcagcatggctgttttatagagagtgtgactttggatctggtagaacctgtgcctcagctttgtgggattcctcctttaaagtctcatgggctattaacagagacacatgaaagattcagtcccactttctaaggcttaaaaattctctttctgtacaatcatctgagcaaaccaagggtggctaaaagatgtcttggggaggccatgattcatttctgaatttttccctaattgcaattttgcct

SEQ ID NO: 72683 - DNA, 601 bp, Human
atttgaggaagatttgaaatgaggaggagaattggaactcatattctttcccctatttctaacagaagcagttgtggccacactaacagcaatgccaagttggggcttcccagtccctagaccacagttacagtagtaggttcttgtactcagtaattctaggaaccaccctttggctcccatttctccattcttccaatgatttttttaaatgccaaattccctatatgaaatatctttctgctaaaagtacctaaagagatttctgtaccttgcctaaaccctcaccaatacaattctrcttttcatgcctcagcctcaagatactaagtatgaatcagcacattaataccaaacatataatgctttgtatttataaagtacatttattatgttttacagtcgggcgcggtggctcacgcctgtaatcccagcactttgggaggccgaggtgggcagatcacttgaggtccggagttcgagaccagcctggccagcacggtgaaacatggtctctactaaaaatacaaaacagctgggtatggtggcacatgtctgtgatcccagctactcaggaggctgaggcaggagaactgcttga

SEQ ID NO: 72684 - DNA, 601 bp, Human
gttttcatacatagactatcctgtggattggcttgcttaacctctgtaccactctctttccagcttcctgctgaagcatgacagttaaaaactgcctttcctggacttcttcacaactagtgttctggatgcaaatcatttctccattagaagcatttgaggaagatttgaaatgaggaggagaattggaactcatattctttcccctatttctaacagaagcagttgtggccacactaacagcaatgccaagttggggcttcccagtccctagaccacagttacagtagtaggttcttgwactcagtaattctaggaaccaccctttggctcccatttctccattcttccaatgatttttttaaatgccaaattccctatatgaaatatctttctgctaaaagtacctaaagagatttctgtaccttgcctaaaccctcaccaatacaattctgcttttcatgcctcagcctcaagatactaagtatgaatcagcacattaataccaaacatataatgctttgtatttataaagtacatttattatgttttacagtcgggcgcggtggctcacgcctgtaatcccagcactttgggaggc

SEQ ID NO: 72685 - DNA, 601 bp, Human
aaaaaaaagctactttggatttcatttaaaatgtttctatgtgaggagctgttaaaggagattgcttccttatctcttcctcatgccacaactagtttgtagcagttttcatacatagactatcctgtggattggcttgcttaacctctgtaccactctctttccagcttcctgctgaagcatgacagttaaaaactgcctttcctggacttcttcacaactagtgttctggatgcaaatcatttctccattagaagcatttgaggaagatttgaaatgaggaggagaattggaactcatmttctttcccctatttctaacagaagcagttgtggccacactaacagcaatgccaagttggggcttcccagtccctagaccacagttacagtagtaggttcttgtactcagtaattctaggaaccaccctttggctcccatttctccattcttccaatgatttttttaaatgccaaattccctatatgaaatatctttctgctaaaagtacctaaagagatttctgtaccttgcctaaaccctcaccaatacaattctgcttttcatgcctcagcctcaagatactaagtatgaatcagca

SEQ ID NO: 72686 - DNA, 601 bp, Human
ttatatttctttaatcatccttttaaatctattttctaatacaaagttagaattcatttggtaaaactaaaagtcctcatctataaaaaaaagctactttggatttcatttaaaatgtttctatgtgaggagctgttaaaggagattgcttccttatctcttcctcatgccacaactagtttgtagcagttttcatacatagactatcctgtggattggcttgcttaacctctgtaccactctctttccagcttcctgctgaagcatgacagttaaaaactgcctttcctggacttcttcrcaactagtgttctggatgcaaatcatttctccattagaagcatttgaggaagatttgaaatgaggaggagaattggaactcatattctttcccctatttctaacagaagcagttgtggccacactaacagcaatgccaagttggggcttcccagtccctagaccacagttacagtagtaggttcttgtactcagtaattctaggaaccaccctttggctcccatttctccattcttccaatgatttttttaaatgccaaattccctatatgaaatatctttctgctaaaagtacctaaag

SEQ ID NO: 72687 - DNA, 601 bp, Human
gcacaaagaggcacagaattcatttgcacagactttacaaagtaaatgtttcttataaccctattgctgcaaccgatagataatataggaggctagtttatatttctttaatcatccttttaaatctattttctaatacaaagttagaattcatttggtaaaactaaaagtcctcatctataaaaaaaagctactttggatttcatttaaaatgtttctatgtgaggagctgttaaaggagattgcttccttatctcttcctcatgccacaactagtttgtagcagttttcatacatagamtatcctgtggattggcttgcttaacctctgtaccactctctttccagcttcctgctgaagcatgacagttaaaaactgcctttcctggacttcttcacaactagtgttctggatgcaaatcatttctccattagaagcatttgaggaagatttgaaatgaggaggagaattggaactcatattctttcccctatttctaacagaagcagttgtggccacactaacagcaatgccaagttggggcttcccagtccctagaccacagttacagtagtaggttcttgtactcagtaattctag

SEQ ID NO: 72688 - DNA, 601 bp, Human
gcccactcacctgcatttctacctcacctgcacacgctattttcttcccactgggaacataaatgaagcgtatcaattaactggcaaccctttttggctgataacaaactagaaacattttgctaagaaataataatggatgagagcagagggaaaataccattttttccagtgatgcaaactggtttaccaagatttctatgaattaattagtcatttcagattcttagcaggaaaatacatacatatgcaattaaaaaaaatctactcattgaattggttctgccttttgcaatggctrtgcccatacacaatgatgtcatgacttctgattcccaagaaaaaagtattcttcctttattattcaaggatgtttccttggtcttgcaactggcacaaagaggcacagaattcatttgcacagactttacaaagtaaatgtttcttataaccctattgctgcaaccgatagataatataggaggctagtttatatttctttaatcatccttttaaatctattttctaatacaaagttagaattcatttggtaaaactaaaagtcctcatctataaaaaaaagctactttggatttcattt

SEQ ID NO: 72689 - DNA, 601 bp, Human
agcagataaggacttttagaacacagaacactgtcatatggagatatgaagttatgtacaccgcattatgtggcagaattgaataaatttgaacagaaagttacagaaagttgtggaaggttcaaatagcatagaactaactaactaaaaggagtttgatgtggcatctcaattcacagacatttcaatagttacctcctgaggatacactgccccagccattataggacctgttgccattccctaatgtaccagagcatctcccttcttacactgcatctttgtaccaacgacaaaaaaacaaaagtaggcaaacgaataacattgataatgatggctaacatatacggagtatttaaggggcaagtgtaaaggtacagacatggaatcgaagttagaaatgagtgacttagcattatttcactgaaactctgggaaaggagtgaagctttgttcatgctgaaaacgctgagcctggcccactcacctgcatttctacctcacctgcacacgctattttcttcccactgggaacataaatgaagcgtatcaattaactggcaaccctttttggctgataacaaactagaaacattttgct

SEQ ID NO: 72690 - DNA, 601 bp, Human
accctcttgttctcaagagctcacaagatggtactgagatagcagataaggacttttagaacacagaacactgtcatatggagatatgaagttatgtacaccgcattatgtggcagaattgaataaatttgaacagaaagttacagaaagttgtggaaggttcaaatagcatagaactaactaactaaaaggagtttgatgtggcatctcaattcacagacatttcaatagttacctcctgaggatacactgccccagccattataggacctgttgccattccctaatgtaccagagcatytcccttcttacactgcatctttgtaccaacgacaaaaaaacaaaagtaggcaaacgaataacattgataatgatggctaacatatacggagtatttaaggggcaagtgtaaaggtacagacatggaatcgaagttagaaatgagtgacttagcattatttcactgaaactctgggaaaggagtgaagctttgttcatgctgaaaacgctgagcctggcccactcacctgcatttctacctcacctgcacacgctattttcttcccactgggaacataaatgaagcgtatcaattaactgg

SEQ ID NO: 72691 - DNA, 601 bp, Human
ttccatggaaatttgtgtccttccttggcaagatatcttaggtcaaaatagggttcattcaataattcctgtaaacactggaccatgcaggcttaaaaggggcagttcctggctaagcaggaaagagctggtcccaacccaggggattgggagcagctattctcaaagtgggaaggctgataccatcacaccgtcctccccaaatacaaacacgcacacatacatcgcatgttttaaaaatcctgtgtgaaggttaaaaattctgcccttcatgcctaataatattcaacaaatatttcamcaaaatacatttatagagccctttggaaacagctacctctgaatttcctgcttggtttcctatagttcaagcaagggtactgcaggggtccagcccaagtgagacacagacaggaacgcccttgacagacatgagtggttgggaatgactatttatactgagtgggaagcactgcagtgggcacaaaagggaaaaccctcttgttctcaagagctcacaagatggtactgagatagcagataaggacttttagaacacagaacactgtcatatggagatatgaagttatgtacaccgcat

SEQ ID NO: 72692 - DNA, 601 bp, Human
tgtggtttctaacattcctgctactgcctcactcatttccatggaaatttgtgtccttccttggcaagatatcttaggtcaaaatagggttcattcaataattcctgtaaacactggaccatgcaggcttaaaaggggcagttcctggctaagcaggaaagagctggtcccaacccaggggattgggagcagctattctcaaagtgggaaggctgataccatcacaccgtcctccccaaatacaaacacgcacacatacatcgcatgttttaaaaatcctgtgtgaaggttaaaaattctkcccttcatgcctaataatattcaacaaatatttcaccaaaatacatttatagagccctttggaaacagctacctctgaatttcctgcttggtttcctatagttcaagcaagggtactgcaggggtccagcccaagtgagacacagacaggaacgcccttgacagacatgagtggttgggaatgactatttatactgagtgggaagcactgcagtgggcacaaaagggaaaaccctcttgttctcaagagctcacaagatggtactgagatagcagataaggacttttagaacacagaaca

SEQ ID NO: 72693 - DNA, 601 bp, Human
ccaggctcagtggaacatgacaggagcctacagccaacctaggaagctggaaatgagtgtctatgtggggtgcattaaggatgttttgtgatgctttacatatggccctgggtgaacgtgctgaggagaaatgtaatttatatcacaatgtaagagaatggacagccaaccgtgtttttataataccaaaaggaaatatttttcagattgtatcagcacagttgtggtttctaacattcctgctactgcctcactcatttccatggaaatttgtgtccttccttggcaagatatcttaggycaaaatagggttcattcaataattcctgtaaacactggaccatgcaggcttaaaaggggcagttcctggctaagcaggaaagagctggtcccaacccaggggattgggagcagctattctcaaagtgggaaggctgataccatcacaccgtcctccccaaatacaaacacgcacacatacatcgcatgttttaaaaatcctgtgtgaaggttaaaaattctgcccttcatgcctaataatattcaacaaatatttcaccaaaatacatttatagagccctttggaaacagctacctctga

SEQ ID NO: 72694 - DNA, 601 bp, Human
ccccttagtttccttccagccaaaaagatatatgtcacgggaaatgattacaataatatgaataagtggaaaaaactaccaaattctgtagattatgtagtatagtccaaattttattaaaagaaaaaaaaattgctgtgaaactcagggatatccgggagctcagagaattctattaagcacactactgtgaaggaaaaaaaatgtgtattttcattttaacaaggctattttgacaaactactccaaaatatcctgctgggtttcccacaggccaagaacgctgcaggtccaggctcastggaacatgacaggagcctacagccaacctaggaagctggaaatgagtgtctatgtggggtgcattaaggatgttttgtgatgctttacatatggccctgggtgaacgtgctgaggagaaatgtaatttatatcacaatgtaagagaatggacagccaaccgtgtttttataataccaaaaggaaatatttttcagattgtatcagcacagttgtggtttctaacattcctgctactgcctcactcatttccatggaaatttgtgtccttccttggcaagatatcttaggtcaaaatagg

SEQ ID NO: 72695 - DNA, 601 bp, Human
tttctgttataaagcagccagatggaagcctaacaatagaacctaacaaaagtccagcaaagatccatccccaccagacattagaccccttagtttccttccagccaaaaagatatatgtcacgggaaatgattacaataatatgaataagtggaaaaaactaccaaattctgtagattatgtagtatagtccaaattttattaaaagaaaaaaaaattgctgtgaaactcagggatatccgggagctcagagaattctattaagcacactactgtgaaggaaaaaaaatgtgtattttcrttttaacaaggctattttgacaaactactccaaaatatcctgctgggtttcccacaggccaagaacgctgcaggtccaggctcagtggaacatgacaggagcctacagccaacctaggaagctggaaatgagtgtctatgtggggtgcattaaggatgttttgtgatgctttacatatggccctgggtgaacgtgctgaggagaaatgtaatttatatcacaatgtaagagaatggacagccaaccgtgtttttataataccaaaaggaaatatttttcagattgtatcagcacagttgt

SEQ ID NO: 72696 - DNA, 601 bp, Human
ctgaaccgaaactgcgaagttccttggccatcagctaaggaggtttgagtaggaagacaggggtctgggagcttgatggcacactacgtagccatcactgagccctaaactacctaccctctaattctttattgcttgagataaataagcaattatttggttctgccccccatcaggtttctgttataaagcagccagatggaagcctaacaatagaacctaacaaaagtccagcaaagatccatccccaccagacattagaccccttagtttccttccagccaaaaagatatatgtcacrggaaatgattacaataatatgaataagtggaaaaaactaccaaattctgtagattatgtagtatagtccaaattttattaaaagaaaaaaaaattgctgtgaaactcagggatatccgggagctcagagaattctattaagcacactactgtgaaggaaaaaaaatgtgtattttcattttaacaaggctattttgacaaactactccaaaatatcctgctgggtttcccacaggccaagaacgctgcaggtccaggctcagtggaacatgacaggagcctacagccaacctaggaagct

SEQ ID NO: 72697 - DNA, 601 bp, Human
gtcgctgtaagggctgagcgagataacatgtgaagaaactgaggcagcccgtatagttgacaaacgcaaggcatttgcctaaagctggaaaactgaacttcccaggctttcttgcagttagacatgcccatgtgactcagtcctgattaatgatacatgagcaggaatctgtccagctttcctcttctgtttactccttctttttgctgggatcctgaaccgaaactgcgaagttccttggccatcagctaaggaggtttgagtaggaagacaggggtctgggagcttgatggcacactaygtagccatcactgagccctaaactacctaccctctaattctttattgcttgagataaataagcaattatttggttctgccccccatcaggtttctgttataaagcagccagatggaagcctaacaatagaacctaacaaaagtccagcaaagatccatccccaccagacattagaccccttagtttccttccagccaaaaagatatatgtcacgggaaatgattacaataatatgaataagtggaaaaaactaccaaattctgtagattatgtagtatagtccaaattttattaaaagaa

SEQ ID NO: 72698 - DNA, 601 bp, Human
taggattccatatcctgtatagctacactctactttttctcccaaaaagctgcaaaagaaatttcttggccaggtgtagtggttcatgcctgcaatttcagcattttaggaggccaagatgggtggattagttgagcccagcattcctagaccagcctggtcaacataacaaaaccttgtctctacaaaaaaaaaaaaaaaaaatacaataaaaaaaatacaaagattagccgggtgtggtagcacacgcctataatcccagctacttgggaggcggaggtgggaggatcacttgagcccmgaaggtggaggcttgcagtgagccatgatcgtgccactgcatttttagtttatcaaacagagcaagaccctgtctcaaaataaaataaaataaaaataaatttaaaaaatgaaatttctccatttcttataaaggtattcttagaagtgaaaaaccttaaaacagtttcaaggtgactgagtgataagaatgaactaatccactagaatccatgtcttctaaggaaataaaccatagagtaaacactaatacctttgaaatcagacaggccaggtttcacatcccagcccttccacctac

SEQ ID NO: 72699 - DNA, 601 bp, Human
ggaaccatgttctagattcctataacaaagaagcaatgcaaggtttcccctttataaaactcaaaataatgtaaatgctcttatttctcctttcaacaggggataccggggagctcaaagccaaaaagagactagagtattgtatgggaaactatggtgttgtataggattccatatcctgtatagctacactctactttttctcccaaaaagctgcaaaagaaatttcttggccaggtgtagtggttcatgcctgcaatttcagcattttaggaggccaagatgggtggattagttgagyccagcattcctagaccagcctggtcaacataacaaaaccttgtctctacaaaaaaaaaaaaaaaaaatacaataaaaaaaatacaaagattagccgggtgtggtagcacacgcctataatcccagctacttgggaggcggaggtgggaggatcacttgagcccagaaggtggaggcttgcagtgagccatgatcgtgccactgcatttttagtttatcaaacagagcaagaccctgtctcaaaataaaataaaataaaaataaatttaaaaaatgaaatttctccatttcttataaaggt

SEQ ID NO: 72700 - DNA, 601 bp, Human
aaagttcccatcagctattcttctgagcaactccattgcactacctcacttctaatcgattgttttcctttccctatgaagataacagatatttggacatccagtgatgatccattttcctgctcttctcagttacacagcaatttgaagaacagtggatatcaattcattgttcagatcacaatcttaattcactagaagttaatgatttatttcaccttgctcttttactttactgtaattattatccaaatataatgaaacaaagactgtaacattctctgttactactttatgtttyccgaaatcccagcttcaacacctttatttcttttcactgtcctgtaaaattgatttcaccctttttttagtggtgttttagtttttgttttgcttcatgggttcctggcattacccaaatgccaaggcaatgctaaagtccgtaaacactttgagagaaaataacagtaataatattatcatatgtttttatggtgcattcattacaaagcacttttaaacccattatctcattttaactttgttactcataataatgatactgaaatataaagaccaggtattatttgtcccaatgtgc

SEQ ID NO: 72701 - DNA, 601 bp, Human
acttggtttatgacttaatttcaaaacataaccccaggctgcccttccaggtccctgcctcccagcccataccaagttccagtaactgtgcttcagccttgcttacaaaaacagtccctaattttggccccagtgctaggatgctcacctggttcacttgtgttcctgctgtgataaatgatcagttcccaaacctctagaagtcagaggctctggcttcttctgaccagtacccttggaagctgccagttgtcaaaacctccagcgtagagactgggaacttgaagtcaattgttttaamcggatctctgggtatagctccatccaccccattttcatctctgcattctgcatactagcagcacatcatgttactccttattatcttctggttattgccaacagtgttccacagtaagaactgcaatacccctttctggctactggctggacttccttttagcccccaaagctatgttcactccctatcctatccctagccaacccctttccccattgtgttgggcaagtcaagcttcagggtcggtctcttcaatctactcagaagttctgaacactgaagataacagggtagagctag

SEQ ID NO: 72702 - DNA, 601 bp, Human
cagacctcaaatgatctgcctgcctcagtctcctaaagtgctgggattacaggcatgagccaccgcgcctgtctgtgaaacttttttgaaagttcttgaattagtatagataacagatgataaaccttgacttaacccagtggcagtgaggtaagaaaagaggggattgattcaggaaatatttatgaaataaacttggatttggacagtgaaattcaaacataagaccctggtgtccagctcaagtgactgagtagacgatagtgtcattacctgagatcaggaatagaagaaaagaagyaggagaaagggacagaattgtgagcatgtaaaaggtaaggaacctatggaacattgaggacagtatccaataggtgcagaaccggatctatttttactcactattatttccccaggaactagcacagtccctaccacacagcagtagttgctcaataagtacttcatgaatgagtggtcgaacacttattttacttacatagaatcatgaaaatttcaggaaagcatagttgtgctggcagcagggcatatttatttaggtgacaagtccaatcaatgtgtaaggcaatcttctatgcat

SEQ ID NO: 72703 - DNA, 601 bp, Human
ttagccacttgctcatctgcatggcaagtagtgaagagtgagttaagagatgtcacacacaccagtttacattttataacaacaaaattggcagagggtggaggatgtcacagaaaggcaaattcataatagtgaacttttttttttttttttttttgagatggagtctcactcttgcccaggctggagtgcagtggtgtgattttggctcactgcaacctctgcctcctgggttcaagcaattctcctgccccagcctcctgaatagcagggattacaggtgcctgccactacgcccagmtaatttttgtatttttagtagagacagggtgtcatcatgttggccaggctggtctcaaactccagacctcaaatgatctgcctgcctcagtctcctaaagtgctgggattacaggcatgagccaccgcgcctgtctgtgaaacttttttgaaagttcttgaattagtatagataacagatgataaaccttgacttaacccagtggcagtgaggtaagaaaagaggggattgattcaggaaatatttatgaaataaacttggatttggacagtgaaattcaaacataagaccctggtgtcc

SEQ ID NO: 72704 - DNA, 601 bp, Human
cccagtgtagtttcaggttccctttcttagagggtagaatttccttatttttaataataaaacgcaacagcatatctactagctgctccttgtccttcatgagttttctctgtgaatgctgctccagctgacttagtctgccgtttagccacttgctcatctgcatggcaagtagtgaagagtgagttaagagatgtcacacacaccagtttacattttataacaacaaaattggcagagggtggaggatgtcacagaaaggcaaattcataatagtgaacttttttttttttttttttttgagatggagtctcactcttgcccaggctggagtgcagtggtgtgattttggctcactgcaacctctgcctcctgggttcaagcaattctcctgccccagcctcctgaatagcagggattacaggtgcctgccactacgcccagataatttttgtatttttagtagagacagggtgtcatcatgttggccaggctggtctcaaactccagacctcaaatgatctgcctgcctcagtctcctaaagtgctgggattacaggcatgagccaccgcgcctgtctgtgaaacttttttgaaagtt

SEQ ID NO: 72705 - DNA, 601 bp, Human
gaagtggaggggggaaagcactgattctcagttggggtgttcctaactgagcagtagggatagaaggtgtgagcctgggagtgcttttataaattatttttcttgtagattttatttttaatttatgtctgtgacctgccaggaagaggggagagagagagaaaaagagatgctgttgaacacatgacaaaataaaataaaatggaaaaaaaaaaggccaccgtttctggccatctatgtcattcaactgtatctgcaagacttgtacctgagtcacccatcatagctacattggctttcyattccctacaaacactaagttgataaaagaggccaaagccagggttctgccctatcttagtaagtatgttatatctcagtctctcaatcaccccaggggaatggttggtgcatccctaattacagaactacaaagcccagtgtagtttcaggttccctttcttagagggtagaatttccttatttttaataataaaacgcaacagcatatctactagctgctccttgtccttcatgagttttctctgtgaatgctgctccagctgacttagtctgccgtttagccacttgctcatctgca

SEQ ID NO: 72706 - DNA, 601 bp, Human
agcaggagtgaagtggaggggggaaagcactgattctcagttggggtgttcctaactgagcagtagggatagaaggtgtgagcctgggagtgcttttataaattatttttcttgtagattttatttttaatttatgtctgtgacctgccaggaagaggggagagagagagaaaaagagatgctgttgaacacatgacaaaataaaataaaatggaaaaaaaaaaggccaccgtttctggccatctatgtcattcaactgtatctgcaagacttgtacctgagtcacccatcatagctacaytggctttctattccctacaaacactaagttgataaaagaggccaaagccagggttctgccctatcttagtaagtatgttatatctcagtctctcaatcaccccaggggaatggttggtgcatccctaattacagaactacaaagcccagtgtagtttcaggttccctttcttagagggtagaatttccttatttttaataataaaacgcaacagcatatctactagctgctccttgtccttcatgagttttctctgtgaatgctgctccagctgacttagtctgccgtttagccacttgc

SEQ ID NO: 72707 - DNA, 601 bp, Human
ggaaaacacaaaacattacacaacccagcaacaacaaaaaaactagtcctcttagaatttcatgcactttgatttttttagggcttgtgccctgtttcacttgtagaatgcttgtattgagtaaaaaggagatgtcctaatattcaaagcagctaaacgtcctctttgccataaagacccatgtaactaactgtgtgaacactcgggatttttctcctctgtcccgaggttgtcgtctgctttcttttttgggtttctttctagaagatggagaagtgcaagtgacaggggctgagagcamcccccaaacacgcaagctctcagccatgggcagcttctccacagccccagcttagcacaagctcctggagggctgcctgggggaggcagtcatggaagtgccaaggtggccagatggttccaggaccacagtgtctttatttttaactgtttgccactgccacccccacccctgcccgactctggagtactgtcttccccagacaagcaggagtgaagtggaggggggaaagcactgattctcagttggggtgttcctaactgagcagtagggatagaaggtgtgagcctgggagtgctt

SEQ ID NO: 72708 - DNA, 601 bp, Human
aaactagctcttctgcaactataagctgatgcaataaatcccatttgtgttccccatccctcacccactgcctgagctcttctgtagctggggtgaggtgctggcagtgctccgggaactgggcctgcagccttcctattccagtactgctgtgagtcaggggaatgatatggagggaggatctagcgcagcagcctccaggcaggattcagcacaacactggggagtgatctttccctcaggcctctgcctaccaaggactgggcttgtcactgggaaaacacaaaacattacacaaccyagcaacaacaaaaaaactagtcctcttagaatttcatgcactttgatttttttagggcttgtgccctgtttcacttgtagaatgcttgtattgagtaaaaaggagatgtcctaatattcaaagcagctaaacgtcctctttgccataaagacccatgtaactaactgtgtgaacactcgggatttttctcctctgtcccgaggttgtcgtctgctttcttttttgggtttctttctagaagatggagaagtgcaagtgacaggggctgagagcaccccccaaacacgcaagctctcagcc

SEQ ID NO: 72709 - DNA, 601 bp, Human
gcccaaggccctctatcctgatcagtagcaaggcttggattcccactactctcagcaagccaaggaagaaactagctcttctgcaactataagctgatgcaataaatcccatttgtgttccccatccctcacccactgcctgagctcttctgtagctggggtgaggtgctggcagtgctccgggaactgggcctgcagccttcctattccagtactgctgtgagtcaggggaatgatatggagggaggatctagcgcagcagcctccaggcaggattcagcacaacactggggagtgatcwttccctcaggcctctgcctaccaaggactgggcttgtcactgggaaaacacaaaacattacacaacccagcaacaacaaaaaaactagtcctcttagaatttcatgcactttgatttttttagggcttgtgccctgtttcacttgtagaatgcttgtattgagtaaaaaggagatgtcctaatattcaaagcagctaaacgtcctctttgccataaagacccatgtaactaactgtgtgaacactcgggatttttctcctctgtcccgaggttgtcgtctgctttcttttttgggtttct

SEQ ID NO: 72710 - DNA, 601 bp, Human
taaaaagtaatgaggggctggggctgggcatggtggctcacgcctgtaatcccaacaatttgagaggccaagggcgggtgtatcacttgaggtcagaagttcaagaccagcctggccaacatggtgaaaccccatctctatgagaaatacaaaaattagccaggcatggtggtgcacacctatagtcccagctactcggaggctgaggcaggagaatcacttgagccccgggggcagaggttgcagtgagcagaggtcacaccactgcactccagcctggatgacagagtgagactccgtstcaaaaaaaaaagcaatgaggagctggaggaagcagatggatggcaattggtaagcttatattagctgacattctcagagagttcatatcgtgaagaccttgtgtgacactctaagggatttgaattttatcatacaggttgtaaccaggaaggatgaacctgctcaagattgatcccctgtcaacaggaaaaagatgtgggctcctgtagagctgcatggaaaccagatggggctcagtgcccaaggccctctatcctgatcagtagcaaggcttggattcccactactctcagcaagc

SEQ ID NO: 72711 - DNA, 601 bp, Human
gcatgtgagccagtaactgttattcaataacaatgttgacaattcagttattgaattgttatacaataattgttattcagttgtattaagagagatatatacaaatttgggggggagaaaatagatttttaatcaacactgccaggtggttgagacttgggagagggaactgggaaggtttgcagaaatgatgctttggctggatcttgaaaaataaacaagaattcatcagataaggataggaagggcattttgggcagaaggaacaacatgtacaaatgtgaagacaaaacgaaaaaaygaattgttctgggaaatgcaagtcacttagtaaaagtaaaaagtaatgaggggctggggctgggcatggtggctcacgcctgtaatcccaacaatttgagaggccaagggcgggtgtatcacttgaggtcagaagttcaagaccagcctggccaacatggtgaaaccccatctctatgagaaatacaaaaattagccaggcatggtggtgcacacctatagtcccagctactcggaggctgaggcaggagaatcacttgagccccgggggcagaggttgcagtgagcagaggtcacacca

SEQ ID NO: 72712 - DNA, 601 bp, Human
aagttaaatcctcggactggattgagaccccacctgcccgtttggcacactttcctctgattgatccccaccgttcacctatttttcatatacccacactttcctaattggctttctacactgtcgtgtccacctttgagtggcatctttgctttgacctttttgcacagtcacaaatcaatcaatacaagctacctattctgagcccataaaaagccccaggctcagccatattgagaactttactgcctttgggtagggggaccacccctgctaaaagctgtttcatcattcaatgaarctccccgccttgctcactcttcaaatttctgtgtgcctacttcttcctggtcatgagacaagaacccagacctagctgagctaacgagcaaaaaaatccctcatcattatgttgactgcttccaatgtgaggattttcccctccactctctattaatgaactccaagtctctttatatttataccaaaacataggctctaggtacaccaggatacacttggtgattgtatccaccaaaactaagcagctgaactcattcattcattcattcatcattccactaaaatttattgaatctct

SEQ ID NO: 72713 - DNA, 601 bp, Human
accctgtttgactatcttcacagttagccttaaaggcttcagtctgggacagttattctgaggtttcttaccgataatgacaggaggcagacaaatgcctagatagacacgggcaggtcctggcgaaaccccacctccaagctgcagacagtttaaagcctgaaagccaagctacaagttaaatcctcggactggattgagaccccacctgcccgtttggcacactttcctctgattgatccccaccgttcacctatttttcatatacccacactttcctaattggctttctacactgtcrtgtccacctttgagtggcatctttgctttgacctttttgcacagtcacaaatcaatcaatacaagctacctattctgagcccataaaaagccccaggctcagccatattgagaactttactgcctttgggtagggggaccacccctgctaaaagctgtttcatcattcaatgaaactccccgccttgctcactcttcaaatttctgtgtgcctacttcttcctggtcatgagacaagaacccagacctagctgagctaacgagcaaaaaaatccctcatcattatgttgactgcttccaa

SEQ ID NO: 72714 - DNA, 601 bp, Human
actgactgagctgacatctctgactgtgatttttacatcttcaaaaacagcagcaatttctccattatggtgtcctttaagattgatttcattgcaacatctgagacttgtattatctaatgacacaagagtaacatggtaacaaaagcgctcggggtcaccctgtttgactatcttcacagttagccttaaaggcttcagtctgggacagttattctgaggtttcttaccgataatgacaggaggcagacaaatgcctagatagacacgggcaggtcctggcgaaaccccacctccaagytgcagacagtttaaagcctgaaagccaagctacaagttaaatcctcggactggattgagaccccacctgcccgtttggcacactttcctctgattgatccccaccgttcacctatttttcatatacccacactttcctaattggctttctacactgtcgtgtccacctttgagtggcatctttgctttgacctttttgcacagtcacaaatcaatcaatacaagctacctattctgagcccataaaaagccccaggctcagccatattgagaactttactgcctttgggtagggggacca

SEQ ID NO: 72715 - DNA, 601 bp, Human
ctttcttgcccctatttgttcatgatgcaataaaaggtcaccaatgaaattacaaaatgccttaagtgaacgttttaagtgaatgactataatttactttataatttttgacctgctatggtcttactttcaaatattgcagagagcactttgctacttgttttacagggccatttccttgaaatgtaattacaagctgaaaaagcagtcctaggggattacttaatgtatgtcctttactaattccaaggacagtcaaaaagttttcaactcgaaggatgattgttcaaactgcccacaycaaccaaggtttagtgttcataatctggatgaaaccattttcttatttagagttcaaggggttaaaaaattattactgtctctggcaagaggttgtttgggaactatattgactggcttgtttcctaaacatattggctccacggcgctacaaagactgaaaagtattttcctccagcagctgggccaagataaattgaaaactaacagggagacagtatgtcaatttcaaagatactggtattataatagctgtggttttaaaatacaaatcccagtcattcgctttgtgggaaaattg

SEQ ID NO: 72716 - DNA, 601 bp, Human
tatgacattttattaccattatttttattcatatgataacactttgcctttttccccaaaggtttcctggcccttacttaatctatcttacatcttataaatccttaccactgaatgcttattttcctaagcccaaatctttatcttctaaatcctttcttgcccctatttgttcatgatgcaataaaaggtcaccaatgaaattacaaaatgccttaagtgaacgttttaagtgaatgactataatttactttataatttttgacctgctatggtcttactttcaaatattgcagagagmactttgctacttgttttacagggccatttccttgaaatgtaattacaagctgaaaaagcagtcctaggggattacttaatgtatgtcctttactaattccaaggacagtcaaaaagttttcaactcgaaggatgattgttcaaactgcccacaccaaccaaggtttagtgttcataatctggatgaaaccattttcttatttagagttcaaggggttaaaaaattattactgtctctggcaagaggttgtttgggaactatattgactggcttgtttcctaaacatattggctccacggc

SEQ ID NO: 72717 - DNA, 601 bp, Human
cagttattgaaagaattaaataaaatgataattataaaaagtgccaggtctggaacttagaaatcattcagtcaatatgacctattaatagctgtaaaatacgagagcgccaatcatcacattgctctggtggcttccctgctccaagtagtcattctgatgttctgtgtcctacatcagcctttcctgtctccttgttctctgcatccctccactgttcttagatctctcaaccatctgcaaaagtgaaaggaaatttctacatatcaagatccccatggtatgacataacctaaaacaygaaatttaaatttccttcaggtaccctctttttaaagacatgacataatctatgacattttattaccattatttttattcatatgataacactttgcctttttccccaaaggtttcctggcccttacttaatctatcttacatcttataaatccttaccactgaatgcttattttcctaagcccaaatctttatcttctaaatcctttcttgcccctatttgttcatgatgcaataaaaggtcaccaatgaaattacaaaatgccttaagtgaacgttttaagtgaatgactataattta

SEQ ID NO: 72718 - DNA, 601 bp, Human
tgaagctttggttgtttcatcagcagtggctttgatgaaccttttggctcacatatccattaactgactcagtaagaaaacatctgcattaaggatgttttcaaggctggaatgactttcttataagtgtactaaacagaatgccaagcccacaggaagcactggcaacagaaagttcagagttggccaatttaatcctcaatgcttctcaagcacaacttaattgaggaaaacttcacagacagatggaacgatagcatatataaactctatatgaatatacataacatatctaaatcaytcctcagtcatcttctaagtgcccaggtcatggagaataaaatggttatttacacaattacagcatcagaggattctgccacttccaatgtactttgtgatgggtactgaacctttcttagcctcagcttcctcatctataaaatggggtgaagggaaacgtaagaaattacctctacagttattgaaagaattaaataaaatgataattataaaaagtgccaggtctggaacttagaaatcattcagtcaatatgacctattaatagctgtaaaatacgagagcgccaatcatcacatt

SEQ ID NO: 72719 - DNA, 601 bp, Human
gaaattagcaactgagtaagtctccatccgtttccaaggaaaacaaaatgggaatctccttatacactattataggtatttcagacatatcaggagagagacttcattaggttgtaatcattttgtagcatattacctaatttgaaaggaaatgcaaggcagtttaaagggttaaatttgtagatgttagcttcaacaggcctcagtttgaatcttgacttggaatcacagcatggaaccagtgtctaactgggaaatcccaggcaggacacttttggctcagcctcaatttctacatgtmaaatggagacaataatatcagcatcatatgttgggattatcagataatgcatgcaaaacatttagcaaagagtctagcacatagttagtcttcaacaaactatagttgtagagtgtagccacaaaattgaatcaaattgagaaaatataaccaacctactctttggtaggttttctctaatacatttgagtttcattaatgtttcctacgcactttccttaaagtgtcacattttgcggaattgagtttatttatttaaattaacttactaattatttccaatttaaaattaaaatactg

SEQ ID NO: 72720 - DNA, 601 bp, Human
gagaaacgggagtatcagcccactgtattctcttcttttatatggacaataaagtttgcttaattgtatgtaaaacacctcacataaaaggagtcttgaagagacagaaccctcttttaacaagttcaccatcactaacccattccatatagaggtcctcctgctgttacttatctgatacatatagcctggagcagttgtacagttaattctttaagataaatccttaaatatggaattgttaggtttaaacaatttggaccacattacagaaattagcaactgagtaagtctccatccstttccaaggaaaacaaaatgggaatctccttatacactattataggtatttcagacatatcaggagagagacttcattaggttgtaatcattttgtagcatattacctaatttgaaaggaaatgcaaggcagtttaaagggttaaatttgtagatgttagcttcaacaggcctcagtttgaatcttgacttggaatcacagcatggaaccagtgtctaactgggaaatcccaggcaggacacttttggctcagcctcaatttctacatgtaaaatggagacaataatatcagcatcatat

SEQ ID NO: 72721 - DNA, 601 bp, Human
ggatcaggtgatcccatatgaatactattgtaatgtgtatgtttatttaacaagatattatggataccttcccttcatgattgtaatatcaacatggtatttaactgtagaggtgattcataatttaaccaatcccttaatgttgaatattttaggttattcccattttttcactatgataaacaatactgttataaacatctttgaattgtggcagagctaagaaggtagctgagaaacgggagtatcagcccactgtattctcttcttttatatggacaataaagtttgcttaattgtwtgtaaaacacctcacataaaaggagtcttgaagagacagaaccctcttttaacaagttcaccatcactaacccattccatatagaggtcctcctgctgttacttatctgatacatatagcctggagcagttgtacagttaattctttaagataaatccttaaatatggaattgttaggtttaaacaatttggaccacattacagaaattagcaactgagtaagtctccatccgtttccaaggaaaacaaaatgggaatctccttatacactattataggtatttcagacatatcaggaga

SEQ ID NO: 72722 - DNA, 601 bp, Human
ggcgggggaggcctcaggaaacaatcacggcagaaggggaagcaaacacatcctttctcacgtggcagcagcgagaagaagtgcagagcgaagttgaggggagggggggaagcccgttataaacccatcagatctcgtgagaactcactcactatcgtgagaactcactcactatcatgagaacagcatgagggtaaccacccccatgattaaattacattccacctggtccctcccttacatgtggggattatgggaactacaattcaagatgggagctgggtggggacacagccaaacyaaaaccatatcaccaaagcagcaggataagaagctgctcatgccctactcatgggcatgggagccaggactgccagatattctgattttttttcaagtgatactaaaaatccaggtattaatgtaaaagctcctcatttttaaaagttggcatatagttcaaatgatttttttttaaagtaaagccaaaatttgaaggccagatttatcttaactggtagccaatttgcatatcctactatagacccaggcagggccctggcagacttaataaataaatttattccaagagtaggcagtt

SEQ ID NO: 72723 - DNA, 601 bp, Human
taggtatacagatgttttcattaattaattgatttaatccagccccagactttctggagaaatgccaagaatctatctaagcaaatgcagcaaacctgttccctttttcagaccactgacagaaaggttaaggaaattgctaaatgatccacagacgagctttttagattattttaaagtctagcacaccagaggtgcaaaatgaaatgcctacacaattcaagcgggtaacataaacgagtggaaggaaggcaataggaagtgctagagactgtggcaaacaaagggcacatggccaaaygtattagtctgttttcacactactaataaagacatacctgagagtgggtaatttataaagaaagaggtttaactgactcacagttcagcatggcgggggaggcctcaggaaacaatcacggcagaaggggaagcaaacacatcctttctcacgtggcagcagcgagaagaagtgcagagcgaagttgaggggagggggggaagcccgttataaacccatcagatctcgtgagaactcactcactatcgtgagaactcactcactatcatgagaacagcatgagggtaaccacccccatga

SEQ ID NO: 72724 - DNA, 601 bp, Human
actaagcagacattctaggcccttagcactgggtaacacttgactagctactgttgtgtacacccatcttccacaacagcgaataagcccctcaagggtataaaccatgtctttgtaactcttagtgtctccagagcctaccacataggtatacagatgttttcattaattaattgatttaatccagccccagactttctggagaaatgccaagaatctatctaagcaaatgcagcaaacctgttccctttttcagaccactgacagaaaggttaaggaaattgctaaatgatccacagaygagctttttagattattttaaagtctagcacaccagaggtgcaaaatgaaatgcctacacaattcaagcgggtaacataaacgagtggaaggaaggcaataggaagtgctagagactgtggcaaacaaagggcacatggccaaatgtattagtctgttttcacactactaataaagacatacctgagagtgggtaatttataaagaaagaggtttaactgactcacagttcagcatggcgggggaggcctcaggaaacaatcacggcagaaggggaagcaaacacatcctttctcacgtg

SEQ ID NO: 72725 - DNA, 601 bp, Human
ggccttagttgtctcacttgtaacaactgtactgacttcttacagttgttgtgagaattaaatgacttatgtctggcacaaggtaaatgatcaataattgttatttttatctttaagagatcaacattttctcagcaacacagcctagaaatctcagagccatttttgctcacctctctcttaatatctacgtaacacctccctctgcagaggctcttctgttcttctcctctttccactctcactgtaactattgtttaaaatggtttaatgctgtaaattggcctctagttcttgcctrtcatcaatccttcactctcatatcctaattcttctaaaacaaaagctagtgcaaatcacttttctaataaaaaaaaaagtaccatgttttcccttgcccacagacaaaaacacttccgatcttcattgaagcacccacccaggacctctcaacaccctaaacttcctgttcattcttttctaccagctggttatctatgcatacacccaatattccctccacaccattttacgcacctgtgtttcctcagacacagcctgaatttcttgtctccctacctctgttaaagctgcttcaatg

SEQ ID NO: 72726 - DNA, 601 bp, Human
ctagatgtcttgaatgataattgtgtgacctctagaagcacatgagttaaccaccataaatcattcattgttgcagagtctgagctggtctgggaggcagggcaaaaagtaggaagtgcatggagaaaaagaaaatgtaaaccacttagtggatagagaattggatgcaacagtaattttcacaggaatgcacaacattttattaagagcacttctgattacaaattaagttacaagagcctttgtgagaggctgcctttgaggcatgtctacaattttaaaaatcagcatcatgcattgrtatgaaatcaaaatctaagaattaaaaagaagttctttaaaaccactaaagggcagaacaagagattgcgggcaggctgcaatgtccttacctccacgttataaaaaataactaaccttaaatatagatttcttgaatccttttcggattctttttgaatctaaaaacttcagaatccccgaagcaaccagctcaccaggaatcttatcaatagtggagttctgtcagaactgacctaaggcctgaacagatatgaggaggctctgaggctctggtatttatgagaattgagtgctagat

SEQ ID NO: 72727 - DNA, 601 bp, Human
atgaatcatctggattcagatttgtcaggcccttcaacccctcagtgcctcactggaaacaaggcatgataaaaaaccatttgttccatcttccaggactattacgagagttaaaataaggtgaggcatttaccattatcagtaacctctgaagtcccatataaatatattatattaattcattattatgtactaacaaaattgcattccttaggggaaagttagtattttgctagaccactgtagtatttagtctatatttgtgtgagatattttcaatttcaaagatttatatagttgytgttttttttttttttttttttgagacacagtttcactctgtcccccaggctggagtgcagtggtccaatcacggctcacagcagcttcaacctcctgggctcaagcaatcctcctgcctcagccaccagaacagctggggctacaggcatgtaccaccatgcctggctaatttttgttttttgtttgtagacacgaggtttcaccatgttacccaagctaatttatatatattttgaacaaatcaatattttttgtcattggtcctttgagggtgtatttgtttgttttgagacagagt

SEQ ID NO: 72728 - DNA, 601 bp, Human
acaaacagatcttggaagcagcaacatagtcctagttataaacattacctcctaacttccaaactgtggaactatggaattggaaggtaggctgtcaaacccctctgtattctgcttcctgtcctggaaggggtctaacctcacacaggctttcatgaaattctatgagtttgtggatgtcaagcatctaaccaagccactggcatggaagtccactcatcttccttccctttttcatttctttcctccttctagcagagtctccctggcttgttcaagccatgaaatgcctagatttcayggtttctgtagaacacggtaaaacagtaatttaacacactaccttaacaattagtaataatttttattaacagaaaacttagctattatatccatgcactagtaaataccaccccccaaagccctcaaacaaaagtccaggggttttttttaaaaaaagccattttgactttttattgacaagcaatttcatttcatttcaataaatatttcctgagtgcctgagtgcactctctgggcacttataatacgtcaatgaacaataacagcacaccaaagctttacagacaaaaaaacttaa

SEQ ID NO: 72729 - DNA, 601 bp, Human
atttaaatacttacattcaaagtagctgtttgtttattccacaagtatttacaaagtgcctactatgcgtcaggcactgccctgggtgacaaggacataagtaaaaatttctgttcccagaggttatattctagtgtggaaaacagatgataagtaaagataaatgagtaaaatgagcagtgggtcagatggtgacacgagctttggaaagaaagaaagcattgccatgaaaggattaggagatgctttcagagaggaactgcaattattattattattattttcttttgagacagtctcscttagtcacccaggctggagtacagtggcatgatctcggctcactgcaactcccacctccgggattcaagcgattctcctgactcagcctcttcagtagctaggattacaggtacacgttaccatgcccagctaattttttttttttttttttttttttagtagagatagggtttcaccatgttggctaggctaatctcaaactcctgacttcaggtgatcagcttacctcttcctcccaaagtgctgggattacaggagcgagccaccgcacctggccccaggaactgcaattttaata

SEQ ID NO: 72730 - DNA, 601 bp, Human; identical to SEQ ID NO: 26406

SEQ ID NO: 72731 - DNA, 601 bp, Human; identical to SEQ ID NO: 26407

SEQ ID NO: 72732 - DNA, 601 bp, Human; identical to SEQ ID NO: 26408

SEQ ID NO: 72733 - DNA, 601 bp, Human; identical to SEQ ID NO: 26409

SEQ ID NO: 72734 - DNA, 601 bp, Human; identical to SEQ ID NO: 26410

SEQ ID NO: 72735 - DNA, 601 bp, Human; identical to SEQ ID NO: 26411

SEQ ID NO: 72736 - DNA, 601 bp, Human; identical to SEQ ID NO: 26412

SEQ ID NO: 72737 - DNA, 601 bp, Human
caataaattgggactgaagccaacaaattgaaaagtagcagtaatgagtaaacagagtattgtgctgttctttgagcaaaacaattgatcttcttgttatttctatcatctctaaaggcaagaaacagaatcccagaggaagcataaaatattgtttggattcccataatcctgttttctttatttacaattcccttcatccttcctgcctgtccagatggttttcctcttgatttcccaaactgaattatgctcactgcctttgaaatgctaagtacttgagaagacttcatcttcgttygtcacaaacagaagtcataaactcttacctttgccgaattatgctgggattagctgtcactaactgacttttggatccaacatccttagtgtattcacttgacaaaggagggagattgcatctagagaaacaagaacaaacattttggaacaatttgcatagttttaaatcatcagttagaataatacaaatagaaatgttattaattctagctgaattcacgagtaactgttttgttttttgttttttttttttttttgagatggagtctcgctctgtcgcccaggctggagtacagtg

SEQ ID NO: 72738 - DNA, 601 bp, Human
ggtgtgcccagggagggcatggaagctccatgtcccttcccccatccctcatcctacacactccttcatctgaatcctttgtaacataataaaccagtaaacgtaaataagcgtttccttgagttctgtgagctgccctagcaaattaatcaaacccataaagagagttgggggaaccccaacttgaagccagtcagtcagaagctccggaggcctagacttgtgactggtgggggtggggggtagtcttgtgggactgagccctcaatctgtgggatctgacactatctgtagatagtgytggaattgagttggagataccccgctggtgtctgctgcagaattgattgcttgcttggtgtgtgggggaaaaacacaaacacacttggtggcagaagttttctatgttgattattctgggaaaactatattgtctccttgtgcgacacatggattttggaaaaagatcagagggtgtgatggtgcaatattatgaaatagatatttgagatcttcgatctcattccgtagcgtacaatgcctaaaatctttagaaactccacagtgctatctttttgcatgttaatgagttgattgaggc

SEQ ID NO: 72739 - DNA, 601 bp, Human
actcctaaaatctttagcaactcccagtgatacctttttgcatcttaaggagttgactgacggctggcagccctatgcagcttcagagtggggggctggtcactgcaaagaatcaaggcaggattctaggactgggacttcagccccactccctgacctctggggaggagaaaagggttacaggttaagttgatcaccagtggttaatggtttcatcaatcacgcctgctaatgaagcctccataaaaacctgaaaggacagggcttggagagcttccagataagaaggtggaggtttctkgggggtggtgtgcccagggagggcatggaagctccatgtcccttcccccatccctcatcctacacactccttcatctgaatcctttgtaacataataaaccagtaaacgtaaataagcgtttccttgagttctgtgagctgccctagcaaattaatcaaacccataaagagagttgggggaaccccaacttgaagccagtcagtcagaagctccggaggcctagacttgtgactggtgggggtggggggtagtcttgtgggactgagccctcaatctgtgggatctgacactatctgtag

SEQ ID NO: 72740 - DNA, 601 bp, Human
cctcggcctcccaaagtgctgagattacaggcgtgagccaccaggcccagcaacttcatttttaggtcttaaccacctgaaaataatttttggtataagttatgaggtagaggtttaatttatttttttcccatgtgtaatctaattatcccaacatcattttgaaaagtttatacttctttgctattctcggctcttcatatttatatcactcatataaatatgacatctgtcatatatactggtttatatctatgtggaaatatttgggagtagcctattctctttcactgctcagttsgtttatccttgcaccagagccacattgtcttaattataatagctttttaataagtcttaacatcttatagagcaactctgcccatcattttttcttcaagagcttctttgctattctcggcatatttctacataactttttaagtttaacacacacatacacatgcatgcatcattaggatttctattggaatttcaatgaatctgtagatagatttgggtagacctggtgcctttaaatactgagtctttcaatcatgcacatggtattatagtacatctaatcaggttgtctaaagtg

SEQ ID NO: 72741 - DNA, 601 bp, Human
tggtctcaactcctcagccagtccaccagcctcggcctcccaaagtgctgagattacaggcgtgagccaccaggcccagcaacttcatttttaggtcttaaccacctgaaaataatttttggtataagttatgaggtagaggtttaatttatttttttcccatgtgtaatctaattatcccaacatcattttgaaaagtttatacttctttgctattctcggctcttcatatttatatcactcatataaatatgacatctgtcatatatactggtttatatctatgtggaaatatttgggrgtagcctattctctttcactgctcagttggtttatccttgcaccagagccacattgtcttaattataatagctttttaataagtcttaacatcttatagagcaactctgcccatcattttttcttcaagagcttctttgctattctcggcatatttctacataactttttaagtttaacacacacatacacatgcatgcatcattaggatttctattggaatttcaatgaatctgtagatagatttgggtagacctggtgcctttaaatactgagtctttcaatcatgcacatggtatta

SEQ ID NO: 72742 - DNA, 601 bp, Human
gcacacgcctgtaatcccagctacttgggaggttgaagcaggagaatctcttgaaccgggaggcagaggttgcagtgagccaagatcgcaccactgtactccagtccgggcaacaagaatgaaattctgtctcaaaaaaaaaaaatgtttttatcaatccttatgttcaagacactgagatcctttttatatagaacttacactctagtatacgtctcgaactcaattatgtcaaaaaagcaaactgagaacctttaaaattaactataagttgtatagtcctccatcacttagcatactyttttcttatgtttttagtaaagtatatctattgaagagtgcatctaacatacatgtgcagcctaagcaatcattataaagtgtatatccatgttacaccagcctggccaagaaaaagaacacttctagcaatccagaggtcccattattccacacctgaaccaatactcttcctaccctgagaagtgactacttattgttccttatagttttacttgctacatctttgtccctagccatattgttagttggttttattttttattttaaataattattattattttactgtctcactcga

SEQ ID NO: 72743 - DNA, 601 bp, Human
tttttattggccgggtgcagtggctcacacctggaatgccagcactttgggaggatgaggcaggtggatcacctgaggtcaggagttcaagaccagccttgccaacatggtgaaaccccgtctctacaaaaaatacaaaatcacccgggtgtggtggcacacgcctgtaatcccagctacttgggaggttgaagcaggagaatctcttgaaccgggaggcagaggttgcagtgagccaagatcgcaccactgtactccagtccgggcaacaagaatgaaattctgtctcaaaaaaaaaaaatgtttttatcaatccttatgttcaagacactgagatcctttttatatagaacttacactctagtatacgtctcgaactcaattatgtcaaaaaagcaaactgagaacctttaaaattaactataagttgtatagtcctccatcacttagcatacttttttcttatgtttttagtaaagtatatctattgaagagtgcatctaacatacatgtgcagcctaagcaatcattataaagtgtatatccatgttacaccagcctggccaagaaaaagaacacttctagcaatccagaggtccca

SEQ ID NO: 72744 - DNA, 601 bp, Human
ttactgagaatttcttttagatagagtaataagtattgccttctctaactttctttttttcactataattatgagtgcctctcacatatgtatgcttaatttttctaaaacctgttttatcttgttactgatattttctaacagaattttacagtgaaaactcttaatgcttataacttctgatagaatatttttaggagaatcaaggttttggagacagctatgaaaattagcatttccactgcacatctctgcccaacaagtttaatttttcatcacatgaaagtacaagataactacygatgtcttggatttgcacagctttgagagaagactacgagatatgaataaaatatctaatataaataggataatcttctaatatagaaatacatactgcctttctcacttcaatattatttcctccattttactgtgccatgagagtatagcatcatctatattttaatccctatatacaagtgtttgcactttgtttaccaccctgtttgcatatactgctagccacatgaacaagatgctatgaatgcagtctcagctgtatttaaccaaaagtttccagcacttgctacctgtttga

SEQ ID NO: 72745 - DNA, 601 bp, Human
agaggatgaatgtgactgcaaagccctttctaatcttatgtctcaggcaccctaactaatctttttgttctgggtactgtcaagaagaatgcactccaaacaagatatcctaacaaaggctgtagcaaagctccttcttactgtagcaaagctccttcttactgagaatttcttttagatagagtaataagtattgccttctctaactttctttttttcactataattatgagtgcctctcacatatgtatgcttaatttttctaaaacctgttttatcttgttactgatattttctaacrgaattttacagtgaaaactcttaatgcttataacttctgatagaatatttttaggagaatcaaggttttggagacagctatgaaaattagcatttccactgcacatctctgcccaacaagtttaatttttcatcacatgaaagtacaagataactactgatgtcttggatttgcacagctttgagagaagactacgagatatgaataaaatatctaatataaataggataatcttctaatatagaaatacatactgcctttctcacttcaatattatttcctccattttactgtgccatg

SEQ ID NO: 72746 - DNA, 601 bp, Human
tctctgctcactgcaagcaatgtgggaatggactaatatagaaggattccctcaaatttataaaatcccttccatggacactacaaccatggacatgtctgcttctgtgagcaacttcagggtttgaggccatctcattcaactttgtaatgtcatgtcccagagtagatttcaagaaatatttgttggctctcattttattcctcctcccccccataaacttccagaccttcaaactccatatgtatatttttctcaaatatatttgctcaagaccaatctgacagtctaaagaactctsttttccaaattctatttccataatttttctttttctatttcataaaagaaagtcatgcctcctattatcccaaatattataatgattcattgccccaaaggataaaagccactaagccaccaaacaaagaaacatttccaaaatacataccttctgagggaatatcccctgaacaaaagcaaaaatgtatttagaagaaatagaaaggagctgtgtcttattttatccaggggacaaactcttgacagttccccatactgtatatgttgaataattaagcctgagaagtgggtttatatt

SEQ ID NO: 72747 - DNA, 601 bp, Human
tgggctcaagcaatcctctcacctcagcctcccgagtacctgggactaccagaacatgccaccatgcccagccaagtttttattattttctgtagagaacattttgtataatttcagaaggtaatatgttttgtatctgtgtccacacccaaatctcatattgaattgtaatccccaatgttggaggtggggcctaatgggaggtgattggattatggggacgatttctcatcaatggcttagtaccatccccttggtgctttccttgcaatagtaagtgacttatcatgagacctggctrtttaagtgtggcagctcactcgctgtctcttgctcctgctcctgctcgggccatgtgacatgcctgctccccctttgccttctgccatgattgtgagtatacagaggcctccccagttgctgggcagatgccaacatcatgcttcctgtaaagtctgcggaaccaggagccaattaaacctcttttctttaagaattacccagactccggtatttttttttttttttttttttgagatggagtctcactctgtcacccaggctggagtgcagtggcgcgatctctgctcactgcaagcaa

SEQ ID NO: 72748 - DNA, 601 bp, Human
aatttctctaaatctgatgagtacaataatgtattaaataatatgttttatccaagaacaaaatgtattgcaactggagagtcctcttgagtagctaatttggatatcagtcagaatagcttctactagatgcagttacattatctcatttatatctctcaacagtccccaaggtaaataatatttatactcaattgacatatggtacattaagtaactaaggttacatagctagtaggcagaaacacttactagcactagcactataatttgaaaacaaatccgttctaatcaaaacttrtgttcttcactgctatataatattgcctctcagataccaactccatgtatccatatttttaggggcttttcttttctatctcctacttgctatctctagtttcagttttattatctgccttctaattcccttatttcagaacagatgttagaataaatagctatcaatgactttgaagccttgatacaaacaatgataagctgctctgagtttggaggaaaaaaaaaaagaagtcagacagcaaaagagatatggaagttttaggaacacagtttgaaacatgcatgtatagtttgtgta

SEQ ID NO: 72749 - DNA, 601 bp, Human
tataagcttcttattatctttagctctgtttcactaaaattgtctgtttgcatttttaaaaattttaattgatctgcttgatactttgtgttttggatcacattactttttacttatggatcacattaatcatgaattctgaaaaagagttcttatccctattttatacttccacaattccactttaacatactccttctcattctatcgtccatgtttctttgtcttgcctttgtattttccatagcctcattatctggaaaattatttgctctgtattccagttcacaaattctctctycagttatgtctaatttgatgtctttccatttcaacaattatatttttcatttctaaaagttcaatttaggtctttttcaagtctacctatttaatttggatattctcttattggcttctcattctttttattttctataaagattacatatttagtaatctactgcatctgacaattccaataagttctcaggcattaaattcatctggtactttttgtttgatttttgtctctgagaatttacactattgatggcttgtgtgcattttgagtgtttgcttatgagctatcatttgtttg

SEQ ID NO: 72750 - DNA, 601 bp, Human
aaatttggagttcaagttaatctcacttaaatctggaagggcaggaacccacacacaaaatcagggctttattcatattgtttgcccctccaactcacagggctgtggtattgtcaaaataagttaacattaggaaaaattataaaataacaaggcctttttttaaagagatggggcctcactctgtcatccaggctggagtacagtggcatgatcacagctcactgcagccttgaactcctaggctcaagtaatcctcctgtgtcagcttcctaagcaactagcactatagacgccatgyctggctaattttttattttttatatttgtagtgataaggtctcactatatggcccaggctggtctcaaacccctggcctcaagcagtcctcccacctcagcctcctacctcccaaagagctgggattgcaggtgtgagccactgtgcccagccaaggtctgctttttaaataatttttttccccattataaaattttgcaactttggaaaatgttgattttttttccttagagattttctctgaacataactatatatataattttatatatttacacatttatatatttatttttttca

SEQ ID NO: 72751 - DNA, 601 bp, Human
gctctcaggacaaggttaccggaaagatgtggagaacgttctgactctgaattaagtacataaaatttggagttcaagttaatctcacttaaatctggaagggcaggaacccacacacaaaatcagggctttattcatattgtttgcccctccaactcacagggctgtggtattgtcaaaataagttaacattaggaaaaattataaaataacaaggcctttttttaaagagatggggcctcactctgtcatccaggctggagtacagtggcatgatcacagctcactgcagccttgaackcctaggctcaagtaatcctcctgtgtcagcttcctaagcaactagcactatagacgccatgtctggctaattttttattttttatatttgtagtgataaggtctcactatatggcccaggctggtctcaaacccctggcctcaagcagtcctcccacctcagcctcctacctcccaaagagctgggattgcaggtgtgagccactgtgcccagccaaggtctgctttttaaataatttttttccccattataaaattttgcaactttggaaaatgttgattttttttccttagagatttt

SEQ ID NO: 72752 - DNA, 601 bp, Human
aattagccagtttcacactttacacttaaagtttgccttccacagttaagctggggcacaaatgccttggctgtaatgaaatagctttgtaagtcaaaaggttgtctgtacgttccaaaaggggtatgcagtcaactgctaaagtggcgtttcccaggatttgcatctgaacatccctaggagggttatattctccaggtcctctctgtcccctcagtgccattacccaggagaacaaaccatgttgatcccaaatgaatgaagcacattcccttcaccacacacacacacacacacacaagtgcacatacacacgctaatgtcacatacaaaactgacaaaaatgcatggctacattagaaatctgaagagtcatagaacttaagagagaattaaggggaaataatttcaggacacgcactctctgaaaaacaacttacaattgattttagacatttcagtttgtttctagccaacatgcctaagtttcccaaagatttctctcctgctcctttaccacgtctcccttctctagaccttctttcttcctcaacccctctcttttgcttatcccaacaattccacactcacctattactca

SEQ ID NO: 72753 - DNA, 601 bp, Human
acaagaaaatataaaattgcttccattatttctctgaagtaatttgcttacaaatcaaatttacatcccaggctttgtttccatctttatacacaatagatattcaatctttttggagatattttaaatgccaatcaaactcaacatgtgcagtacaacaatgtgcataatttaattaggaggacagcataggagcagctatgagcaaggtgacaactatgtactcccagtgccaactatgcctcagcttccaactggacaacagaggctgtaagaagcagctgtttcacagatgttaaartattaaaaactgtgcagctcacaatcaataaaatatggtaatttaaccatgtgggtagcacttcctttttctgcctttcccttcatttgtatttgcaataatatttatcaaatatgatatctgtcccactaatttatattctgaccttgtcaacaatttgcattgtgattctgattctcctttgtctcattagtgtgtgtatgtgcacgtgtgtgagcgcatgtattgtgtgtgtgcgcagggtgtgtgtgtccaaagagattcagatatgaaagctacagtggaaacttcggttaaaaa

SEQ ID NO: 72754 - DNA, 601 bp, Human
tgtgttgactaagtttaaagtgctgagaaatgctgccacttgaatttagctactgctatggaaaagaatggttgctagggttattctcataggaaccacaaggagacaggagacccacaggacaccagcaggaaggaacaaatctctttcccctttcagcctcccatagtgtccctctagtgcccccagtcagaaactagctggcaagggggaaacgtgatttgtaaaatcatggtttcagcaacacaaaccagggtatatgaaagtggttttgcagctgagaggcaataagttactaaayagcacagtggtgaggctggaagcataaaaacttattgggagatgactgcaattattcgggagacacatggaccaaggtcatgacagtggaggaggtgaataatggtcataaaatacgaaagtagagccaccgtaatttagcagtggatttaataaaataagccaagggggactccaattcaaggtttttgagctgagcaaatgaaaaatggagtttccatttctttgagatggggaaaatgacagaatacacaggtttgcagaaaagggggaattaggagttctgtactggttattttaa

SEQ ID NO: 72755 - DNA, 601 bp, Human
agctgtctgaagcacagaagagattcaaggcctgggacaggtctgaactagtggtagttcaacacttgggaacaccaacattaaggtagcagatgaaaggaaaaccaacaaaggaagataacaagaaacagtaaagagagctgtgttgggacatagggtggaaagaatatcaagaatgcagaaacatgtgttaagtgcagcagagatcaagtaatgtaagtaccggtaaccactagtttcattcgtccaggactttaaatctctgtttcaaaatatttatttaacaattgttcaaacaaayagtgtcaagctcttacaaaataatgctcttacacaaaaatcagaaaacctttccatctaaaggttatgaaatctttgccttctggggttttagtgatatcaggcacatgttatgatctagcatatatttgaggaatgaaatctctttttttcacagaatttgttgccatgagatgtaaaccatgaaaaaggcaaccttctaagagcctctagtcttagagcacagctatagactctgaatcctgccctctctggggctctgtaatacaaaagagtagagtctgtttcccattagttctcc

SEQ ID NO: 72756 - DNA, 601 bp, Human
gttcatggataatgtaaaagtgatattaacagtgtttgtagattaatagatagggatgatgacaatgaggatgtacaagaatgacttcaatggctgagcatggtggctcatgcctgtaatcccaaaactttgggaggctgaggtgggaggatcactccaggccagggatttgagaccagcctgggcaacatagggagaacttgtctctacaaaaatcaaaaaattcactgggcatggtggcatgcacctgtagtcccagctacttgagaggccaaagtgggaggattgcttgagcccaggyggtcgagtctgcagtcagctgtgatggcaccactgcactccagcctgagtaacagagcaagaccgggtttcaaaaaaaaaaaaaaaaaaaaagaataacttcaaggttatccaccatgatggcttgaaagatggtgccaataactgtgatgataactacaggatcaaggatggtttgatgggagaaaaattattcactttaaggacatatgaaacatgaggtacctggggatttctaagtggagttggccagtagacacatagctgtctgaagcacagaagagattcaaggcctgggaca

SEQ ID NO: 72757 - DNA, 601 bp, Human
gctgagatcgcaccactgcactccagcctgggtgacagagcaagactccatctccaaaaaaaaaaaaaaaaaaaagtaatggggagccagtgaagaatattgactctggattttaaagacaaatctatactgtaaaaaaacaggggaggggtgttgaaggaagatcttaggacactattttcagcaagggattagaacagcctgaacaaagacaatggcagtggaaatactgagacagcaacagagttcatggataatgtaaaagtgatattaacagtgtttgtagattaatagatagggwtgatgacaatgaggatgtacaagaatgacttcaatggctgagcatggtggctcatgcctgtaatcccaaaactttgggaggctgaggtgggaggatcactccaggccagggatttgagaccagcctgggcaacatagggagaacttgtctctacaaaaatcaaaaaattcactgggcatggtggcatgcacctgtagtcccagctacttgagaggccaaagtgggaggattgcttgagcccaggcggtcgagtctgcagtcagctgtgatggcaccactgcactccagcctgagtaacag

SEQ ID NO: 72758 - DNA, 601 bp, Human
agccaccacacctgacctttcctctgagtctttaagtcacattttctgtgttacaaaatgttttgaggccaggcgcggtggctcacacctgtaatcccagcactattggaaggctgaggcaggcagatcacgaggtcagcagttcgagaccagcctggccaactcggtgaaaccccatctctactaaaaatacaaaaatcagccaggcatggtggtgggcgcctgtaatcccagctactcgggaggctgaggcaggagaattgctgaacccggagatggaggttgcagttagccgagatcrtgccattgcactccagcctgggcgacagagcaagactccatctcaaaaaacaaaacaaaacaaaaacacacaaaaaaaatgttttgaggtgttctataccaaattttttttctattatttctcttaaatagtagaaaaacaaacataaagcaagaaacttattccagaaccatatttgtttcaaaaaggtatatatggtatccttttatcttcaggcactaatcatttgagtatttgtgcattttctttcttagacctagacttacaaagaatgccacagtgccaagtcctgagcctggt

SEQ ID NO: 72759 - DNA, 601 bp, Human
gggaaaagtttgaagctaccttgactcttactccattgtaggtaaatcacatttttctgattggatgcttgtagagtttttctctttatctttgaagtgtaaaaattcatcacaatatgtctaaatgtgggtctttttgcattaattttacctggaatgtaactaagtacttctgcctgtggacccagtcctgtttcagctctggaaagccttatggctgttaaaacttttttttttttccttattgggtctgatgattactttttttaattctttattgattcttcttcagcaaacttggcatctttaggatgaatctcctttccctttccttcatcttttttttctcattatattcatctctctgagtttttttcctcgacattcttaaaatggaaatattaaggggtttactttctgcactgtaactctgctctttgcaacatccaacatgaactttattgctttctttgcaattctgcctgctctcagccatctctcttttcatctcaactttcagctcatcctttgttctcctaaccactctgtgcacctaatgggtcaattcttattaagtcaccaagctaaggctttgaaattt

SEQ ID NO: 72760 - DNA, 601 bp, Human
tttttaaagaatcattcacatcttggtacttaccatgacatctgtcctgaaatttagtgatagggaaaagtttgaagctaccttgactcttactccattgtaggtaaatcacatttttctgattggatgcttgtagagtttttctctttatctttgaagtgtaaaaattcatcacaatatgtctaaatgtgggtctttttgcattaattttacctggaatgtaactaagtacttctgcctgtggacccagtcctgtttcagctctggaaagccttatggctgttaaaacttttttttttttccttattgggtctgatgattactttttttaattctttattgattcttcttcagcaaacttgtcatctttaggatgaatctcctttccctttccttcatcttttttttctcattatattcatctctctgagtttttttcctcgacattcttaaaatggaaatattaaggggtttactttctgcactgtaactctgctctttgcaacatccaacatgaactttattgctttctttgcaattctgcctgctctcagccatctctcttttcatctcaactttcagctcatcctttgttctccta

SEQ ID NO: 72761 - DNA, 601 bp, Human
tatatatatgacaacttggctagactttttaaagaatcattcacatcttggtacttaccatgacatctgtcctgaaatttagtgatagggaaaagtttgaagctaccttgactcttactccattgtaggtaaatcacatttttctgattggatgcttgtagagtttttctctttatctttgaagtgtaaaaattcatcacaatatgtctaaatgtgggtctttttgcattaattttacctggaatgtaactaagtacttctgcctgtggacccagtcctgtttcagctctggaaagccttwtggctgttaaaacttttttttttttccttattgggtctgatgattactttttttaattctttattgattcttcttcagcaaacttgtcatctttaggatgaatctcctttccctttccttcatcttttttttctcattatattcatctctctgagtttttttcctcgacattcttaaaatggaaatattaaggggtttactttctgcactgtaactctgctctttgcaacatccaacatgaactttattgctttctttgcaattctgcctgctctcagccatctctcttttcatctcaac

SEQ ID NO: 72762 - DNA, 601 bp, Human
tatgtatatagtacatattttatactcaaaaaattcaagaagaatattcgagaaataacctttctcagccctcgtattatatatatgacaacttggctagactttttaaagaatcattcacatcttggtacttaccatgacatctgtcctgaaatttagtgatagggaaaagtttgaagctaccttgactcttactccattgtaggtaaatcacatttttctgattggatgcttgtagagtttttctctttatctttgaagtgtaaaaattcatcacaatatgtctaaatgtgggtctttktgcattaattttacctggaatgtaactaagtacttctgcctgtggacccagtcctgtttcagctctggaaagccttatggctgttaaaacttttttttttttccttattgggtctgatgattactttttttaattctttattgattcttcttcagcaaacttgtcatctttaggatgaatctcctttccctttccttcatcttttttttctcattatattcatctctctgagtttttttcctcgacattcttaaaatggaaatattaaggggtttactttctgcactgtaactctgctct

SEQ ID NO: 72763 - DNA, 601 bp, Human
gatctttgtagatataatagttaagttaaaatgaggccacagcacattagggtgagccctgatccaatgactggcagccttataaaaagaaaaaacagtgacatagatcatacataggaagaatgctgtgtgaggacagaggcagagatggagtgctgagtctatcagccaggaaagctacagattgttagacagcaccagaagctaggacgatgtaaggaaggaccctcctctagagccctggaaacttcacagagagcctgaccttgctgacaccttgatttcaaaattctagcctccraaattctgagaaaacaaatttctgttgtttttgtggtttgtggtaatttgtggtagcagccctaagaaactaataaaatgattatacagttaattttgatatatggcctctgatgaagatttaagttattttgtgctcaaagagtgaactaataggtccagatcctaattattaggatctggatcctactagtagctggatcctagtaggcatgtgaggaccaattgctcacatttctcctattaaagtaaattaaaatggagaccagggctgaggaattcctgagcagacaaagccagt

SEQ ID NO: 72764 - DNA, 601 bp, Human
atgtgactttatttagaaacaggatctttgtagatataatagttaagttaaaatgaggccacagcacattagggtgagccctgatccaatgactggcagccttataaaaagaaaaaacagtgacatagatcatacataggaagaatgctgtgtgaggacagaggcagagatggagtgctgagtctatcagccaggaaagctacagattgttagacagcaccagaagctaggacgatgtaaggaaggaccctcctctagagccctggaaacttcacagagagcctgaccttgctgacacctygatttcaaaattctagcctccaaaattctgagaaaacaaatttctgttgtttttgtggtttgtggtaatttgtggtagcagccctaagaaactaataaaatgattatacagttaattttgatatatggcctctgatgaagatttaagttattttgtgctcaaagagtgaactaataggtccagatcctaattattaggatctggatcctactagtagctggatcctagtaggcatgtgaggaccaattgctcacatttctcctattaaagtaaattaaaatggagaccagggctgaggaa

SEQ ID NO: 72765 - DNA, 601 bp, Human
gctgggattataagcatgagccactgcgcctggcctatttatactttatcttggtatctctgatgcaattttttcccaaataattgtcggtttttagattttatgtttttgacaagaacacattttaaatttttggagtcaaatgtataaatcatttttctttgatttctgccagcagaaagtactctatcctcaagacaaataagtattcacactaatgcttttaatttttgtagtctgtttcttacatttaatgtgtgaatctttctcttgggtcaaatccttgtactgatccccagaragttcacacccactcagaacttcagaatgtgactttatttagaaacaggatctttgtagatataatagttaagttaaaatgaggccacagcacattagggtgagccctgatccaatgactggcagccttataaaaagaaaaaacagtgacatagatcatacataggaagaatgctgtgtgaggacagaggcagagatggagtgctgagtctatcagccaggaaagctacagattgttagacagcaccagaagctaggacgatgtaaggaaggaccctcctctagagccctggaaacttca

SEQ ID NO: 72766 - DNA, 601 bp, Human
ctttatttttctactttggttgttaaaaatagataatttgcttccagctctaatgtgagtatatttattaatatgactgaatacttattttacaagccaactgtatttactcctttgtgacttttctacctctacatccaattatctcctgagactacaatatttttcatacctgtttacatatcatctttataaatatataaaaatatatttatactttttttttttttacatggagtcttactctgcgcccaggctggagtgcaatggcacaatctctggtcactgcaacttcctcctyttgggttcaagcgattatcctgcctcagcctcctgagtagctgggattacagatgcacaccaccaggcctggctcatttttgtattttttagtagagacagggttttgcccaccttggcctctcaaagtgctgggattataagcatgagccactgcgcctggcctatttatactttatcttggtatctctgatgcaattttttcccaaataattgtcggtttttagattttatgtttttgacaagaacacattttaaatttttggagtcaaatgtataaatcatttttctttgatttctg

SEQ ID NO: 72767 - DNA, 601 bp, Human
atactcccactagcagtgcatgagaatatacagcagcattgttatcatttctctttatttttctactttggttgttaaaaatagataatttgcttccagctctaatgtgagtatatttattaatatgactgaatacttattttacaagccaactgtatttactcctttgtgacttttctacctctacatccaattatctcctgagactacaatatttttcatacctgtttacatatcatctttataaatatataaaaatatatttatactttttttttttttacatggagtcttactctgygcccaggctggagtgcaatggcacaatctctggtcactgcaacttcctcctcttgggttcaagcgattatcctgcctcagcctcctgagtagctgggattacagatgcacaccaccaggcctggctcatttttgtattttttagtagagacagggttttgcccaccttggcctctcaaagtgctgggattataagcatgagccactgcgcctggcctatttatactttatcttggtatctctgatgcaattttttcccaaataattgtcggtttttagattttatgtttttgacaagaac

SEQ ID NO: 72768 - DNA, 601 bp, Human
tttcaagccagattctgattcaagcagcatgagtctggagtgagcagctgaagttgtggcttctcaacgtggcagggattctgattctgactgattctgcagtctattgattgctggagacgttctgtcatttggcttttggagctgttttccatttccttaatcaagaatctatttcttcaccctctcgacagctgtaaaatccctttaaataaacccatttatgcttaggctagttagaatgaattatattccctgcaatatccttaacaatagaatgtttctaattgtgcaaaataayacttaattctgttatatcttcttttgctttctacatctttatcctttatacattgctagattattactttctgacttttttagaagtgttattatgaattcaaaaggtaggaacattttcaagattcttgatacatgtcaattcttttgttttcctaaaagaaaggttgtactaatttatactcccactagcagtgcatgagaatatacagcagcattgttatcatttctctttatttttctactttggttgttaaaaatagataatttgcttccagctctaatgtgagtatatttatta

SEQ ID NO: 72769 - DNA, 601 bp, Human
agacagatggagaagaaagggaaaaaagagaacagaagaatgggaagcaaaaggacaagaggaagaggaggtaaataaagaggtattaccaaaaacaacagcaaagataaaataggcaatcaaaaacttgtatgattaaagaggttgagatgcaaaaagagaaaaagaacaaaaatcattttccttcctatcactcatcccattatttatctgccacaatgaataaagacgaagagagaaatagcaaagtgtagaaaataacaaagaagaggaggtgagaagaaatgtctcacttgctctyttcaatttcaaagactaaattatacactcatttcatttcacctccaattctttaaatcatgtgctgcaaacagccccaaacaaaccacagtagactgcaaaacagttgattcagaggctaagtaaaagcagagcctaagagttaattatattacagttgttgaaaacagaacatctattttcatttcacgttgtgattcaagtgttagtggattagcttttaaaataaaccttttccttgcttatacctatattagatgtagggcaaatagtaatttcttccatttctaagtgtcctcag

SEQ ID NO: 72770 - DNA, 601 bp, Human
caccagcaataccactaccctaactttccaatttacatcatcacctggaaagaaaaaaaatgatgagtggagacagatggagaagaaagggaaaaaagagaacagaagaatgggaagcaaaaggacaagaggaagaggaggtaaataaagaggtattaccaaaaacaacagcaaagataaaataggcaatcaaaaacttgtatgattaaagaggttgagatgcaaaaagagaaaaagaacaaaaatcattttccttcctatcactcatcccattatttatctgccacaatgaataaagacraagagagaaatagcaaagtgtagaaaataacaaagaagaggaggtgagaagaaatgtctcacttgctctcttcaatttcaaagactaaattatacactcatttcatttcacctccaattctttaaatcatgtgctgcaaacagccccaaacaaaccacagtagactgcaaaacagttgattcagaggctaagtaaaagcagagcctaagagttaattatattacagttgttgaaaacagaacatctattttcatttcacgttgtgattcaagtgttagtggattagcttttaaaataaac

SEQ ID NO: 72771 - DNA, 601 bp, Human
ccttctctgctgtcccagtaatccgtgcctgccttttctctgccttcagccctttttgctccatcagtacttttagtgcttttctacatattggcagtgtggaaatgtcatgattcccaaaatatcacatgcaggctatggagaactggaggtagcatctcaagtccatccctgggcattcccttcagccatttttcattctctcctagcaccaagatggctccctcctaggccaccagtctccttggagaagcatgcagttatttcagacacctaccttgcccaccagcaataccactaycctaactttccaatttacatcatcacctggaaagaaaaaaaatgatgagtggagacagatggagaagaaagggaaaaaagagaacagaagaatgggaagcaaaaggacaagaggaagaggaggtaaataaagaggtattaccaaaaacaacagcaaagataaaataggcaatcaaaaacttgtatgattaaagaggttgagatgcaaaaagagaaaaagaacaaaaatcattttccttcctatcactcatcccattatttatctgccacaatgaataaagacgaagagagaaatagcaaa

SEQ ID NO: 72772 - DNA, 601 bp, Human
aaaacccttaaatttgccaattaaaagcaattaagtgtctttcaaagtaaaaacagtgttgggggcaaatatttcattcatttaaaacgcaaaactccttcagagctaatttttccctcccaggatcctcacggaaatagtagatccttatgctgtctccaatgtggtgaagttgatctgagcttgtccttgggacctggcactggtggtgtctgcatggctggtatgtctggtttttctggacaccaagctgacaaccagaactcaagtctctaaccttctctgctgtcccagtaatccrtgcctgccttttctctgccttcagccctttttgctccatcagtacttttagtgcttttctacatattggcagtgtggaaatgtcatgattcccaaaatatcacatgcaggctatggagaactggaggtagcatctcaagtccatccctgggcattcccttcagccatttttcattctctcctagcaccaagatggctccctcctaggccaccagtctccttggagaagcatgcagttatttcagacacctaccttgcccaccagcaataccactaccctaactttccaatttacatcatc

SEQ ID NO: 72773 - DNA, 601 bp, Human
ttttgtctttcatatacacacccctaatagcagaattgaaaatttatacacaactcacatgtgcaaaagtctaacttttttccccctgcaattgccttcatcttactctgatgttcccatcctcactgacggcggaagaaaaacccttaaatttgccaattaaaagcaattaagtgtctttcaaagtaaaaacagtgttgggggcaaatatttcattcatttaaaacgcaaaactccttcagagctaatttttccctcccaggatcctcacggaaatagtagatccttatgctgtctccartgtggtgaagttgatctgagcttgtccttgggacctggcactggtggtgtctgcatggctggtatgtctggtttttctggacaccaagctgacaaccagaactcaagtctctaaccttctctgctgtcccagtaatccgtgcctgccttttctctgccttcagccctttttgctccatcagtacttttagtgcttttctacatattggcagtgtggaaatgtcatgattcccaaaatatcacatgcaggctatggagaactggaggtagcatctcaagtccatccctgggcattcccttc

SEQ ID NO: 72774 - DNA, 601 bp, Human
acctaacaattctaccattcagagttgacctcaattaacatacggatttttgtctttcatatacacacccctaatagcagaattgaaaatttatacacaactcacatgtgcaaaagtctaacttttttccccctgcaattgccttcatcttactctgatgttcccatcctcactgacggcggaagaaaaacccttaaatttgccaattaaaagcaattaagtgtctttcaaagtaaaaacagtgttgggggcaaatatttcattcatttaaaacgcaaaactccttcagagctaatttttycctcccaggatcctcacggaaatagtagatccttatgctgtctccaatgtggtgaagttgatctgagcttgtccttgggacctggcactggtggtgtctgcatggctggtatgtctggtttttctggacaccaagctgacaaccagaactcaagtctctaaccttctctgctgtcccagtaatccgtgcctgccttttctctgccttcagccctttttgctccatcagtacttttagtgcttttctacatattggcagtgtggaaatgtcatgattcccaaaatatcacatgcaggctat

SEQ ID NO: 72775 - DNA, 601 bp, Human
taagctggttacttcattgctttatgcctcaattttctcatttgaaaaaaataataatagcgtgtatttcatagggctgttgtgaggactagatgagttcatatgtataacacacttagaatagtgcctggcacataataagtcttacaactactagctttcatcatcatcatcaccacatcatcattatcatcatcatcattactctcctctttgcaaaagcaagtgatgaaaatttgaatcttaaaagaacccttccaaagaaataagcattatctccaaggacacaagttataaattmataggaaaccacttcctagccttggtatgtctgtgcatttgtttatataggcattatcagaataatgagatgaatgtaaataactgttcatttctcatgtctcattgttttgtgaaataaaatttaaacatgtgactgacattccaaactgtcagtgaacacttagaaataacaagaaataggcccggtgattcatgcctgtaatcccaggactttgggagtctgaggggggcagatcacttgaggccaggagttcgagaccagcctggccaacatggcaaaaccccatctctacaaaaa

SEQ ID NO: 72776 - DNA, 601 bp, Human
ccttttctgtaacttctacatccagttggtcactaagttccattttcatagcatctcttaagtttacctttccatctatctattacagtgttacaggctgagccacataaagtggccattatgcaggtcaaacacagttgtttcctctgccagcaacaacagaatcctttcagcaacaacaggatctactcaaggactctatagccctaagggaatggtggaaccagagatggaataatttggggtccataaatgacagtgcagaatagaaccattccccttttctgtgcaccctcaaatygtgtctggatgagaaagaacgctttgctgtattacgtcatgaaagtttggggtagtttatcatggcagttggccaaccctaactaatgcatatcctcagtaccacagtttaatttcaggttaccttcaagcctcctccttcttattttaacagatcggtctctaacgcataattctcaatcctccccaagtaattgtcccaagtccaatttgaccatgtcacttcctgtcaagggggcattcttcaagggcttctcctcatcttcagataaagtctaagcatgatataatccctgcctac

SEQ ID NO: 72777 - DNA, 601 bp, Human
tcttttccaagtctcccccaactgaaaactaacataacaaacaaaaatttgctcaaaagtgcatctttctctaggtacttcccaatctgtttccttctctcaatgactgatttcttctcttgtgtcacccatactctctggaaagcctcattccactgaccatttccatttggattcattcacactcctagcaattatttattgagtacctatcatgtaccaggtgctgttctatgcactgagggatgtagcaatgaacaatgctaacaaagtctctgctgtcatggagctttcattcaartaagaagagacaaccagtaaaccaaaaaatgaacaatatttgggaagagctatgaagagaataaagtgggataataagaaaagacagagtgagagtgttgctgttttgtttagggtgacattttaacacaagttcaaagaaagttagggagtcagccctgtggagatctgtgggaagcatctcaaactcacaactttcctccaatatctattgtgacaaccacattccttgcatgaaaagattgcacaaccatccatcagtgactcaaccaaactaaaaacatatattcttcccttttct

SEQ ID NO: 72778 - DNA, 601 bp, Human
tagtagaaatcagtctagatcatgggttgtctacaaaggccaagtaaattaggaaaatatatgaagagcccaggcaaaagacaagagggagtagacctggaaatggattgttgcatgtcccatttaaggatttcaagttaaaaagaaaaaaataatgttatagccaagtgaaataactctgcaggccggatttggcttgttgacaacaagtttgatgttaaccctcaaaacttattcaaaattccaaaggacatgaaatcccaaatccttttggagcaaatgaaacaaaaaaaacatatamtagatagggcctcttgtttatttatgacactagtaataatttgagataaaaatcaaaagatctataattaaattacagaaataatcaacaaattccatcacaagattcttgcttaatgcatgtcatgtcatttaagccttgcagtaactctatgaggaaggcattatcccttttctgctgttgagaaaattaaggatcggggcagttaagtattctagcaaaatttcatagcaagaatgtagtagactctggcttccaactcagatcagcctgacacttgattctatgctctgaattata

SEQ ID NO: 72779 - DNA, 601 bp, Human
gtggagggctgatctttagctgggaagcaacagtgaggtgtacagggcactgtccagtcttatttaatgtctacactgtgccagttgttgaatatttattatttctagatgtgaaagtggtttcagtttgggggattgaatggcttggatttctggcgactgctttcattgtgatatgtaacacaataggagaaaatggtttgaagagaaagactattatccaaatttgaacatgttgagccacagacatgagccaacaagaagaacagtgagctaaaataaaaacactgacaaattatcrcacttaaatggtgggcaaaggagacagagctgcagcaaagagtagacaaaaaaggaaggtgacagaaaacagaggaaaaaagagtttcaaaagtttatcaacagtggcaaatgttgaggcaagatcaataaaataaagacagaaagtggtctgtggggattttgcaatatgagagtcattaaaggtatgagatattttatagtagaaatcaatagtagaaattactatgaaattgatttcatagtagaaatcagtctagatcatgggttgtctacaaaggccaagtaaattaggaaaata

SEQ ID NO: 72780 - DNA, 601 bp, Human
gattgcttttccataactgctcactgctcaggaatcatataaccagaagtcacaagatttgtaactttctcaattgctcctgtatattcatcactattgtaaaacctaagactggtctttgagatcattttcaaacttttgcattcaggtagaccaactcatgccacctgaatccatgacccataccaaagaactgactcgacaggtccacaggtcctgttacccacccctgccagccagaaactgactcgggacatgaagatagtttcaacatccctatgatttcattcccaaccaatcrgccgcacccattccctagccccctgcccaccaaattatccttaaaaaccccagcctctcagttctcaaggaagtgaatttgagaaatatctcccatcctacttgcttcacaccccacaatgattaaattctttctctactataatacctgatgtttccatgtatttgctttttctgtgcagcaggcaagaagaatttgttgggctataacaataataaaatatgacttacaaatgcaagcttttaaaatacttgcagcatgggggttccaaacctagactggcgatgttgctaagagaga

SEQ ID NO: 72781 - DNA, 601 bp, Human
agccattgttccctagattgcttttccataactgctcactgctcaggaatcatataaccagaagtcacaagatttgtaactttctcaattgctcctgtatattcatcactattgtaaaacctaagactggtctttgagatcattttcaaacttttgcattcaggtagaccaactcatgccacctgaatccatgacccataccaaagaactgactcgacaggtccacaggtcctgttacccacccctgccagccagaaactgactcgggacatgaagatagtttcaacatccctatgatttyattcccaaccaatcagccgcacccattccctagccccctgcccaccaaattatccttaaaaaccccagcctctcagttctcaaggaagtgaatttgagaaatatctcccatcctacttgcttcacaccccacaatgattaaattctttctctactataatacctgatgtttccatgtatttgctttttctgtgcagcaggcaagaagaatttgttgggctataacaataataaaatatgacttacaaatgcaagcttttaaaatacttgcagcatgggggttccaaacctagactggcga

SEQ ID NO: 72782 - DNA, 601 bp, Human
gtaacagtgagagaaatctaacataaactgactccatcttgctcttcacctcgcaagctaactgcccttgctcatgcctgagcacaggttaagctaactataggaagaatttagcttacagtttaactttgaagcaaggatgataatagtccctttcccaaactgatccctggggactgacaccatctttgtaagactacagtggggcctcaattctgctaagaggtaggcatagttaaacactaaccagccattgttccctagattgcttttccataactgctcactgctcaggaatcayataaccagaagtcacaagatttgtaactttctcaattgctcctgtatattcatcactattgtaaaacctaagactggtctttgagatcattttcaaacttttgcattcaggtagaccaactcatgccacctgaatccatgacccataccaaagaactgactcgacaggtccacaggtcctgttacccacccctgccagccagaaactgactcgggacatgaagatagtttcaacatccctatgatttcattcccaaccaatcagccgcacccattccctagccccctgcccaccaaatta

SEQ ID NO: 72783 - DNA, 601 bp, Human
tcactcaacactaatcaacacagaaaaattctgtgacctatatgtgggttttttcccccacacatcaaacaagcaatcagttttacagcagacaccagctgggggtcctccacttcaattccaacactatctacctagagatagcgtcagaccccacaagacacccttcaaccccttagacatcagttgcaagtctgggcctccagaacttctgaccagctggctgcacgctgaggttcctgcaatcccttcttcatgttggattaatttgctacagtaactcacaaatctcaggcaaacrttcacatttactggtttattataaagattactgttaaattaagtttagtctaaagctgcctcttcacatattttaggttcagcctaaagatttctctatacacagtgaactgtaacttaacaggatgtgtaaaaagaccataacctactcttgtaccaatcaccaagtttcagccaaaggtggccaaccgttccagctgtgttcaagtaagacaaacaccaagctgtaaccaatcgtgctgtttctgtacctcagtgccactttctgcgtgtcattttcttttttctgtccataaattct

SEQ ID NO: 72784 - DNA, 601 bp, Human
caaataaattatgttatatccatattatgatacatggcaatttttttaaatgacataactctaatttacattgaaatggaaatatttccaagacaaatgttatatagaaacatgaagaagttgcagaattacgactgcagtttgtatagtggattatcatatatacatatcataaaagataaagatagaaattttctatagttacatatacatatgtggtgcatgggaaaatgttgaaaggatacacataaagctgaaaaaaaatggttacctccagggatagcagtggtatggaggtagyggtaagggtctctgtgtagaaaaaacaaattcaaagtgatttttctgttctctcactcaacactaatcaacacagaaaaattctgtgacctatatgtgggttttttcccccacacatcaaacaagcaatcagttttacagcagacaccagctgggggtcctccacttcaattccaacactatctacctagagatagcgtcagaccccacaagacacccttcaaccccttagacatcagttgcaagtctgggcctccagaacttctgaccagctggctgcacgctgaggttcctgcaatcc

SEQ ID NO: 72785 - DNA, 601 bp, Human
atatgcatattaaaataagcacgacctcactcgcattcaagttataacaaaactatagcaaactaacagtcttccacacatctgactggtgcaaattaaggaaattgataataacaaagaaatctgtgagaaacagtacacttttatgcttcaaatgggagtatgaattgccactgacagcttggaaagtgattttgcatttcaaatatgcacacctattgaccctgcatttccagttctcagctggtgcctttgatatttgtagggcaccatccatcacttcttttaggtcttggctcaratgaaagctcctcatagaagcctttactgccacctactctctcatctttgttttctttctgtatgtttttttacaacatctttgttgtattctttttatattttcttcctcagatatattttaatatacatctttactgtctctgttgtatttcttctatcatacaacataatattttattacatatacatgtcttcatttatatttgtctcctcttacatgcccataagaagtattattttgtttactattaaatcctccaaaccaggaagggtgcctggcacgtggcactaagtaaat

SEQ ID NO: 72786 - DNA, 601 bp, Human
acatgacaagggattagtatcaaggatacaaatgataaaaatcaataacaaatacagcaaatagcacaacataacaaaacagtagtatccagaacacaaacaataaaaattaataacaaacatgcaaatatcacaatgggtaaatgaacaacgatgtagaactgccaaatccgagatgaggaaattcaaagggccaatatgcatattaaaataagcacgacctcactcgcattcaagttataacaaaactatagcaaactaacagtcttccacacatctgactggtgcaaattaaggaaaytgataataacaaagaaatctgtgagaaacagtacacttttatgcttcaaatgggagtatgaattgccactgacagcttggaaagtgattttgcatttcaaatatgcacacctattgaccctgcatttccagttctcagctggtgcctttgatatttgtagggcaccatccatcacttcttttaggtcttggctcagatgaaagctcctcatagaagcctttactgccacctactctctcatctttgttttctttctgtatgtttttttacaacatctttgttgtattctttttatatttt

SEQ ID NO: 72787 - DNA, 601 bp, Human
ttataattacctatctagaatatacaaaataatcaactgaaaaaaatatttattggaaccaatagagtcttagcttccctatacagcaggaatcatatattaaaataatacaataaaacaaaaatttcattgttaatagcaacaaagcccccaaacactttgaaataagcctaaaaataaatacaacatttttatgtggacaataaggaatattgaaagatgcctccccagataaatttgtaggttcaaatgcaatctcaacaaaaatcccaacattattttaaagtaaaatttgataagrtaattctaaacatcatatgagaggtataaattagtatgtatactgacagtaattttggacaaaagaataacagagaaaacttaacttaccaatgtcaaaactgattataaaactatagtaataaaaacactatggaactcacacaagaataaaccatgtatgatgaaacaggagaatgagtctaaaaatgtacctaagcatttttggagatttcctttatgccaaaagtaatatttcaaaccaattcataaaaatctactattccatacattgtactgggtctactggctagccagtaat

SEQ ID NO: 72788 - DNA, 601 bp, Human
ataaaaagaaaaggcatttaggtaataagaaagtgctgctggcaatttaaaaaatataacaaatgatggatttgggtaaaggaaagctccagaaaaatagctatacagtaggcctagaaagccatcaatcaggttcaagtaagagaaaaatacagctccagatgaatgtctcaacagaaacagtgtcccagataggccaatgtgcagcagggatggaagagctgcactttcaaaggattccagagatggattcgcgactgctgcatggaagggctttatgcactctgggagaaaatttacwtgtggacaggctatcaattcctgtaataaactttttatctcagatgtgaactacatttaggtagacactgactattgatttgattgcgatatgtctggactgagaggtcaagaaagtataagtgtatagggtagacagccgtgctgtgaggagcacatgaagagaactcagtatatttttccataagaaatcaatagacaagttgaaattttaagaactgtaattaagcatgttgttttcacatgtgacaaaaaaaatcagctgaggaagttgaaaggtatagatttcttggaacataac

SEQ ID NO: 72789 - DNA, 601 bp, Human
tcagtgtaagctgtctggctttctgcatccatctctcaccacctttttctttacatcttctaatcacatccttgctgccattctaagaagtgctccatcttcccctctgtatcttgagacaagctgtttcacatatcctaaagaactcatgttccaaagtggatctctcctcttcaaaaaaaaaatcaacctctccatctcaactgaattatttcctctgtcttctaaatacggttagaactttccccttcaacgctactaaggtatattttacaaataaaaatcgtgtatatttaaggtrtgtaatgtggtgttttgatatgcacatacattgtgaaatgattacaacaagcaggttagaactaaaaaactcttcttaatatgctcataccgttcccagtgctacattctcattctgtcatttcaccatcaaccttctagagcagttaggatacctctattgctttccttgcttccttccattcctccttattcctgtacagaatggctcccatttcacagggccctgctggctgatggaactgatccctgtctctgtggactacatactagcagagaattacacactgcttcaataaag

SEQ ID NO: 72790 - DNA, 601 bp, Human
ctgatacagaagtaataacagggtctttaggtagattcactttaacttagaagaagccatggaagcacattcaaccatatctggagctgggccagcctctccaatacaaattcctgcttcccaacttccaaatgggctctgcttagcaattcctttcttccatcgcccacccatatcttctaatatgggtggcactaatgctttcccaatcatatcgacacactgtgtagataacctgctactccatttgagccattggttctcacactttagttagaataacccagagagttcactaatrtcacagcttcctgggttctgatgagagtgatccaggggctgaatttttacctagtactcctgggtaatctgacacaggtgggacatacttatttagaagatcaaagcatcagtgtaagctgtctggctttctgcatccatctctcaccacctttttctttacatcttctaatcacatccttgctgccattctaagaagtgctccatcttcccctctgtatcttgagacaagctgtttcacatatcctaaagaactcatgttccaaagtggatctctcctcttcaaaaaaaaaatcaacct

SEQ ID NO: 72791 - DNA, 601 bp, Human
tggcggcagcagtggctgaagacaaggcattcttcgaaaaacgtcttatatctgttttgtttgttagaacatcactctgtggtgacaggaaatcttcacagcagtgactgcttacagcacttatggcaactgtcagtctgtgtaaaaaaaaggtactctaatagaatagaagattaccttggaaggaagaggctggtagcctggagaccaggtaagaggctgctaatacactcaagttaaaaaaaagagagagagagaaagagagggagagagaagggtagagagagagaaaagcaatgamctagattagggccttgcaacttttaattcctttcaccatgggagctgcccatcttgggttatatgcaggtggagcagcagcatcaaagaataaactgagccacaactagcagaggaaagtctggcctgacatgttggcaggctcatcataattatgtgaaattaaagttctgaatacacaaatccacaggattgtatgtagcaatcagcattattgactctgcctgcccagaaaggtatgtttctcaaggccagaaggaagggaaatctctcaagttgtcttcatgtccttgatccagta

SEQ ID NO: 72792 - DNA, 601 bp, Human; identical to SEQ ID NO: 26413

SEQ ID NO: 72793 - DNA, 601 bp, Human; identical to SEQ ID NO: 26414

SEQ ID NO: 72794 - DNA, 601 bp, Human; identical to SEQ ID NO: 26415

SEQ ID NO: 72795 - DNA, 601 bp, Human; identical to SEQ ID NO: 26416

SEQ ID NO: 72796 - DNA, 601 bp, Human
tgctattacctggaagaaggagactttagttatttctctgcatatgtgtttacctgggctatttaataataaaacctgaaaaaaaatgtttcttagttttagatgcatacacaggcttattttcaaaaatgttttaatagattggttgttagaatttgaaatgcatttttctataaaaacacctatatactggccgagcacggtggctcacgcctgtaatcccagcacttcgggaggccaaggtgggcggatcacgaggtcaggagattgagaccatcctggctaacacggtgaaaccccrtctctactgaaaatacaaaaacaaacaaacaaacagaacaaaaaaaacgagcgtggtggcgggcgcctgtagtcccaactacttgggaggctgaggcaggagaatggcgtgaacccgggaggtggagtttgcagtgagccgagatcacgccactgcactccagcctgggcaaaagagcaagagtccatcacacacacacaaaaaataacaaaacctatataccaattagattccaaggcaattagatttagaaatctattttctccatgtcttaggtttggttccctggaagagagtctg

SEQ ID NO: 72797 - DNA, 601 bp, Human
ttgggagcccctggatagagttggtgaatttctcccaggagaaaagtccctccaaattctagctcacctccttaagcctccatctttccatggatcttgtctcataattctttactattttattagttctctgacatttttaagcagaattaaaaaatactttgccagacttcctattgccttcagcaggaggatagttctgagttatttagtctgctattacctggaagaaggagactttagttatttctctgcatatgtgtttacctgggctatttaataataaaacctgaaaaaaaawgtttcttagttttagatgcatacacaggcttattttcaaaaatgttttaatagattggttgttagaatttgaaatgcatttttctataaaaacacctatatactggccgagcacggtggctcacgcctgtaatcccagcacttcgggaggccaaggtgggcggatcacgaggtcaggagattgagaccatcctggctaacacggtgaaaccccgtctctactgaaaatacaaaaacaaacaaacaaacagaacaaaaaaaacgagcgtggtggcgggcgcctgtagtcccaactacttgg

SEQ ID NO: 72798 - DNA, 601 bp, Human
gttgtaaatttagtctgctgattttcttccatgttccttccttgatgccagaaaaatcctacttggctccagttattccagagtattccaacagcttcttaagattaataaatatcacagacaaagactataaagactaagagggagaacaattaataaattataactaatatattgtgatgagtgtttattatatgagttaaacccactaattttgtggagtatttttacctaacatttttaagacttattattgtgtcaagacttttacatgatgtttaactcttagtaaattaattartttagaattatattaaaacacaaaacacttgagatcacaattaatttctatatagtgtccaaatatgctaccgtatatgatcttacagtaatcctggtggtatgactattatttctgttctatagataacatttctaaaagtatgcttaaatttaaaaaattttatccttagaaagctgaaattgattagttaactctgggtttttataagagattttagaatctgtggttttattcacattgagatattcttagttattatctctttaaatattgcttttgaccattttctctctttcc

SEQ ID NO: 72799 - DNA, 601 bp, Human
attttatagaatgtgatcttataggatcttattctaactatatgtaggtatctgtattacattctctgggcacacacgtgggtcttcttggttggacatcctgccgttatctacataaatgttacttcacgctcatgggtttcaacaattccctttcaaagcactaaccttaaacttgcattcactcctgttaaacagctatgaactttatatagaattgttcttaaatgaaacaattgtgtctcttggagatttctcccctaattcttaaccttttatttctccaaaaacgtaaagcaaatactttcctttccttggggttttactgtaaataattctgtttctgttagctctggtttttgttatatttttctagcatgataaactcatacatgcagaaacattattatgttatttaaataatagatacttgctcactgttatttttaccaaggccacctgttttatagatttcccatatttaattcttataaaactctgtgtattacccatattttaggtaaaggaacaaaggtccggagatgttacgttagtcaaagcctaaaaaccaccatctaaaaccacctaatttccacagcag

SEQ ID NO: 72800 - DNA, 601 bp, Human
gttcagcagttcaaattcactgccaagatctctgtgatttgccttatggctttaagatggcgcctgcagttctaccagcttcttgtctacatttgagaaaggaataaaggagggaatattctggtccaactcgtccccatttattaggtaaacatagcctttcccagaatttctttcagccttttatttaaatattattagtcatgtgtcacatagccaactctagctggaagggatgataagaaaaatatttagctaggtacattcctatctcaaataaaatcagactttttttttttttcccgagagaggggagacatataagattttctgcctcagggggccccttgggaagctgtttaatattgtcaggctgacactaccagcccctgcctgatcctgctctcctatcaggattaatacttaggcatgtggagaatataacaaaaatctcaagttctcgtatcctacagtttaattctgtatcctacagtttaagccccacagtttaatcctgctttgggaacttaagctatgtaactctgaacaaattatttgacatatctgagctttaattttcataaaacagggataataagat

SEQ ID NO: 72801 - DNA, 601 bp, Human
gcctatattttctttctgtgataagatgtctgagggtaggcggtctgctgtgggttcagcagttcaaattcactgccaagatctctgtgatttgccttatggctttaagatggcgcctgcagttctaccagcttcttgtctacatttgagaaaggaataaaggagggaatattctggtccaactcgtccccatttattaggtaaacatagcctttcccagaatttctttcagccttttatttaaatattattagtcatgtgtcacatagccaactctagctggaagggatgataagaaaartatttagctaggtacattcctatctcaaataaaatcagactttttttttttttcccgagagaggggagacatataagattttctgcctcagggggccccttgggaagctgtttaatattgtcaggctgacactaccagcccctgcctgatcctgctctcctatcaggattaatacttaggcatgtggagaatataacaaaaatctcaagttctcgtatcctacagtttaattctgtatcctacagtttaagccccacagtttaatcctgctttgggaacttaagctatgtaactctgaac

SEQ ID NO: 72802 - DNA, 601 bp, Human
ccaccttatacattttgatgaaccgtttggtgagaattaaagcaggacaaattaatttgctgaaggaaagatttattctgaaaccaactctctgtaaatggggtgcaggaaatgaaaacatcgagaacaataacaaaaacagctgttggaaatcaaccggaaatggcgaggttattacgataagaaagttcacaatttgagaatttgagggggtgctttagtttagatgataactttaatagccatgtggccttgctccaggtacttaactttatctttagtctctttattttaaaaaagrgatcaaaatatatacctttcaaatactgacagaatgtgaatgtccacagtgcccttaataaatgtaaattcttccaatgaaaacatttttgtaccttccccacaaatgtttatataatgttcctttgttacataatttttatatactttttcatatatttgtatataatttttatgttatatataatttatacaaaaaaatcacaagacaacaagtgatgtgcctggtgtgtaacagtttgtcagtctgaagtcaggttcattgctcttcccttaaaaccattgtatgacaaaatatgac

SEQ ID NO: 72803 - DNA, 601 bp, Human
taaaatgttgaaaggattatgtgcctggacatggaaatcgccaagaattatggcagtaatcgctctggagttaccactgctaacatcttcaaagaataggaggaaggtcttggaggtcctcagatgactggaataagcagggatggtgagtaatatagtctgatagcaggagctggggagttttggagattcagtccaagagaagtctaaacaattactaggacagtggtaaccaaattttgctgtacattagaataatctgaggagctttaaaacacctggcattccagttcacagcccrtaccaactaaatcagaatttctggggaggtagaagcaggattcgaatagtgtaagatccctagatgatttcaacatcagcaaagtttgggaaccactgccacagagtccaccttatacattttgatgaaccgtttggtgagaattaaagcaggacaaattaatttgctgaaggaaagatttattctgaaaccaactctctgtaaatggggtgcaggaaatgaaaacatcgagaacaataacaaaaacagctgttggaaatcaaccggaaatggcgaggttattacgataagaaagttcac

SEQ ID NO: 72804 - DNA, 601 bp, Human
ttctttcttcaactaaaacatacacaattacttcttgaacaacaaaaaatatcatttggtactgctcaacccattcagaatatcacagaaaaaagtaacaattacaaaaataagactaaaagagaaatagatttatgtaacattcaatatttatttaaaaatgttaattcactatatactatgcctgttaattgatgatctactattaataaaaatctttgccatcaagtgtttacattctaaacagactaggttcaggaaagaaacaggagctgtataatgcaagttgctacaaactacrgctcacagaccaaatgtggcccatgcctattggtgtgcatatagtttattagaacacagccttgcaagttttttgtatattatctatgattgcttttgcactacaatggaagagtttcatagttgttacagagtgggttcaacaaaaataggatattcagggaaataatataactgtggagcaaattgaaagactaaggatagataactcctatgagaactttttcagtaaagacaatcagggaaatgaggcagtagctaggggaagatatggggtcaaagaaggacttttttctttaaa

SEQ ID NO: 72805 - DNA, 601 bp, Human
ttattatccaatttgattcagattcaattccatttttaatttttaagaaaatgcaattcaaaggtaccaaacaataataataatgtgcctaatcataaaacatgcagaggattgattttattttttcataaagagaatctaaaaaagtccactagctggatttttctttcttcaactaaaacatacacaattacttcttgaacaacaaaaaatatcatttggtactgctcaacccattcagaatatcacagaaaaaagtaacaattacaaaaataagactaaaagagaaatagatttatgyaacattcaatatttatttaaaaatgttaattcactatatactatgcctgttaattgatgatctactattaataaaaatctttgccatcaagtgtttacattctaaacagactaggttcaggaaagaaacaggagctgtataatgcaagttgctacaaactacagctcacagaccaaatgtggcccatgcctattggtgtgcatatagtttattagaacacagccttgcaagttttttgtatattatctatgattgcttttgcactacaatggaagagtttcatagttgttacagagtggg

SEQ ID NO: 72806 - DNA, 601 bp, Human
tctgtactcttcctggcacactgccttacttctttattaaaaggctcagggagaacaagccatttctgtagcacacttacaacatttttgggagcggctccataaatctctctagtgtgtaacaatgggataataaaactccgggatttggaatttactgtggttctcatcttctctccaggcctttgtgacttaggaagtccatatgctaaaatctcagaaagggtgattcagagagacctcctttaatttggagcttgctggtgacctcctatttatttgcttcctcttattttttttyccaaactaaggtttttcacaggacttcatataatttttccagcttttctggtataaaccatctgtggtcactttgcagagtctctttaggtcatgggaaagttctgtctttcctgcatagcacatatatgagccctgctcaccacagccactgttagtggacagttctatttgtccctaaggagttgagatgtagtcacaatgacaaaatgttgcctatctacaattgtgataaagtttagaatgctcatacacttaattaactcattggtcactgttaaaaatgagttttacctctttt

SEQ ID NO: 72807 - DNA, 601 bp, Human
aagagctctcctggtctagaaactctgagcccagagacactagacttttcccctgcggcctatagtgtacctgacactatttggaatttgtatggaatcagctggcatcttctatttttgaacattctggatagtcctcctgagcagcaatcttctcagcttgctcaggactggttgtgcctctttgattttgaacactgtcttcatattgcagataatgaaagtgaaaaccctgtgaggttaagtatgatgtgccatttccctcagagaattatcaggatagctgaagttctagtcaccyactcttcactctgtactcttcctggcacactgccttacttctttattaaaaggctcagggagaacaagccatttctgtagcacacttacaacatttttgggagcggctccataaatctctctagtgtgtaacaatgggataataaaactccgggatttggaatttactgtggttctcatcttctctccaggcctttgtgacttaggaagtccatatgctaaaatctcagaaagggtgattcagagagacctcctttaatttggagcttgctggtgacctcctatttatttgcttcctctt

SEQ ID NO: 72808 - DNA, 601 bp, Human
cctttaccttccaccacgagtggaagcagcctgaagccctcaccacaagcagatgctggtgccatgcgtcttgtacaacccacagaattgtgagccaagtaaaactcttctttgtaaattacccagggtctttatagcaacactaaatggactaagacactacccctttgaggtaaaattgtccccactactcctaactctgaactgatctgttcttcatctctgtagttttctctttaccagaatttcaaatggatgtaatcttagtatgcaatctgagactgacttctttcacctagcrtaatgcatttgggatttatctatgttgttttgtgtatcaatagtttgttccttttattggggaggagtattccattatatggatgtaccagtttgcttatgcattcactccttgagagagattttggttgattccagttttgagtaattttgagtaatgctgctacaaacatttttgtgcatgtttttgtctaaacataagtttttatttctctagtgaaaatacttaggagtgagatttctggatctcatcacatgtgcatgactttatgagaaaccgccaaactgtaccatcttgctt

SEQ ID NO: 72809 - DNA, 601 bp, Human
agattatgtgattttctttctttcttttttttgagacagagtcttgctctgtagcccaggctagagtatagtggcgcaatctcggctcactgctacctccgcaggttagcagtgataataaaaagtatcctctctatgaaacgatatttcaaagaacagaagtttttaattttgatgaagtccaatttatcaatttgttcttttgtgtattgtacacttgatatcatatcaaataaattattaactaatccaaagttacaaatatttttctcctatttttttcatagaagttttaggtttygcatttagctctgtgatccattttgagttaattttttacatggtgcaaaatatgtattgaagttcatttttaagttaatacgtaatatctgtacataattatgaggtacatgtgatactttgttacatgcatataaagtctaataatcaagtcagggtatttgggatatccatcacctcaagtatttatcatttctacatgtaggaaacattccaagctgtctcttctaggttattttgaaatatacaatatattgttgttaactgtagtcactctactttgttatcaaacattacgatt

SEQ ID NO: 72810 - DNA, 601 bp, Human
tttaactttttctatggttcttgggcctgaaaagtaggaacacctctatgttcctggaaattgagaaaaaaaaaatgtgaatcagaagagatcatatattccgtattgcgactactctgagtcatatcagtaacacaaacatttgataatcatttcttaattaaacttctgaacattttttgacattttataaaacaatgcttttcccaaactaattctattttgagctatcagaatgtatatcctgttttcttgcattttcaccaccagatggcagtgataacctattcattcatttctytctcttttttttttttttttaatcgttctcttgtttaatgttattctagaaatgaaccagtagctctaaattaaaagtgatggccaaaaattcccactttattttctacgacaagtcagcatgctagagtcacagttcccttgtgcaaagaagtgaacaaaacgtgcatggagggaagcacaggaaatatcgtgattttgtgtgagagctggaatgccactaagtaataaatgactctggtaaattgtaaaagactaccttgggttgtgtatattaaaagtatataaatttccgtgtgtg

SEQ ID NO: 72811 - DNA, 601 bp, Human
ctgaaataataaacgccaacttttattgagtgcttaacatgtcacaggcatgatgctagttaagctcttttcatggattatctcacctaattttcaaaaaggtttattagtatttcaaaggggcaaaactgaagatctgaagcctagtacttttgcaatactgtaaagttgctagtggtagaatgctttctgattttgaaatccacactgttaaccaagagaccacttcattagctaatgagggttctctggagttgctaaaggaaatgtcattcatactttcttgagaggaatggatcatattgcacaggaaagggatgtaagaacatatatgtattgttcttacatcatatatgtgtgtgtactaaagccctgttagaatgatgagcaaggaaggaatgagtttaacctttaaattagactgaccttgcttcaaaacttggtttctccactcactcccagtgcagacttagatgagttattcattgctctgagccaagttttctccacgcttaaataggaataataattctccaaagtttttttgagaatttggaaatactaatatgtgcataaaatgattgaaacagtgtctgacata

SEQ ID NO: 72812 - DNA, 601 bp, Human
atgatttctgggacttatgtggtttttgtgctgctattcttttttgtgtgtttttatgttaggaaaagtcatagaagaagccaaatttggtgtaggagctgaattagttactgtgatttactagagatggacagggactgtggcagtctttggcaggcctcgaggagcaaactgacaaagctgtcattttcacatttagaattttccatgtgttcactgccagcctagaaaccccaggagcgtggtgtcccctacattttccaatatgtgaagatgttctacccagatctctcatatgatygattctacagcccatatagagtcttgccctgttattctagagtcaccattcagagtcatccaatattctgaagagctcttttcctttcataaaggccttttcatatcgctgaaaacagttaatcatcaatctgcattgaatatccagtatataaaagagactgaaataataaacgccaacttttattgagtgcttaacatgtcacaggcatgatgctagttaagctcttttcatggattatctcacctaattttcaaaaaggtttattagtatttcaaaggggcaaaactgaagatctga

SEQ ID NO: 72813 - DNA, 601 bp, Human
gctggaataaatgggtagataattatcctgcttgagtatattaatagttaaaaaatgtatatatagttcaaatatttttctatgtttaatattagaagtgctttggctctttatttagaagtctggtgatgtttttgtgaccagaaatttgttgtaggaactgaatcttatttatatcaagtagctggtggtaaaattggttttgttatatgtcgttttgtttaaacttttgtttaacaagcaataggttcaaagaacctatttaagatataaagtgaggaattaatgtgtgtgtgtgtgtatatatatatattttgtaaaatcactgcctttttaaagggtaatttgggaacatttttatcattcctcggaacgaaggataaacattcctttccttaaaaataacattggaacatcattttccagaaatataagaattctctcacagtggttgctattttacttttcaatgacttgccaaaactagaaagcagaacatataaaatttcatctggaaatgatttctgggacttatgtggtttttgtgctgctattcttttttgtgtgtttttatgttaggaaaagtcatagaagaagccaa

SEQ ID NO: 72814 - DNA, 601 bp, Human
gattatcattgaccccacagaaatggaacacagtatcattcagagactattatgaacacctctgtgcaaaccaactaggaaacctagaagaaatgaatacattcctggaaatatacaacctggtaaagattggacgaggaagaaattgaaactttgaacaaaacaaaaatgagttccaaaattgaatcagtaataaaagcctactaagaaaaagtcctgaagtagatggactcacagctgtattctaccaggtgtataaagaagagctggtaccaatcctactgaaactgtttttaaaaaytgaggatgacaaactcctctctaactcattctatgaggctggtatcattctgatagcaaaacctgccaaacacccaacaaccacaaagtaaaacttcaggccaatatctctgattaccataggtgcaacaaccctcaacaaaatactagaaaagcaaatccagcagcatatcagaaagctaatccaccatgattaactaggctttattgatgtgaaagattggttcaacacacacaaatcaataagtatgattcattatatgaaaataactaaaagcaaaaactacacaatcatctcaat

SEQ ID NO: 72815 - DNA, 601 bp, Human
tggggtggatcacgaggtcaagagatcaagaccatcctggccaacatggtgaaaccctgtctctactaaaaatacaaaaattagctgggcatggtggcacgtgcctgtagtcccagctactcaggaggctgaggcaggagaattgcctgaacttgggaggcggaagttgcagtgagccgagatcgcgccactgcactccagcttggtgacagagcaaggctctgtctcaaaaaaaaaaaaaaaaaaaactttgtaatttagcattccattgattttttaaaaatatatctagacacaaacrcatactctgttttcagataatggtagcatagtgtacaagtttttcattactttgtttttactccataatatatcctacgtaattaatagatttatagagatatggcttatgcctttttcacatcttcagagtattccattgtgtaaggatacattatttaatcagtccagtcccctcttgatggacatttgactctttctagtattttaatattataaataatgattcattgaagaatcttggagaagacctaagatagttgactagatgcagccaggaagagcatctcccatagaggga

SEQ ID NO: 72816 - DNA, 601 bp, Human
tcattatagtttacaaaaaaattctatcattcctttctgttttattagctggaatatttctgtatttctatacagagaaacctatcctcattagtcatttagttaccttaaagtataatttatatagaaaaagcaggataaaatttgatttttttccctttacgtactcgttttcaaaataatgactttgttgcatattatcctccaaagttggccaatgagtttgcttgtttgtttgaatattattataaaccataggtttaatacatgtgatgtgattgtatttattgttctattgatrctctaattgtctaatttcagggcagtgggaatctcttcaggttggccagtgagtcctttggcatgatcttggcattccttcttttctgattcaacaagatagttcaagtttattttgtaaatttcttgctctagctttggaatcagtcctttctccaggaaccccactttccatatagtggaaaatcatctttagagaccacaacatgggcactaaagtactcattactactaggttagtagtagttctagtactactcattagttctaggcctttgctgaggacagagttaaggaaccc

SEQ ID NO: 72817 - DNA, 601 bp, Human
tactaaaaatacaaaaattagctgggcatagtggcatacgtctttagtccctgctacttgggaggcctgaggcaggagaattgcttgaacctgggaggcagaggtttcagtgagccgagatcataccactgcactccagtccggacgacagagtgaaaccccgtctcaaaaaaaaaaaaaaaaaattagccaggtgtggtggcgggtgcctgtaatcccagctacctgggaggctgagacaggagaatcgcttgaattggggaggcggaggttgtagtgagttgagccactgtactccagmctgggtgacagagtaagtgagactttatctcaaaaaacaaaaataataaataaataaaaatgtttattcatgttccttatatatggccttttgagtttctacaaggtgatatctactttatcaacaaactgaatgtcctttaagccctttgatttcagttttataagatagttgtcttcaagttcttgttagttttgcgcaatctagacctcataccacctatggttaactgaccaaaggcactatttgtgaagatctgtctgaagcaggtacaggcacaaaaacaaggccaaagctgag

SEQ ID NO: 72818 - DNA, 601 bp, Human
atgatgtgttattgtgcaggcgatatctggggcatctggccttgctgtgaacagaaagggtttaggcagccaggtgaggctttctgaaagacagggtctgtgctcttaaggtggagctgaattaggagagagaggaggtgagcaggagcaaaaacactgagatctggaatgccgaactgtaaactagggagaggagcaatttggagttgtcagagcttgtgtgaggtagctaatgatgactttagatgcgtcatcttcctaactgaattcaagaactctggctgtgtgtgtgtggtgggtktgtgtgttatgtgtttaaaccagggaatgtcttatgtgcctaatatttttatttcctgaagagttttagtttaacttttgcactgcctaaagtcatgtcaattgatgtaagtctttctaacctttgagtaaacccataaaacctctgaattttatataaaattgtgcgtatatgcatgtggacattttcccagggtgagagtccagatagcctcatcagtggtttcccaaaaaggatctctctctctctctttctttctttctctttccctctctctctttcttgctttctttctctctc

SEQ ID NO: 72819 - DNA, 601 bp, Human
ctcgcgttggcccgcaagcactctgcgcagccccagttctgctcgcgcctctcgctccacacctccctgcaaggtgagggagccggctccagccttggccaggccagaaaggggctcccacagtgcagtggtgggctgaagggctcctcaagcgaggccagggtgggcgcgccaaggccgaggaggcaccaagagcgagtgagggctgtgagggctgccagtgcgctgtcacctctcaatatcagcaggtatagtctgctaatttacttgtacactgcaaacttctagaggctcatctgtyatctctgtatcttcagtgtgtgaaagagttcaagacatattataggaaataatttaatggttgtgatattgtgaagtgtgtatttggtcttcttccctgtttcctggtatacaacccctaaaatccatggaatctccaaagtgatgtgtccttttgtttgctaatgagttgattggtggctggtggtcctaggtagtttcaggaccaaggcaggattagagggctggaatttttcagccttctccccacaccctgccacctccagggaggggacaggggctgaaggtttagttgatcacc

SEQ ID NO: 72820 - DNA, 601 bp, Human
gggggaggcggctcaggcatggcgggctgcaggtcctaagccctgcccctgcccctgccccttggggaggcagctaaggcccggggagaaaccgagcgcagcgccagtgggccggcactgctgggggacccagcacaccctccgcagccgctggcccgggtgctaagtccctcactgcccggggccggcacggccggccagccgctcggagtgcaggccagcccaatccatgcccacccggaactcgcgttggcccgcaagcactctgcgcagccccagttctgctcgcgcctctcgctcmacacctccctgcaaggtgagggagccggctccagccttggccaggccagaaaggggctcccacagtgcagtggtgggctgaagggctcctcaagcgaggccagggtgggcgcgccaaggccgaggaggcaccaagagcgagtgagggctgtgagggctgccagtgcgctgtcacctctcaatatcagcaggtatagtctgctaatttacttgtacactgcaaacttctagaggctcatctgtcatctctgtatcttcagtgtgtgaaagagttcaagacatattataggaaataatttaa

SEQ ID NO: 72821 - DNA, 601 bp, Human
ggaattggtgggttcttggtctgactgactttaagaatgaagccgcgaaccctcacggtgagtgttacagttcttaaaggtggcgtgtccagagtttgttccttctgatgtttggatgtgttcagagtttcttccttctggtgggtttgtggtctcgatggctcaggagtgaagctgcggaccttcgcagtgagtgttacagctcatgaaggcaatgtggacccaaagaccgagcagcagcaagatttattgcaaagagcgaaagaacaaagcttccacagtgtggaaggggaccagagcrgattgccactgctggcttgggcagcctgcttttattctcttatctggccccacccacatcctgctgattggtccattttacagagagcccagtggtctgttttgacatggtgctgattggtgcgtttacaatcggtgagctagacccaaagttctccaagtccccactagattagctagatacagagtgtccacacaaaggttctccaagtccccaccagagtagctagatagagagtgtggattggtgcattcacaaaccctgagctagacacagggtgctgattggtgtgtttacaaa

SEQ ID NO: 72822 - DNA, 601 bp, Human
agattagataaagtggcaggatatgccctataactgcaaccaagaaaggactaatagttcctagtgtaaaattccctgtatcatttctttaccccaaaacggggaagggtgacctttattgcctctacatatatctgtctgggccatggcctgtgcacttgtgcatgtaaaaggggcccctgggagcggtgggacacactatacctactcatactgtgtccggaattggtgggttcttggtctgactgactttaagaatgaagccgcgaaccctcacggtgagtgttacagttcttaaagstggcgtgtccagagtttgttccttctgatgtttggatgtgttcagagtttcttccttctggtgggtttgtggtctcgatggctcaggagtgaagctgcggaccttcgcagtgagtgttacagctcatgaaggcaatgtggacccaaagaccgagcagcagcaagatttattgcaaagagcgaaagaacaaagcttccacagtgtggaaggggaccagagcggattgccactgctggcttgggcagcctgcttttattctcttatctggccccacccacatcctgctgattggtccatttt

SEQ ID NO: 72823 - DNA, 601 bp, Human
tctacacatagcaatggattgttgtagagctcagattagataaagtggcaggatatgccctataactgcaaccaagaaaggactaatagttcctagtgtaaaattccctgtatcatttctttaccccaaaacggggaagggtgacctttattgcctctacatatatctgtctgggccatggcctgtgcacttgtgcatgtaaaaggggcccctgggagcggtgggacacactatacctactcatactgtgtccggaattggtgggttcttggtctgactgactttaagaatgaagccgcgraccctcacggtgagtgttacagttcttaaaggtggcgtgtccagagtttgttccttctgatgtttggatgtgttcagagtttcttccttctggtgggtttgtggtctcgatggctcaggagtgaagctgcggaccttcgcagtgagtgttacagctcatgaaggcaatgtggacccaaagaccgagcagcagcaagatttattgcaaagagcgaaagaacaaagcttccacagtgtggaaggggaccagagcggattgccactgctggcttgggcagcctgcttttattctcttatctgg

SEQ ID NO: 72824 - DNA, 601 bp, Human
aaaccctgggtcttcaacaggatctgtacactaatggctgacccgagtttgaatatctctggattccctttgggttctagaaacatttcgtttacagctcctctcaatggttctttgctgccctcctgtcttatgtgcaccccacacattccagctgcctgagcttttctgaactctagtccctgtcttttcaactcaatgacactgcagtgttctgcttggacttatacctccaatgtggtccaaaaaatcccttcaggaagaaagtcaaggcaattatagtgatcatcttctttcctakttttcaaggatcacattcttgtgcctattttataatgtctaaaaacctgtttctcccgtcttgttcagttttctagttgtttacattggcaagcccagaattgtttctatggtggccccagagcctttttacataatcaagccttgtgaataattctcaattccctatataaaataggtgctttagatggtgaagatgcagcctgactgcatggtcttgcatatttagaagcattttcagaaattctgaattttcctttaaactgtactacattcaatattttgtaattatagtagtgga

SEQ ID NO: 72825 - DNA, 601 bp, Human
gttgtccttcacggtacttcagatgactgtagttacaaaactaagtgcacacaattaccaaccatggtgacatgcatttatacattttgctttttgacctgtttctttatgaatatggtttttctgctcataactgttgtacccgtgagactctatagctgagtgtttatgcttgcaaaaatatgtatattttacatatcttattgtgtaaagtggtctatgacaatagatctttgcacaataaaataattacaatagacctttacataataaaaatattttactttattatgtaaagtgrtctatgaaatattcttttttttctcaaatatccttttaaaatataaataaatgttatttaaataattttaaattatctttaccagaattatattttcaagattttgatcttttttaagatttcaacatttggaattatggtatgtgggattgtttctttcagaattattataggctccctttaaccataacttttatggttttctttcctctccttttggcctttggcaaagcaaaaacaaagtaaaaacaagcccttttgtgtctcttagtggtatctatgcatggaatctccagaatt

SEQ ID NO: 72826 - DNA, 601 bp, Human
gccattttcctggcttggtcttccaaagttctgggataacaggcatgagccatcactcccagccctgatattacttgaatgaaatttgttaaataaaaaataggtgccactggggagtagaacataagggagctaatatttattgacatctactatggctagatgtcatactaggtgctttgaatggctctgtttaatcttggtggtgtagtcaaaagtgtactcatgatgttgaccttgagacaaatgtctaatagtatttaatgaatagggattacagtgtaacggggcaaaagaagcrttgtaaagccagaggcagaaggtacaatccaacttctggctaattaagtgatactatactgtcagatcctctcactttaattatcttaattttattctccaaataattcatgatcttttataaagaattgaaaaaatacgggaaggtgtaagaaagcaaaagtccttactttccccataccccgattcctctgcctaggggtaattgtctttaacatattaatatgcgtcctttctgtctcccacaacctaaaaataaaagatatagttgaaattttgttagtaaacaataagattctaa

SEQ ID NO: 72827 - DNA, 601 bp, Human
tggattgagcatttacgttaattattatgtcttactcattatttcagacaggttaaaatgtaacttcttgcagtgttctcgtgtaccacgaaggaatttgttcctaccctcatccatcaccagtggttgaaatcagtcagcttaatgggtttctaaaagccatttccaggcagctgtgtttacccttctctccaaatgctcattggggcttcctaagcagaaatatgacaaggaacacttcactcatctgtatttaaatataaaagccttgtgtatataaatataaaagtttagtgtctcyttttgttttctctgattttggcctatggcaaaaaagaaaataaaaagtgataacaaacaaaaaacaatttgaaaacaggtgaaccaaaagtagcccctaaaatccagagttctgatgttgtagttgatttttttgtttcctgttttttgttttagggatgggggtctctctatgttgtccaagctgatctcaaactcctggcctcaagccattttcctggcttggtcttccaaagttctgggataacaggcatgagccatcactcccagccctgatattacttgaatgaaatttgttaaa

SEQ ID NO: 72828 - DNA, 601 bp, Human
gcattgtggatagattgtttttctaactagaaagtaaatattaaaaatacttaaaaatatatcaggcactacctaggtttttaggcaatatcagtggactcaggagtttattttacttttagagtagaaaacgttggagagaacatttgcctcaggcattctgagagtggattgagcatttacgttaattattatgtcttactcattatttcagacaggttaaaatgtaacttcttgcagtgttctcgtgtaccacgaaggaatttgttcctaccctcatccatcaccagtggttgaaatyagtcagcttaatgggtttctaaaagccatttccaggcagctgtgtttacccttctctccaaatgctcattggggcttcctaagcagaaatatgacaaggaacacttcactcatctgtatttaaatataaaagccttgtgtatataaatataaaagtttagtgtctctttttgttttctctgattttggcctatggcaaaaaagaaaataaaaagtgataacaaacaaaaaacaatttgaaaacaggtgaaccaaaagtagcccctaaaatccagagttctgatgttgtagttgatttttt

SEQ ID NO: 72829 - DNA, 601 bp, Human
ttttaatattaatatgagtatttttttaaaaatacacatttattcatgttaagcaatttgtgcattgtggatagattgtttttctaactagaaagtaaatattaaaaatacttaaaaatatatcaggcactacctaggtttttaggcaatatcagtggactcaggagtttattttacttttagagtagaaaacgttggagagaacatttgcctcaggcattctgagagtggattgagcatttacgttaattattatgtcttactcattatttcagacaggttaaaatgtaacttcttgcartgttctcgtgtaccacgaaggaatttgttcctaccctcatccatcaccagtggttgaaatcagtcagcttaatgggtttctaaaagccatttccaggcagctgtgtttacccttctctccaaatgctcattggggcttcctaagcagaaatatgacaaggaacacttcactcatctgtatttaaatataaaagccttgtgtatataaatataaaagtttagtgtctctttttgttttctctgattttggcctatggcaaaaaagaaaataaaaagtgataacaaacaaaaaacaatttga

SEQ ID NO: 72830 - DNA, 601 bp, Human
ttggtgagttcccatgtatccatcactcagcttcctcccataataacaacttactttatcattgagcttgttaatatcagaaaatgaacactggtacactactgtaagctaaactagggaccttattcaaattttagcaattttaatattaatatgagtatttttttaaaaatacacatttattcatgttaagcaatttgtgcattgtggatagattgtttttctaactagaaagtaaatattaaaaatacttaaaaatatatcaggcactacctaggtttttaggcaatatcagtggacwcaggagtttattttacttttagagtagaaaacgttggagagaacatttgcctcaggcattctgagagtggattgagcatttacgttaattattatgtcttactcattatttcagacaggttaaaatgtaacttcttgcagtgttctcgtgtaccacgaaggaatttgttcctaccctcatccatcaccagtggttgaaatcagtcagcttaatgggtttctaaaagccatttccaggcagctgtgtttacccttctctccaaatgctcattggggcttcctaagcagaaatatgacaagg

SEQ ID NO: 72831 - DNA, 601 bp, Human
ttaattttaaactcagaataagttgccaaaactgtttggtgagttcccatgtatccatcactcagcttcctcccataataacaacttactttatcattgagcttgttaatatcagaaaatgaacactggtacactactgtaagctaaactagggaccttattcaaattttagcaattttaatattaatatgagtatttttttaaaaatacacatttattcatgttaagcaatttgtgcattgtggatagattgtttttctaactagaaagtaaatattaaaaatacttaaaaatatatcargcactacctaggtttttaggcaatatcagtggactcaggagtttattttacttttagagtagaaaacgttggagagaacatttgcctcaggcattctgagagtggattgagcatttacgttaattattatgtcttactcattatttcagacaggttaaaatgtaacttcttgcagtgttctcgtgtaccacgaaggaatttgttcctaccctcatccatcaccagtggttgaaatcagtcagcttaatgggtttctaaaagccatttccaggcagctgtgtttacccttctctccaaatg

SEQ ID NO: 72832 - DNA, 601 bp, Human
gattttaaaaaacgttttattttgtgttaattttaaactcagaataagttgccaaaactgtttggtgagttcccatgtatccatcactcagcttcctcccataataacaacttactttatcattgagcttgttaatatcagaaaatgaacactggtacactactgtaagctaaactagggaccttattcaaattttagcaattttaatattaatatgagtatttttttaaaaatacacatttattcatgttaagcaatttgtgcattgtggatagattgtttttctaactagaaagtaaayattaaaaatacttaaaaatatatcaggcactacctaggtttttaggcaatatcagtggactcaggagtttattttacttttagagtagaaaacgttggagagaacatttgcctcaggcattctgagagtggattgagcatttacgttaattattatgtcttactcattatttcagacaggttaaaatgtaacttcttgcagtgttctcgtgtaccacgaaggaatttgttcctaccctcatccatcaccagtggttgaaatcagtcagcttaatgggtttctaaaagccatttccaggca

SEQ ID NO: 72833 - DNA, 601 bp, Human
tatagaagtatggagtctttctcgggccatatttagtttgctttaataatatcaaaatactaaaagtaagggtgattttaaaaaacgttttattttgtgttaattttaaactcagaataagttgccaaaactgtttggtgagttcccatgtatccatcactcagcttcctcccataataacaacttactttatcattgagcttgttaatatcagaaaatgaacactggtacactactgtaagctaaactagggaccttattcaaattttagcaattttaatattaatatgagtattttttwaaaaatacacatttattcatgttaagcaatttgtgcattgtggatagattgtttttctaactagaaagtaaatattaaaaatacttaaaaatatatcaggcactacctaggtttttaggcaatatcagtggactcaggagtttattttacttttagagtagaaaacgttggagagaacatttgcctcaggcattctgagagtggattgagcatttacgttaattattatgtcttactcattatttcagacaggttaaaatgtaacttcttgcagtgttctcgtgtaccacgaaggaattt

SEQ ID NO: 72834 - DNA, 601 bp, Human
cctaactgatgtattattttgaccagtttgaaattacaatgtcattgttatttcaatactgataaaagaaaaactcagccaaattaaatttaaaggagttgaattgagcaatgaatgttttgcgaatcgggcagcccccccaaatctcagcagattcacagaggctccagcgcagccatgtggtggaagaagacttacagacaaaaaaaaagggaaatgacgtacagaaattggaagtgaggtacagaatggctggattggttacagctcggtgtttgccttatttgaacacagttttaayactcatcagtgtatgaatggttgaagtatggcctctggaatggccaagacttagctatagttacagatgcatactctgaagttacgttttcaattttgtctgactactaagctaggttacagttcatccacaaggactcaaatatagaagtatggagtctttctcgggccatatttagtttgctttaataatatcaaaatactaaaagtaagggtgattttaaaaaacgttttattttgtgttaattttaaactcagaataagttgccaaaactgtttggtgagttcccatgtatccatc

SEQ ID NO: 72835 - DNA, 601 bp, Human
catttcaaccctatgtggtgggtacttttatttttcttattttaaggatatggggaaactgaatcacagaaggtcaataacctgaccaagatcacacaactagtaagcagactctctctctccctctctctctctctctctctctgtgtttaaatttttgtttttttttttcctgagacagggtcttgcgctctcacccaggctggagtgctgtggtgcaatctgtgctcactgcaacctccgtctcctgggttcaagcgattctcctgccttagccttctgagtagctgggattacaggyacccaccaccatgcccagctaatttttgtatttatagtagagacagggtttcaccatgttgaccaggctggtctcaaactcctgacctcaaactcctgacctcagatgatcctcccgcctcagcctcccaaagtgctggcattacaggtgtgagccactgcaccccgccggatcattcttaacatacagatttatacagatttgtttccttttaaaaaatggttactaaatattcaatcattcagaaacaccatgatgtatttaactgttcccatattttgagacattatgctttttact

SEQ ID NO: 72836 - DNA, 601 bp, Human
cgtgtcccgactcccgccagcaggccgtgggggtgatgtggccgccatgaacccaccaaggacaagtagggcctggttttagctgcaaatgcaacaagtctctccgctgagccgcagctgctaccctctgccttctgctcctccgccagggcacggcccccgctgcgccccaaactgagcggcaaagtcagggcccgcggccggatgctcagagctaaaggccgcggaggacagatgtgcttcttcctccttcccgcgtctccccatacaagtactaccccgcacgtcccatcaggcttgyctgtgggccaggattcagggtcctgagccgaaacctaccaggagagagaaggctctggagacctctgtaacagtcgtgcggagaagacaaagtcagctgcgtgcgtctcctccggcgccggctctgcaaggagggaggagggggcggggccccacaaccaccgcagcctcttaggtttctccattgtgattggaaatccgagtaccgcctacccctcccctcggctcgctcaatccccttcaaggacaagggctcaagtgtgcacactccctcccccaccctccagatgaggaggtctcc

SEQ ID NO: 72837 - DNA, 601 bp, Human
atattcaaatattcgaggtaaagatcgtccagccttcataggccacctggttccgtccccctcccccagctactcgggcacgtgtcccgactcccgccagcaggccgtgggggtgatgtggccgccatgaacccaccaaggacaagtagggcctggttttagctgcaaatgcaacaagtctctccgctgagccgcagctgctaccctctgccttctgctcctccgccagggcacggcccccgctgcgccccaaactgagcggcaaagtcagggcccgcggccggatgctcagagctaaagrccgcggaggacagatgtgcttcttcctccttcccgcgtctccccatacaagtactaccccgcacgtcccatcaggcttgcctgtgggccaggattcagggtcctgagccgaaacctaccaggagagagaaggctctggagacctctgtaacagtcgtgcggagaagacaaagtcagctgcgtgcgtctcctccggcgccggctctgcaaggagggaggagggggcggggccccacaaccaccgcagcctcttaggtttctccattgtgattggaaatccgagtaccgcctacccctcccc

SEQ ID NO: 72838 - DNA, 601 bp, Human
taggtgcctttctcctcatcccagcgagtgcaagggcatttctctattaccgtggcaatatattcaaatattcgaggtaaagatcgtccagccttcataggccacctggttccgtccccctcccccagctactcgggcacgtgtcccgactcccgccagcaggccgtgggggtgatgtggccgccatgaacccaccaaggacaagtagggcctggttttagctgcaaatgcaacaagtctctccgctgagccgcagctgctaccctctgccttctgctcctccgccagggcacggcccccsctgcgccccaaactgagcggcaaagtcagggcccgcggccggatgctcagagctaaaggccgcggaggacagatgtgcttcttcctccttcccgcgtctccccatacaagtactaccccgcacgtcccatcaggcttgcctgtgggccaggattcagggtcctgagccgaaacctaccaggagagagaaggctctggagacctctgtaacagtcgtgcggagaagacaaagtcagctgcgtgcgtctcctccggcgccggctctgcaaggagggaggagggggcggggccccacaaccac

SEQ ID NO: 72839 - DNA, 601 bp, Human
agatcttctttgcagaatctttctcaccgtaatcttttaaaaatccaggttttgcttttgaattcctcccctccccccattccccaggcccttactgcagcttgtactgctcgcggtgcgcacaaccatcttttcctcagggcaccggcagcaaagaacagcagatcacgagggcatgcagaagctagagatctccccgagtaaggtctgtggggacaagtctaggacttccttactcggagcacccaaggctggtaaagtaaacgaagcccctaagcatccagaaaagaggccctgcagsaaagaactggcgcatggctcctggaaagaccgtcagagccgggtaaaaataagtgcagcgccaaacgtgctggtcatctaggtgcctttctcctcatcccagcgagtgcaagggcatttctctattaccgtggcaatatattcaaatattcgaggtaaagatcgtccagccttcataggccacctggttccgtccccctcccccagctactcgggcacgtgtcccgactcccgccagcaggccgtgggggtgatgtggccgccatgaacccaccaaggacaagtagggcctggttttagc

SEQ ID NO: 72840 - DNA, 601 bp, Human
aatagttgttctgcacttaagtttattgttgttagatggtctgtttacgaccattttggtatacagggggcccaggaagcagtggaaaatgaaaatgaagaaacagtggctatataaatacagattcgttgttctgatagaccttttaatttagaaaacttcaggaagtacaatttaaaggctcgaaccagattttctttcagatatttctggagaaagtgcttttcttcaatttttccttaaaaggagttttaagaaatgagaagaaaatggtctgcatgatatacaggcctgtgccaatatcagagtgcaggctgtaaggaacaagaacgacaaacggtaaaaatctctgagtcttggtcccttatgtctcctcactgctgtggatataaatcattagaaataaaggagtgccttaatttcaggaacaaagatcttctttgcagaatctttctcaccgtaatcttttaaaaatccaggttttgcttttgaattcctcccctccccccattccccaggcccttactgcagcttgtactgctcgcggtgcgcacaaccatcttttcctcagggcaccggcagcaaagaacagcagatcacg

SEQ ID NO: 72841 - DNA, 601 bp, Human
gtgttttctagataactgaaaaaaagagcaaaacttatcgaaataaacatcaattccatggcaatttatagtacactaaatatataccaccctgtcttcttgaacagagaatacagatggcaaataagccttttcttcataattattacttataattgtagtagtccattgtaatgtccatgattttcacttgttttttactttttatgtcgcatctgaggtcaccatacctgtctcaaactgtaccagagcttcccagtctagtttttaattctaatctgcaatggactaagcaataagyctagtctattaactgtatacgtaaagtaagagttagcaggactcaaagttggaataaagcatctgaatttggagacaactgtgtaacaactattttatcttatagttttttttccaaaaaatatttcctcccatctgtaaggataaattaaaaggagattctttcgcctttacagatcacatttacagtttcctagtggacgttaaagagagaagatgcaatgttgtgcaagtgcctccacaaatagatgaccttaaaatgaaataaattcagacatggcctgcattttaaacaggctca

SEQ ID NO: 72842 - DNA, 601 bp, Human
tctgaaacagtttctgtctaaccatccaaactaaagacccctaaaatgtaaaaaacaaaacaaaaccgaaacctgttggaaaatgaacgatctgtacagtaacaccaaatgtacttgtgccatcagataaccagatgtgttttctagataactgaaaaaaagagcaaaacttatcgaaataaacatcaattccatggcaatttatagtacactaaatatataccaccctgtcttcttgaacagagaatacagatggcaaataagccttttcttcataattattacttataattgtagtagyccattgtaatgtccatgattttcacttgttttttactttttatgtcgcatctgaggtcaccatacctgtctcaaactgtaccagagcttcccagtctagtttttaattctaatctgcaatggactaagcaataagcctagtctattaactgtatacgtaaagtaagagttagcaggactcaaagttggaataaagcatctgaatttggagacaactgtgtaacaactattttatcttatagttttttttccaaaaaatatttcctcccatctgtaaggataaattaaaaggagattcttt

SEQ ID NO: 72843 - DNA, 601 bp, Human
ggatcacattaggagactatcagtctctgaaacagtttctgtctaaccatccaaactaaagacccctaaaatgtaaaaaacaaaacaaaaccgaaacctgttggaaaatgaacgatctgtacagtaacaccaaatgtacttgtgccatcagataaccagatgtgttttctagataactgaaaaaaagagcaaaacttatcgaaataaacatcaattccatggcaatttatagtacactaaatatataccaccctgtcttcttgaacagagaatacagatggcaaataagccttttcttcayaattattacttataattgtagtagtccattgtaatgtccatgattttcacttgttttttactttttatgtcgcatctgaggtcaccatacctgtctcaaactgtaccagagcttcccagtctagtttttaattctaatctgcaatggactaagcaataagcctagtctattaactgtatacgtaaagtaagagttagcaggactcaaagttggaataaagcatctgaatttggagacaactgtgtaacaactattttatcttatagttttttttccaaaaaatatttcctcccatctgta

SEQ ID NO: 72844 - DNA, 601 bp, Human
atcattcttggaagatagggactgattcttctactctgtctcacataaaatgtgttacagcgtactggacatagaatgcatacttaatacatagtgacaatataatggcaatgaataatttttattcaaagtctgcaaaaatatcaacctgaattccttttagggcacctaagaagcttcttggaaagtagatagacacttaatacattgtcgtttcaggggatcacattaggagactatcagtctctgaaacagtttctgtctaaccatccaaactaaagacccctaaaatgtaaaaaamaaaacaaaaccgaaacctgttggaaaatgaacgatctgtacagtaacaccaaatgtacttgtgccatcagataaccagatgtgttttctagataactgaaaaaaagagcaaaacttatcgaaataaacatcaattccatggcaatttatagtacactaaatatataccaccctgtcttcttgaacagagaatacagatggcaaataagccttttcttcataattattacttataattgtagtagtccattgtaatgtccatgattttcacttgttttttactttttatgtcgcatctgag

SEQ ID NO: 72845 - DNA, 601 bp, Human
cattagaattggatttcttccttcagcctatgattccatgtgagtatttagtaggttgttaatatttctggctaaaaacctgtgaacatttgtttaaattagctaatttgtttgtttcctctattaagaatgtatatggaactatgtaaactaagtttgggtctagtattgactcatacttaagcttggataaaaagaataaatggccaattatgaacataatttctactactaatggttatcattcttggaagatagggactgattcttctactctgtctcacataaaatgtgttacagygtactggacatagaatgcatacttaatacatagtgacaatataatggcaatgaataatttttattcaaagtctgcaaaaatatcaacctgaattccttttagggcacctaagaagcttcttggaaagtagatagacacttaatacattgtcgtttcaggggatcacattaggagactatcagtctctgaaacagtttctgtctaaccatccaaactaaagacccctaaaatgtaaaaaacaaaacaaaaccgaaacctgttggaaaatgaacgatctgtacagtaacaccaaatgtactt

SEQ ID NO: 72846 - DNA, 601 bp, Human
tttaaagatataataaaattccaaggtgcccaaagaaactgtgtacacatgctgaacttctctatcatctatggtgttcttgaaatgtacctttcccagaatgctgatagcacacgccataccaacttgtccaacacccactacagtgatcttattgtttggaactgttgcctcttcttccgcaactggtgcaatgagtttttccttaagagttgccattttgcactgcaaggaaagaatcaaaacattacacatatatctgcatatgaaatccaaatagaaatcatccttaaaatgttastgttgcaatttcgaactgaagtacaacttaaaatgagcctaatgatattctagaaagcagaatatattttaaagaaccatgagacccggctgggcatggtggctcatgcctgtaatcccaacactttgggaggcagaggctggtggatcacgaggtcaagagattgagaccatcctggccaacatggtgaaaccccgtctctactaaaaaaaagaaaattagctgggcatggtggtgcaagcctgtagtcctaactactcaggaggctaaggaaggagaatcacttgaacccaggaagtg

SEQ ID NO: 72847 - DNA, 601 bp, Human
aacaggcagggaggatttgtgaggcctcatgggattttatgtatgtgtgtagcatatgtgcactgtaaaatgactggagagttttaagtagcggagccactagttttacaaaagctctctatggttattatataagcaatgggctgcagagagtgggcaaaagtagaagccaaaaataatcaagtcttcatatggtgggacactgtacaaaggggccttagtgggcttcgcgaatctggctaatgcatgtccctcctcaacctctccaatgctatgcttttatttaacttctgggggcaargtacaccatctatgagctcaaaaaggccagatctggcacttactatctgtgtgatcttaggtgtttggtttttgttgatttcagccatatgatatagatgacaatatcctctgacaggttacagaaaggaataaatgaagtaatatacaaacaccaacatgcagttatattcctttctctattaagctagtgggatttctaatctttaccatgtattaacataatttggaaccacttttatctttaaccgttaaaataatatttagacattcttaattggtaaaagcatctttcaacaag

SEQ ID NO: 72848 - DNA, 601 bp, Human
gtgcctggcattatcctcctactcaggtatacagttacgataaagtctctgctgccatggaacatatcaggaaggaaataggaattaaacaaacaacaaatcaggctaatctctgaaggtagaagtgctctgaagggcataagacaaggagatgttgaagctactgggaaggaagtttattttatatcggaaggcagggaaggcctgcctgcaaaggcatgcatttgcagtaagatctgaatgataagaaggggtcaaccctgtggcctagagaagaacattccaggtgaagggaaatgcragcaaaagagtttaagcaaaaatgagattggcatttgggaggcagaaagcaaatagaagagatgaagtcagagatggtaccatcatgttgcactggcaggtctgctgccttggtgtgtatggtgcccctgcagttgtgtgctccattgctctgctctgagaaacaggcagggaggatttgtgaggcctcatgggattttatgtatgtgtgtagcatatgtgcactgtaaaatgactggagagttttaagtagcggagccactagttttacaaaagctctctatggttattatataagcaa

SEQ ID NO: 72849 - DNA, 601 bp, Human
aagctaaggatttatgataatcttgcctcaaagctcttcatgacccttacaacatgatgagttcgacattcagatcctcctcttggtagttaaaatgcagagtctgagatggataatgggataaaagtaaagtctggtagtagaagatgtaaaaaaatcagaagccatgaccaagtttgacaaaacatgagtgaagcttacaagtaatagcaggagtattcatttatttatcatataagtgcctggcattatcctcctactcaggtatacagttacgataaagtctctgctgccatggaayatatcaggaaggaaataggaattaaacaaacaacaaatcaggctaatctctgaaggtagaagtgctctgaagggcataagacaaggagatgttgaagctactgggaaggaagtttattttatatcggaaggcagggaaggcctgcctgcaaaggcatgcatttgcagtaagatctgaatgataagaaggggtcaaccctgtggcctagagaagaacattccaggtgaagggaaatgcgagcaaaagagtttaagcaaaaatgagattggcatttgggaggcagaaagcaaatagaagaga

SEQ ID NO: 72850 - DNA, 601 bp, Human
tttgttatatactgtgtttgtccacaagaacatggctacagttgactgaagcaaacataaacactcaaaccaaagacagacttagaagctaaggatttatgataatcttgcctcaaagctcttcatgacccttacaacatgatgagttcgacattcagatcctcctcttggtagttaaaatgcagagtctgagatggataatgggataaaagtaaagtctggtagtagaagatgtaaaaaaatcagaagccatgaccaagtttgacaaaacatgagtgaagcttacaagtaatagcaggastattcatttatttatcatataagtgcctggcattatcctcctactcaggtatacagttacgataaagtctctgctgccatggaacatatcaggaaggaaataggaattaaacaaacaacaaatcaggctaatctctgaaggtagaagtgctctgaagggcataagacaaggagatgttgaagctactgggaaggaagtttattttatatcggaaggcagggaaggcctgcctgcaaaggcatgcatttgcagtaagatctgaatgataagaaggggtcaaccctgtggcctagagaagaa

SEQ ID NO: 72851 - DNA, 601 bp, Human
gctgaggcaggcagatcacctgaggtcaggagtttgagaacagcctggccaacatagtgaaaccctgtctctactaaaaatacaaaaattagccgggcatggtggcatgcacctgtaatcccagctactcaggaggctgaggcaggagaatcacttgaatccgagaggcagaggttgcagtgagcaaagattctgccactgtgctccagcctgggtgacagtaagactctctctctcaagagaaaaaaaaaaatatacacacacacacacacacacacacacacacacacacacatatatrtctctctctccaagtgtttagtatgcataaaattttgcgggaggaaaaggtataacctttctcaaataattaactaaatggatatgtgccatctattcaatagtttgtgtttcttcccctctgaaatgctacttctacattattattaaatactatttgagcatgtttctggctgaaataccaaaggtggcttgtacaaataccaaattttcattatgttttacttttaagcccagtcttgcactgcaaaaactactttgcaatgtgtcgttgtacctaccttgctcctcctaagagctt

SEQ ID NO: 72852 - DNA, 601 bp, Human
ggctgaggcaggcagatcacctgaggtcaggagtttgagaacagcctggccaacatagtgaaaccctgtctctactaaaaatacaaaaattagccgggcatggtggcatgcacctgtaatcccagctactcaggaggctgaggcaggagaatcacttgaatccgagaggcagaggttgcagtgagcaaagattctgccactgtgctccagcctgggtgacagtaagactctctctctcaagagaaaaaaaaaaatatacacacacacacacacacacacacacacacacacacacatatayatctctctctccaagtgtttagtatgcataaaattttgcgggaggaaaaggtataacctttctcaaataattaactaaatggatatgtgccatctattcaatagtttgtgtttcttcccctctgaaatgctacttctacattattattaaatactatttgagcatgtttctggctgaaataccaaaggtggcttgtacaaataccaaattttcattatgttttacttttaagcccagtcttgcactgcaaaaactactttgcaatgtgtcgttgtacctaccttgctcctcctaagagct

SEQ ID NO: 72853 - DNA, 601 bp, Human
ggggctgaggcaggcagatcacctgaggtcaggagtttgagaacagcctggccaacatagtgaaaccctgtctctactaaaaatacaaaaattagccgggcatggtggcatgcacctgtaatcccagctactcaggaggctgaggcaggagaatcacttgaatccgagaggcagaggttgcagtgagcaaagattctgccactgtgctccagcctgggtgacagtaagactctctctctcaagagaaaaaaaaaaatatacacacacacacacacacacacacacacacacacacacatayatatctctctctccaagtgtttagtatgcataaaattttgcgggaggaaaaggtataacctttctcaaataattaactaaatggatatgtgccatctattcaatagtttgtgtttcttcccctctgaaatgctacttctacattattattaaatactatttgagcatgtttctggctgaaataccaaaggtggcttgtacaaataccaaattttcattatgttttacttttaagcccagtcttgcactgcaaaaactactttgcaatgtgtcgttgtacctaccttgctcctcctaagag

SEQ ID NO: 72854 - DNA, 601 bp, Human
ggggggctgaggcaggcagatcacctgaggtcaggagtttgagaacagcctggccaacatagtgaaaccctgtctctactaaaaatacaaaaattagccgggcatggtggcatgcacctgtaatcccagctactcaggaggctgaggcaggagaatcacttgaatccgagaggcagaggttgcagtgagcaaagattctgccactgtgctccagcctgggtgacagtaagactctctctctcaagagaaaaaaaaaaatatacacacacacacacacacacacacacacacacacacacayatatatctctctctccaagtgtttagtatgcataaaattttgcgggaggaaaaggtataacctttctcaaataattaactaaatggatatgtgccatctattcaatagtttgtgtttcttcccctctgaaatgctacttctacattattattaaatactatttgagcatgtttctggctgaaataccaaaggtggcttgtacaaataccaaattttcattatgttttacttttaagcccagtcttgcactgcaaaaactactttgcaatgtgtcgttgtacctaccttgctcctcctaag

SEQ ID NO: 72855 - DNA, 601 bp, Human
gccaggggtggtggctcacgtgtgtaatcccagcattttggggggctgaggcaggcagatcacctgaggtcaggagtttgagaacagcctggccaacatagtgaaaccctgtctctactaaaaatacaaaaattagccgggcatggtggcatgcacctgtaatcccagctactcaggaggctgaggcaggagaatcacttgaatccgagaggcagaggttgcagtgagcaaagattctgccactgtgctccagcctgggtgacagtaagactctctctctcaagagaaaaaaaaaaatattcacacacacacacacacacacacacacacacacacacatatatatctctctctccaagtgtttagtatgcataaaattttgcgggaggaaaaggtataacctttctcaaataattaactaaatggatatgtgccatctattcaatagtttgtgtttcttcccctctgaaatgctacttctacattattattaaatactatttgagcatgtttctggctgaaataccaaaggtggcttgtacaaataccaaattttcattatgttttacttttaagcccagtcttgcactgcaaaaactac

SEQ ID NO: 72856 - DNA, 601 bp, Human
ggccaggggtggtggctcacgtgtgtaatcccagcattttggggggctgaggcaggcagatcacctgaggtcaggagtttgagaacagcctggccaacatagtgaaaccctgtctctactaaaaatacaaaaattagccgggcatggtggcatgcacctgtaatcccagctactcaggaggctgaggcaggagaatcacttgaatccgagaggcagaggttgcagtgagcaaagattctgccactgtgctccagcctgggtgacagtaagactctctctctcaagagaaaaaaaaaaatayacacacacacacacacacacacacacacacacacacacatatatatctctctctccaagtgtttagtatgcataaaattttgcgggaggaaaaggtataacctttctcaaataattaactaaatggatatgtgccatctattcaatagtttgtgtttcttcccctctgaaatgctacttctacattattattaaatactatttgagcatgtttctggctgaaataccaaaggtggcttgtacaaataccaaattttcattatgttttacttttaagcccagtcttgcactgcaaaaacta

SEQ ID NO: 72857 - DNA, 601 bp, Human
agattaactgcaaaagcagtattcttattatggatcaaggtcacttagataccaagaataccactgttgaaagcttgcttaatgtatcactaaaatggctttaaaaaacctatttatttttactctactcctgtgacagacttaaaaaaaaggcttttaatctaaagtcctgtgtggaccagacacagccatatattctgcctcttcctcctcctaagtaataaattactaccaccagtgccttaatatttgatggtttcatttttatatccaagtgttggccaggggtggtggctcacgygtgtaatcccagcattttggggggctgaggcaggcagatcacctgaggtcaggagtttgagaacagcctggccaacatagtgaaaccctgtctctactaaaaatacaaaaattagccgggcatggtggcatgcacctgtaatcccagctactcaggaggctgaggcaggagaatcacttgaatccgagaggcagaggttgcagtgagcaaagattctgccactgtgctccagcctgggtgacagtaagactctctctctcaagagaaaaaaaaaaatatacacacacacacacacacaca

SEQ ID NO: 72858 - DNA, 601 bp, Human
ttagattaactgcaaaagcagtattcttattatggatcaaggtcacttagataccaagaataccactgttgaaagcttgcttaatgtatcactaaaatggctttaaaaaacctatttatttttactctactcctgtgacagacttaaaaaaaaggcttttaatctaaagtcctgtgtggaccagacacagccatatattctgcctcttcctcctcctaagtaataaattactaccaccagtgccttaatatttgatggtttcatttttatatccaagtgttggccaggggtggtggctcaygtgtgtaatcccagcattttggggggctgaggcaggcagatcacctgaggtcaggagtttgagaacagcctggccaacatagtgaaaccctgtctctactaaaaatacaaaaattagccgggcatggtggcatgcacctgtaatcccagctactcaggaggctgaggcaggagaatcacttgaatccgagaggcagaggttgcagtgagcaaagattctgccactgtgctccagcctgggtgacagtaagactctctctctcaagagaaaaaaaaaaatatacacacacacacacacaca

SEQ ID NO: 72859 - DNA, 601 bp, Human
actgaatttagctgcatccgcagcactgaatatcccccaaatggagaggcgtgatgtgtgactaagtactggtgctattgtttggcttaaataaatctccctctgtattcacatattttatacaatgaatttaccatatatatatttcacttaagctgtaagtatgtttaaaatgtttgaaacagcaaggtttagattaactgcaaaagcagtattcttattatggatcaaggtcacttagataccaagaataccactgttgaaagcttgcttaatgtatcactaaaatggctttaaaaaacctatttatttttactctactcctgtgacagacttaaaaaaaaggcttttaatctaaagtcctgtgtggaccagacacagccatatattctgcctcttcctcctcctaagtaataaattactaccaccagtgccttaatatttgatggtttcatttttatatccaagtgttggccaggggtggtggctcacgtgtgtaatcccagcattttggggggctgaggcaggcagatcacctgaggtcaggagtttgagaacagcctggccaacatagtgaaaccctgtctctactaaaaataca

SEQ ID NO: 72860 - DNA, 601 bp, Human
acacagtaaacactatataaatgcttgataactttagtttattgtataagttaagatttataaagtcactgtggcaaaaatatacattttccaatcattgtaacaaatctgtaaacatatttccaaacacataaaatcaggaaacaataaaagtgaaagaacaaaatatatctcaattgtaaggtcccacttgccactgtcacctaacataatcaactaactaataaaagggataagagtatcttgcctgacagttttttcagcacaaattgtagctcttaaaacccataaaggccctggyacttgagaagcagcaggagtaactctagctgagtattggaaaattaggatttaatgcaattgacacccaatcattagaagacctcggaccagttacactatctgggtgagccatagttttctcacttgtaatataaaggtatatgttaattgaaattataaagactctttcaacttttttaaggttccttttctccacatatagttcaaattcctgaaaaaaaaaattactaaaattgaacaaaatgattctatatttgagacatcagttagtcttgttattaaaacttaaacactgtta

SEQ ID NO: 72861 - DNA, 601 bp, Human
tactgctctgtctctaactataatcttgggcaaattatttaccctttattgccttagtgttccctttttgagtgttaaatgaattaatatatatgtaaaatgcttaaaactgtaagcactacacagtaaacactatataaatgcttgataactttagtttattgtataagttaagatttataaagtcactgtggcaaaaatatacattttccaatcattgtaacaaatctgtaaacatatttccaaacacataaaatcaggaaacaataaaagtgaaagaacaaaatatatctcaattgtraggtcccacttgccactgtcacctaacataatcaactaactaataaaagggataagagtatcttgcctgacagttttttcagcacaaattgtagctcttaaaacccataaaggccctggtacttgagaagcagcaggagtaactctagctgagtattggaaaattaggatttaatgcaattgacacccaatcattagaagacctcggaccagttacactatctgggtgagccatagttttctcacttgtaatataaaggtatatgttaattgaaattataaagactctttcaactttttt

SEQ ID NO: 72862 - DNA, 601 bp, Human
ttgaattaggttttatacatagaatatgcaaacatacactatgagaaaattagatatttgtaagtaacaagtacttatttaattttattatatacgtattttattgaacactgctctatttaaatacactttaataaattttgatatatgagtcttcaaattaaattgcttttaattgtggttcttaatggattactttctatgaaattttaagttgcttaaagacttttagttaggaagaaatttcaggtggtagccaacttatgaggtcctgggtaatagttagagaccattaaaaggsaagatgcttggaatacccaagaattgctaaaaaaaaaaaaaaaaatacaatttccaaaacactttaccagttcgtgtgggtaatttattcacagggtcaatttaactatataactaattatattaaacataccttaatgtcagtttttaaacttttaatttcaaaaattttgtacatacacaaaagtagatagaataaacaaattcctatgtatgtacccaaagactcagtaattacccaattattgacacacttgatttacactgacttgtggaaaatgagtcagttgtcttacaaaat

SEQ ID NO: 72863 - DNA, 601 bp, Human
ttgaagcttcagtgagctatgacagcggtactactctccagcctgggtgacagagcaagaactaatctctaaaggggggaaaaaagagaataatcaaaggtccgatgttccaacagaaagaattgtagaaaacttgataggcctgaactcattccctaatctaattttcatcacttacaggtccacatttccccaatacttatgttttgaattaggttttatacatagaatatgcaaacatacactatgagaaaattagatatttgtaagtaacaagtacttatttaattttattatataygtattttattgaacactgctctatttaaatacactttaataaattttgatatatgagtcttcaaattaaattgcttttaattgtggttcttaatggattactttctatgaaattttaagttgcttaaagacttttagttaggaagaaatttcaggtggtagccaacttatgaggtcctgggtaatagttagagaccattaaaaggcaagatgcttggaatacccaagaattgctaaaaaaaaaaaaaaaaatacaatttccaaaacactttaccagttcgtgtgggtaatttattcacag

SEQ ID NO: 72864 - DNA, 601 bp, Human
ggctcgagttaatcacattgtagtttttaaatttctacagcctagagctcactagtcacaggtcttttaggtccttctggatgtcccacagggtatctgcacttttcttgagctgagcaacctcatcatcctttagcttctggttgataacgctggttaatccccgggcattgaggatacatggaaggctcaggaagacttcattctcaatgccatacatcccctgccagaacaacaaagcatcgagattaagacatgaaactgtaagtaaaaatgatcaaagacaggaggctgaggtgggaggactgtttgagcccaggagtttgaagcttcagtgagctatgacagcggtactactctccagcctgggtgacagagcaagaactaatctctaaaggggggaaaaaagagaataatcaaaggtccgatgttccaacagaaagaattgtagaaaacttgataggcctgaactcattccctaatctaattttcatcacttacaggtccacatttccccaatacttatgttttgaattaggttttatacatagaatatgcaaacatacactatgagaaaattagatatttgtaagtaacaagt

SEQ ID NO: 72865 - DNA, 601 bp, Human; identical to SEQ ID NO: 37638

SEQ ID NO: 72866 - DNA, 601 bp, Human; identical to SEQ ID NO: 37639

SEQ ID NO: 72867 - DNA, 601 bp, Human; identical to SEQ ID NO: 37640

SEQ ID NO: 72868 - DNA, 601 bp, Human; identical to SEQ ID NO: 37641

SEQ ID NO: 72869 - DNA, 601 bp, Human; identical to SEQ ID NO: 37642

SEQ ID NO: 72870 - DNA, 601 bp, Human; identical to SEQ ID NO: 37643

SEQ ID NO: 72871 - DNA, 601 bp, Human; identical to SEQ ID NO: 37644

SEQ ID NO: 72872 - DNA, 601 bp, Human; identical to SEQ ID NO: 37645

SEQ ID NO: 72873 - DNA, 601 bp, Human; identical to SEQ ID NO: 37646

SEQ ID NO: 72874 - DNA, 601 bp, Human; identical to SEQ ID NO: 37647

SEQ ID NO: 72875 - DNA, 601 bp, Human; identical to SEQ ID NO: 37648

SEQ ID NO: 72876 - DNA, 601 bp, Human; identical to SEQ ID NO: 37649

SEQ ID NO: 72877 - DNA, 601 bp, Human; identical to SEQ ID NO: 37650

SEQ ID NO: 72878 - DNA, 601 bp, Human; identical to SEQ ID NO: 37651

SEQ ID NO: 72879 - DNA, 601 bp, Human; identical to SEQ ID NO: 37652

SEQ ID NO: 72880 - DNA, 601 bp, Human; identical to SEQ ID NO: 37653

SEQ ID NO: 72881 - DNA, 601 bp, Human; identical to SEQ ID NO: 37654

SEQ ID NO: 72882 - DNA, 601 bp, Human; identical to SEQ ID NO: 37655

SEQ ID NO: 72883 - DNA, 601 bp, Human; identical to SEQ ID NO: 37656

SEQ ID NO: 72884 - DNA, 601 bp, Human; identical to SEQ ID NO: 37657

SEQ ID NO: 72885 - DNA, 601 bp, Human; identical to SEQ ID NO: 37658

SEQ ID NO: 72886 - DNA, 601 bp, Human; identical to SEQ ID NO: 37659

SEQ ID NO: 72887 - DNA, 601 bp, Human; identical to SEQ ID NO: 37660

SEQ ID NO: 72888 - DNA, 601 bp, Human; identical to SEQ ID NO: 37661

SEQ ID NO: 72889 - DNA, 601 bp, Human
tgacaaggagctgaaaatatctgtcaaactgcaaatacataagaggccctcaatagtataaatcattttgaatattgtattttaaaacatctttccttgggaaaatgggtcctagtaaaagatgcattttaacagttcactaagcatttgtgccaagtgcctattcttagcacctgaataagaagtgactgtcacacagctgttttactgacagtcactgagctttgcctcaaaggtaacattgtagtcagagaacaattctcgacttactgaattaggagatcaccctcaacacaaaagrcacaagacagacacaaacaagcagtcgtgcacacaaaatacccagggcattacctgaatcagtgtgtaaagatatagtctgtccgcccccacccccgcacccccacgacgagtttaaaaaggaaagaaaaaaggtacctactcttcctcgtagtgcagggaaaaagattcaggaaggcaaagttctaccgaatccatgtgcgaccggcaaccattatttgtgcaccccagctataaatcaaagtttccttgacagagcacagtgcaattaacacaaatgttctcctagtgacaagcctat

SEQ ID NO: 72890 - DNA, 601 bp, Human
tagctccaaacacgaatcttaaaacacgaaacttaaattttcaatgtctggacttcagtgatcaggctgaaatttactaaactgttccctcctcgccttgtctgttttggagtgtttcagttgcctttccttcttccaacagctgtgacaactgttaaaacagtcagtaaaattaagtccgctctataatcctgtagtcaatgttacattttaatcagaggttgaaagggattcatgtgatgagcacactcatttagaatgattagactgacacatatgtcaaaatgagcagatatattaktttcatctatttatgctatcagctattactgctattaaatgtgaaacaagctttcaagtattatgttctttaatgtgctggcacatttcctaaaataaaaaaatacatagttagaggttaacattttaagctctcttaatggtggtcaataaatggtatgaatctttttaacagcctccaaagcagaaactgtccaatatttgcccctaaaactgtataactctggtttcatttctgtgtatacacacacgtgatggggtttaacccggtacaattactatgaatattaatagcatgtat

SEQ ID NO: 72891 - DNA, 601 bp, Human
aaggctgcaggtgttttcaagattgtagggaaaaaaaataaaaaacaaaacatgaagaaaagtcatgtgagctccaagtctagagtttaagtattcttacttgaaaaaataaacttaaagtgtctgttcagagttctcaaataatatcacatctaaagtgacttggccaagctcttatcattccctaaaaaaaaggcatcccctctgatctcggcttttttgttgttgttactgttactgtataaattttttctttctgcctattttatcacctataatttgacattatggaattactttrggattgtcttgttttttaattagtatagattttaaaaagaagagatgagaaaaagaaaaaacatgaaaaccctgaaacagaaagagtgaaacatacaaaataaaacttgtgtagctccaaacacgaatcttaaaacacgaaacttaaattttcaatgtctggacttcagtgatcaggctgaaatttactaaactgttccctcctcgccttgtctgttttggagtgtttcagttgcctttccttcttccaacagctgtgacaactgttaaaacagtcagtaaaattaagtccgctctataa

SEQ ID NO: 72892 - DNA, 601 bp, Human
ttttttataattaaaatataaatgtacttttcagttcttcttttagaatttaatctaatctgaagtaggctccctgtaagttttggcaatttaataggtatttaaaattttttaaatgccaaaaccaagtgttttccttttctatattgtttgaaagaattccatatagccataggttgtatttctaattgttagtgttgcgtggtttatagctacattcaaatgcacatatagatctttgccagtatactgaaatggactttaactgaccagaaagaagccaatttctttaaaactgtamcttttctttcattgttttgcctcagtaagttaccttccaagtatacatgcattgtcataaattaaaatgacatatcatttgaagaaatcaaaacatcaaaagcaagtttccctcaaacatttaaaattatttttaaacattataaggggaaatttgtgtatatacacacatatatacaacactcaataaatctaaactctctcaattcaatagttttggataattgagtggaagatacttttggaaaatcctggataattgattagaaaacacatttggaaaatactgagaaatattgtc

SEQ ID NO: 72893 - DNA, 601 bp, Human
tttggatgcagttctggatatatgactaatatgcatttactattattttcaaagcaacataagttcttataaatattgttacataataactgccttgaaaagtatccttttaagatattttaactcacattgtgagtatgaaaaaaatacatatttctttaatgaatcctttgttcaaattctcaaaagccatgaaaaatgagtaaaatctttctagagtagatgaaaaaggaattatcatttacaaaggtattgttgtgatcatggaaaaaaagaatttagtgtgcttctgcctattttctgtacataagttcttaatttatattttaattttcttttgtttttgcatattgaatatgccatacaaaaagaaagcgtaagatttttttgttttccagaaaacatatgcaaagtgcaacaaaaagaggtgtcccctgataaaggtggattgtccgtgttcctttggattctccacttcttcaagtttttatttacttcataaataagagccactgaggttcaccacttcagagacttttgtctttctaaacctattttactttcaaggtagtagaaaaatttgaatgaacctaatttattt

SEQ ID NO: 72894 - DNA, 601 bp, Human
tatggagggcaaagggcaatcaattgaacaacctcacagtttattttttttctctttaatgagtacctcagtctataattttttatatgacctgttattttggttaattttggatgcagttctggatatatgactaatatgcatttactattattttcaaagcaacataagttcttataaatattgttacataataactgccttgaaaagtatccttttaagatattttaactcacattgtgagtatgaaaaaaatacatatttctttaatgaatcctttgttcaaattctcaaaagccaygaaaaatgagtaaaatctttctagagtagatgaaaaaggaattatcatttacaaaggtattgttgtgatcatggaaaaaaagaatttagtgtgcttctgcctattttctgtacataagttcttaatttatattttaattttcttttgtttttgcatattgaatatgccatacaaaaagaaagcgtaagatttttttgttttccagaaaacatatgcaaagtgcaacaaaaagaggtgtcccctgataaaggtggattgtccgtgttcctttggattctccacttcttcaagtttttattt

SEQ ID NO: 72895 - DNA, 601 bp, Human
ttatagttttaaaaaaagagaaaatgagtgcatgctccctcgcatgccttctctgcacctaaacagagccatttacatagcccattgaacactgtttagtaaacaaggcgggtacaagtccagagtggcttctatcttccagtcctgccgtctttttaaaaaacaaggcaggggttctgtttttagtacacacttcggttcagtgttaatcctgttttatgttgttcacacctgctgctgactagcagcctgctgatgggctggggctcacgctgctcagagaaatcccactaaaactaaygaagaagctggacaaaagctactgtacagagctggaaacaaagcctgcccagggtccagaagacaagagaaacaaccccacaaaatctttcctgtcatttgcagataaggctccaatgtcccaagtttgcctgccactaaacaaaaaaaggcaaccaattgctttttttgaaaagtctgaccaccattgggttatttacattcctgagctttttatgtcttttggtaaaattgatgcaaatagtttttaaaaatgctgttgtaatcaggtgtacatgtgagtcactactttgagtcctta

SEQ ID NO: 72896 - DNA, 601 bp, Human
ggcactatacatgacgaagaatgcatccattttaaacagtccacctcagctttaaaaagtgaagagaattcaaagggagtgatatgggaaaactcagaaagactatggcgggggtggggggctggataaagcatgttcacaaatattttgcaaaaaaacccacaaacgaagcaaaaacataggtgagatgactcagctcatgtctgcagtgcttacataaaggtcctttgcatatatggagtggaaaagataaaaaccatatgtttacagccttttgatgttgcagaaaatgctggctgtscccacgttgcaatagttctttgtctgatatttctggtgtcatttctaaaagtgtggcatttcccttccaaagtttgcaatcctgtaatactataacacacaaaaaaactgcattgcatgtcacttgcaattggaaacttacaacatcatgatgccaagctatcctgagacaagcgctcagtaacatgtagtataaattttaattgagcataaacacttgacaaaaactctctcgagatatttctggcatattccgattggcaatggtgccctgataccatgattttaatccttctataaa

SEQ ID NO: 72897 - DNA, 601 bp, Human
cagtgtctatttcagtataaatgacttgtttgactctagtttacaatcgctttaagtatttcttttttgggctaatcaagtaggtacctgtccatgtggtttatctaggcacaaaacacacagttacatagagatttacacgttttaagactttcatttaatagttagtatatattaatatatatgcaaaatccaaaacaatgctttgtacatggtagccaactaaaatattctgaatggccacataaacgaatataattgacatagaaattattttctatttttttatatctagtaaggaaaaaaaggacacaatctgtgtaaattattcactaaaaagtcaaatgtgttatccccactataaaaaaatctgtttccaaaaggacacacagttgttttattttgctaaatcaatacccaaaaatattacttttcttcagttacacttccgttgaaagtcccaaagattccctacctggaattgcccatatttgaagtgcaaaacaggctgagcattatctaaatctagataaaactcattggtttgtaatctgcacaatgatctatacatctaaatctatatgcaaatcgaatgctttca

SEQ ID NO: 72898 - DNA, 601 bp, Human
gcaaatacaactaggttttaatctatatgttttaagaaaacaaaggaatctggcattatgcctggaccagctgtgacatcccaaaacaaaagatcaccaggccatgctgactgtcttcagtgcttaagtaaataccaccctatttattagccttgctttggggaaaccccaaatggtcaccttacctcctgacttatgaatccataaaaatgcccatgatttattattgcatctcccttcttccctatgaatttgataatgaagttctttatgggaggctattaagaagcaacatggatgytactatttgctacttatcccatataattaaaaacaccataactgctattagagagcagtatttaaagtagccagactatcataaatatggctgatttgactaaactgtcaatggcaaatttcaagaagaaccactaaaaggagatttacttttgaaatatatattacaaaaaggcttttattcacatttgttttatttatgttttggttctaatgaaatcactagacttaccaatttgctagataattataaagtcagaattcttaaaagcaagtagttatcgctaattaattttcttct

SEQ ID NO: 72899 - DNA, 601 bp, Human
ggcaatattatcacacattcagcaaatatacagtagcaagatgtttccgtgacaaattaagtactttctaagcattttatcagataaataaaacatcaccacaggatgataaaatcagctcattcagttgatttaacctgtccttcaagaaactcacctgaaatagattaaggaccacctctcagacacacacatacacaaacacacacacttacgcactcatttgctcactcttaaacatataagctggactctcgtactactggtaacaaggttcgtaaaggcctcctaacatcagagycagatagtactgtttactggattagtatgaaagatggtattcctatgcatttcaaaagataggagaaactgaagatgagaacctcttcaaatatctttaatctcagtgtaatctgctagagtctacactttctcctttagtacccttagtaggtgacttatagttttattttgacatttcctttaatatcagaaaatattatattttcatagtcgtattcttaccctaacactctaggcagagaagaaaccagtgagtggttaggtttctgtctttactttgctttccccctttgctaat

SEQ ID NO: 72900 - DNA, 601 bp, Human
ggagcacataggtccccatgcaaactctgctcataactaagcctctttttttatgggaaaatcacaaaccaaacagtaagcaacggtgagtatagaggcattaacttttcagattaaaaaaacaatatgatggtttcgatagtaagaaataaactaacggggtgtcagagaaagaaatggaaatgaagtaaggagtttggtttcatcacttcagaaacctctatcgaagagatgcctctctccagtgtctaaggaaccaaagcgtctgtgcctcagggaactgagctttaggaaaaacaayctcttgaaaaatggcgactttcatcctagcctacgcccacatgtacatatttctctccactctccaaattttggctgacagattagccagttcaggttataatgctgactgatgttgtgaactttattcattcatctatctttctatccctggaacctcacgaggctgagggctgcgtgctgaggccatcgccagcacgtacataaggtcatctgcttatttacctgcattgctgtatcaaatatgctgtcacatttaacctatagagctactaaaatatctgccacaagaaaacaaata

SEQ ID NO: 72901 - DNA, 601 bp, Human
atcttctaaagatttttttattctttaattttcttaaacaactgtatactcagtaagtgccatgatgtacctgtcttgactatttgaccccaaaataacaaaactgtgaccaaattaaaataaaaacaaaaaaggtaacttagtccttcataaatgcccaagaacaaagaataatagtgttgaaaagtcaaaattacagagcaacttaaaaaatactaagattatttatatcataggataataaaacatactaagattatttatatcatagttactccctaattggtacagaattagagtsttctaataaggagaagctgacttatttcacaccatggaaaactggagctagatattagaacttcctggccaaatagttgctgtcattaattaactgtattaaaatgtataattaatataaattaattaactcactgtgcctcagtcatctgttaaataaaatggggtactaatacctatcctatctaatgtacagaaatgttgagactcacaagataaaataggtatcaaatcttttgaaaagcttaaagcattatgcaaaattaaagtactactacaaatttgtagaataaaatatctt

SEQ ID NO: 72902 - DNA, 601 bp, Human
gttggccaggttggtcttgaactcttggcctcaagcaatcctcttgtcttggcctcccaaagtgcaaggattagaggcatgagtcaccacatccagttttaacatcctttttaatgtgcagttgtccctcagtatccatgggggattcattctaggacccccgtcagataccaaagtctacagatgctcaagtcccatatataaattgatgtagtatttgaatacaacctatgcacatcttcccatatactttaaatcatctctggattattcgtaatacctaatacaacgtaaatgctaygtaaatagttgttatactgtattgtttagggaataatggcaattaaaaagtctgtacatgttcagtgcagatacaatcatactttttttctaatattttttatctgcagttggtcaaatccacagatgcagagcccacagacatggagaaatgactgtacaaacttatgtttccatccttcctctatgaattaattgttttatacttctatttaaccctgttcctgggtagttgagtaaatgaacaaaccatgaattcacacacaaaaaaagttgtggactttaaatgttggatcacaca

SEQ ID NO: 72903 - DNA, 601 bp, Human
gataagtaacacatggctgtatacatgcaatgcttaacgctttgtaagtccccatgctaatcagcttttcacactgcttttccttctctctggaattcaacttccttgcccttggcaacactttctgcgcaacttctattcatcagtaaaagtacaattcggttattatttcctcagcaagtctttcctgacactccttcctttaggctcataatactatgagcctatttctataattacagttaacatctttttttgtgtgtgtaatttaaaattttttggtgtgtgtaattaaaaaaawtttttatgtgtgtaattaaagaaaaatagggatggggtcttgcgatgttggccaggttggtcttgaactcttggcctcaagcaatcctcttgtcttggcctcccaaagtgcaaggattagaggcatgagtcaccacatccagttttaacatcctttttaatgtgcagttgtccctcagtatccatgggggattcattctaggacccccgtcagataccaaagtctacagatgctcaagtcccatatataaattgatgtagtatttgaatacaacctatgcacatcttcccatatacttta

SEQ ID NO: 72904 - DNA, 601 bp, Human
aaaacaagctagatgcaaaagaatatatactgtaaaattctgtgatgttccagaacaaggaaaactaatcatcataatagaaatcacagtggttttctggagcaaggagtgaggattgcctagagaggaacatagggaagctggtggttttatgaattatatgggtcatatttgttaaaccccatctaactgcacagaaaatatgtcttgttgtaaactgtatctaaaaggtaatctaaaaaaaattttaaacaatgggttaaacataataactatgcattaccagaagttttccttgatycctatgccctgtaccagatcgtaaataaccagatctagaatattcttttatcagtgcctacttctacctctcatttacacacaatggactagggaagtgagagaactttaaaggactcccagaattacaggcaaagcccagttcaaagtccagatttccatctcttaggccagctcttttcttaactaaggcctacagtgaaaaatatttcactgacttgaatgataaaatgcttttcatattctgtttttaaaaacttataaaatccttgcaactgtaaacataacataaatgcattta

SEQ ID NO: 72905 - DNA, 601 bp, Human
agacatgggttctagctctggatccaggcactgtgtaacctgaggcaagtcattgtaccaccctgactctcagttttctcatttataaaatgagagcatttgcctacgtgtttcgtaaacaacttcagccctgtttaaaaaccatatattctactcagataaaaaacacactggcttgtaagtctggttagaccttgagagcaaggactattgcaccgaggagcactcttcaaactcccaaacttccatttcctttgctgccactgcactgagtcaccattcagggacatggcagggcccttgtgtgtgtgtgtgtgtgtgtctgtgtgtgtgtgtgtgtgtgaagtatatgtctgtgtgtgtgttgcaggagaataattaagcaacttgctacataacaatgaaactgcagcaaccacattcaactgaagactcactcccagtgggctacaaaaagacagacagagacgtgatcattttatgggagctggggaatgggactcttggttttttcctagaaatggttctgcttttgctcattacgtttttggtgggaggcgttggcggaagggcaattccctgcaatcagtgtttaagtgaa

SEQ ID NO: 72906 - DNA, 601 bp, Human
aatgaccaataaaccagctgcttctatagacatagatcagttcaccaggagtggaactctaaaaggtactctgcaactgagtgaatcacagtgttgagaaaatctaaatgctaggaaatcattgttgaaataaaggttgcttcaagcacatatgaaaatttctgtgttagatggagatgtgcagcacaatcagagataataaaccccatctgttgggtagcagttaaactatatttatatttttaccttaatagcttagtctgcagtagttaacatctggatgtaaatgcagctggtcttsggtgatctatagcagaggtgacattatattgttggtatcaggtgttgtccagctgaagtaggagagtagtggggagacagggaggaggggaactcagctaattattaatcctaaaaattcctcctctatcctctttttaaataaacatttcatcaagctagttacttgaagagaacgtaaagctaaaatacacaagccactatttgcaggcaagggaaaataacatatatctgcacatatatttaattcaagccatggaaatgactaaggatttattttgtagcatgacaggtattgtta

SEQ ID NO: 72907 - DNA, 601 bp, Human
atcaatattattgaggcaaattaagtgttttaacaagtgtgtatatttgccctaatgcagcttaattaactatatcctcacaactgctcaactacatgacgccaatggatccgaagagagaatctcgaaaacctcctagacggaaacaaacatgcacagcagatggaaaaacaagcattttgtctccaatccctgaaaatatttcttactttacacaagttactcttctgcgaaccaaaagcctaaagactgaagggctttcgaacagtgtgctatagtcaaccatttgggtagtacatgycccagtcttgaccaggtcactatgcccagggtagagtctaacagccctaggcaatgggtggacaccaccactaaaacaaaaggtttctatgagattttataaaaaaaaaaagtacccaagataaatcattaaaatgaagcttacaatatatgctgaatgtaacatttattcagtgttagaggtttactatgccatgagcagacctcctctgcagtaagctttctaggggaaagcaatagtctcctacttctacaaatctctggtctttcaaacagaaatatggatcaataaagtttgctt

SEQ ID NO: 72908 - DNA, 601 bp, Human
ctttgaagggagagctctcctccactgccaagtccaaatcaattcttatgacattactttataactaacatgatatttaactgatgatggctattagctattatacagattgcactcaaaaactgtaacagtaggggggaaataccatttagtttaaataaacttctgccatgtaatcaatattattgaggcaaattaagtgttttaacaagtgtgtatatttgccctaatgcagcttaattaactatatcctcacaactgctcaactacatgacgccaatggatccgaagagagaatctygaaaacctcctagacggaaacaaacatgcacagcagatggaaaaacaagcattttgtctccaatccctgaaaatatttcttactttacacaagttactcttctgcgaaccaaaagcctaaagactgaagggctttcgaacagtgtgctatagtcaaccatttgggtagtacatgccccagtcttgaccaggtcactatgcccagggtagagtctaacagccctaggcaatgggtggacaccaccactaaaacaaaaggtttctatgagattttataaaaaaaaaaagtacccaagataaa

SEQ ID NO: 72909 - DNA, 601 bp, Human
tgttttgcataattaaccatctgagcttttctttaatataatgggcactcatgtaatatagagcagctataagtctataaaatatacacagtttatatgaaccgtgattctgcttaaaactctggctaatcatctacatcagctttgaagggagagctctcctccactgccaagtccaaatcaattcttatgacattactttataactaacatgatatttaactgatgatggctattagctattatacagattgcactcaaaaactgtaacagtaggggggaaataccatttagtttaaayaaacttctgccatgtaatcaatattattgaggcaaattaagtgttttaacaagtgtgtatatttgccctaatgcagcttaattaactatatcctcacaactgctcaactacatgacgccaatggatccgaagagagaatctcgaaaacctcctagacggaaacaaacatgcacagcagatggaaaaacaagcattttgtctccaatccctgaaaatatttcttactttacacaagttactcttctgcgaaccaaaagcctaaagactgaagggctttcgaacagtgtgctatagtcaacc

SEQ ID NO: 72910 - DNA, 601 bp, Human
ggcgcttagtagtgcaacttatccttagcttgttttcttggacctatttcaatctgggggtgagcatctcttgtttatggctctaaatacagtaagtgagttactgacaaatcaataaaactgttaaatgcataataatgccgagtaattgcatacatgatgttttgcataattaaccatctgagcttttctttaatataatgggcactcatgtaatatagagcagctataagtctataaaatatacacagtttatatgaaccgtgattctgcttaaaactctggctaatcatctacatcrgctttgaagggagagctctcctccactgccaagtccaaatcaattcttatgacattactttataactaacatgatatttaactgatgatggctattagctattatacagattgcactcaaaaactgtaacagtaggggggaaataccatttagtttaaataaacttctgccatgtaatcaatattattgaggcaaattaagtgttttaacaagtgtgtatatttgccctaatgcagcttaattaactatatcctcacaactgctcaactacatgacgccaatggatccgaagagagaatc

SEQ ID NO: 72911 - DNA, 601 bp, Human
caagtttacatacaaatacagagataagaagagtcctcagctcctctgtgtgattcatcagaatcacagaatttcagggacagaaaagaaggttatcaagtcccaccacctaatcactactgattcaaaacaaaaatgaatctatggggactggttgattttctacattctgaaattaccagattaaatatttaagtatttgtgttttaaaaaataaaaagctcttaatactctatagtgtgtgtgtgtgtgtgtgtgtgtgtgtgtgttttatgcttttagaagaaaacctctagactartgttgcagctcccggaggtacaggcttcagagcccatgaccccagcagctcccatggcagcctgagttacaacttcaagcacgctactttacaatgagcttttttcccccctgcttcaactaattgcactctcgtaaagtggcaaaatgtgaatcacttagtaacaaaatgggcaccagctgctattgtcagagaatggtgatgctgaagaaagggaaagcaaccgaatgaagtgtcatgtcagaaatcaacggtgcaacgtgtgatttgagaaaacatgactactttacagagacaggg

SEQ ID NO: 72912 - DNA, 601 bp, Human
atcatcttagatcttctcatgtgttatactaaggcaatatcttctgcaacttttactatatctataccaatagtaaacgctttggtaggctaaataaatgtcaattaaagaagttaacacaatttctattcttctttgtcatccttaagggcctggaaaggtaatcatcatcattataaattccaaatgctttaaaaatttatttccaatgtttttgtataaggacacaatgcagcgaatctccaagtttacatacaaatacagagataagaagagtcctcagctcctctgtgtgattcawcagaatcacagaatttcagggacagaaaagaaggttatcaagtcccaccacctaatcactactgattcaaaacaaaaatgaatctatggggactggttgattttctacattctgaaattaccagattaaatatttaagtatttgtgttttaaaaaataaaaagctcttaatactctatagtgtgtgtgtgtgtgtgtgtgtgtgtgtgtgttttatgcttttagaagaaaacctctagactagtgttgcagctcccggaggtacaggcttcagagcccatgaccccagcagctcccatgg

SEQ ID NO: 72913 - DNA, 601 bp, Human
ggggaaataacaatgtcaagaataacctttagtttctatatgagacactaggttttattttattattattatactttaagttttagggtacgtgtgcacaacatgctggtttgttacacatgtatacatgtgccatgttggtgtgctgcacccattaactcgtcatttacattaggtatatctcctaatgctatccctccctgctccccccacccgacaacaggccccagtgtgtgatgttccccttcctgcatgagacactaggtttgaggaatttaacagcctacctgaaatttcaggrctttaaaaagcatttcaaaacagtttgagatatagcatcaaataattctgatgatcatacttcaacctaggatgtcatttcctagccctgcttagggtcagcaagggtgaaaattatctttggcattagatactaatgatcagccaaataaaatgtcttagttgtttcactatttaaagaagtaatttttgaaagttaattaatggtgtgtatatgtgtgcacatagagagagtgagagaaagaaagaataagaatcaattaaagttgctgctgtgggggagaaaaggataatctgtaag

SEQ ID NO: 72914 - DNA, 601 bp, Human
caattgtcagctggtgggttttattctagacttcacttcaatctaaaattagaggcactaaaattcacattaactctaagaggaatgtagtgaataggactttatttcaaaagaacacctttttgtcagaaagagccattttcaaaatgatggctttatctgtagccaaagagaataagcccaattccacattgtgctgttaatgcagaaattttaagtcacattggattaataaaaatctaaatttagttaagaattatgaatagaaataacatgtgtcgaaatatgtgggaaatatttrttttaaagccttagtatggttactattattattttaagagaaatggtgagatgaacagggagcaagaccagctaactaactcccttcccaaaacctctgaatgaaccccctgagaataaactagagggggaaataacaatgtcaagaataacctttagtttctatatgagacactaggttttattttattattattatactttaagttttagggtacgtgtgcacaacatgctggtttgttacacatgtatacatgtgccatgttggtgtgctgcacccattaactcgtcatttacatta

SEQ ID NO: 72915 - DNA, 601 bp, Human
ctcagcaattatatccacagcccacgcataagtggaaaaggggtgaaggggccactgcgctggttggctggttgcaggtctgccctactgcatcacccacccagggtgtgcagtgacacctaaacagaatctctgaaccaacacagttgtctcctaattactacttagctcattacactgaacacttcctagacactattatattataacctaaaactacagcgagtcttaattctctgcctctctgtctctgaaattctacagctctattattcaagtctgaaatattcacaactatctrtaaattcaattgtcagctggtgggttttattctagacttcacttcaatctaaaattagaggcactaaaattcacattaactctaagaggaatgtagtgaataggactttatttcaaaagaacacctttttgtcagaaagagccattttcaaaatgatggctttatctgtagccaaagagaataagcccaattccacattgtgctgttaatgcagaaattttaagtcacattggattaataaaaatctaaatttagttaagaattatgaatagaaataacatgtgtcgaaatatgtgggaa

SEQ ID NO: 72916 - DNA, 601 bp, Human
acaaggcaccgttttttaatttggaattttttttttcttttttttttttttatccagaggagagttgcttggggctgcttgatcttcagaccctctttttaaattttttttccctctctctcttttcctgtatcttccatggtcactttcaccccaattttctttttttcaggctcttcctcatggacttgcaaaatttgcagaactcttgatttaaagaacaaggccagaaattgccctcccatttatggatcagttatttgctaagccatcaaatatttatgtgtcaaatgcatgttgwtaaagtccctgaaaaatagggactctccagcaagttgtctcatcgaaaatctcagtccataacttggcaataggctggataaaacaaggaaattcgggacgtacaagctgccagaaaggtccttaaaacagaagcactgtcttctcctaaacaaggtctggccactggagccatacatgaaagtgaaccaactggatttgtgctgtaggttgtacgtgtttttggcctgccacgaactgtttccttaattaatatcttttgcccagtggaaataataaaagtcagaattgccatttatca

SEQ ID NO: 72917 - DNA, 601 bp, Human
tcctctctccagcactgaatttcccacagctatgacaattaactctttcaccatctgcctacaaggcaccgttttttaatttggaattttttttttcttttttttttttttatccagaggagagttgcttggggctgcttgatcttcagaccctctttttaaattttttttccctctctctcttttcctgtatcttccatggtcactttcaccccaattttctttttttcaggctcttcctcatggacttgcaaaatttgcagaactcttgatttaaagaacaaggccagaaattgccctyccatttatggatcagttatttgctaagccatcaaatatttatgtgtcaaatgcatgttgttaaagtccctgaaaaatagggactctccagcaagttgtctcatcgaaaatctcagtccataacttggcaataggctggataaaacaaggaaattcgggacgtacaagctgccagaaaggtccttaaaacagaagcactgtcttctcctaaacaaggtctggccactggagccatacatgaaagtgaaccaactggatttgtgctgtaggttgtacgtgtttttggcctgccacgaactgt

SEQ ID NO: 72918 - DNA, 601 bp, Human
cattctgatgctgcaatcattttattatgagcagaataaaacttttattttcaagactgaacagatgatcctcagctctgtaattactgtttgtcagcacgcttccataagcataactgtgtcttattgatctgactaaaacacatagggaatatatcctcaatcactttgtttctttatttaaattgctctatttcatagccatttggcaatatagaaagacatcaagtataaaattccagccaatatttaaagattattcctagagcctgcaaaacttagtgactcatcaccaacattsattaataaatacgtgcatgtgtttcttgtgtgtgatttgccattatttaagagatgaatcagtaaaagccatttgagccttcagtatacctgtaagtccacaaatctgatattatatgtatattatctgatactataaaatctgatgttatatttacattcagtaaagtagaaatgtagcatattttgtcctaaaaaatatatttgtgatggtccttcccccacttctttttgccatttaacattatacctcctaaaaggaaaaatgatgaaacatctaatctgacacactgtttctctt

SEQ ID NO: 72919 - DNA, 601 bp, Human
gatgaaggacgaacagctggaatcaatgtgtcgatctttgtttgacattctgcagagaagcctgagattgaggagatacaaagagagacagaaagaggagagagtgtcaagcacagagaccaaaagaggtagaaacaaaagagatggtgaaaaatagagaaagggaaagggaaaggtaaaaggaggaaaaaaacagaattcatatgttaaagacattgctctttgagagagtttcctaagggctagggactacacatcattcattctctagtcaatacttcttgttctacaagaaggtaawcagcataagggcatgacagggttacaacaaagggcccagacaggccataaacaaaagctctaaagagtccgattgcttttattttacctttctcttggagaaccagtgtcaatatctaactcaactctagattctaaatttatcaatggaagaggtggtgatttgcaaagtctataccatttctaaaattgtatttatcctcattctacctttccttcctcattctgatgctgcaatcattttattatgagcagaataaaacttttattttcaagactgaacagatgatcctcagctctg

SEQ ID NO: 72920 - DNA, 601 bp, Human
ctaatgaatcagaaattctggaggtaggacccaggaatctgcattttaacaagatttccagatgattttaatgcacactcaagtttggaaatcactggtctaaagtatttattatttccatgcatctgtaagaagatccaaaggggtcaaaaacactgttagtccaatgtgcatttgtacagttgctatatagacccacattgctctaataataactatgctcttgtaaactctacccaaagtttattatccttgcaccattaaagcttaacagtaagaggaaaattaatagatatggagkatatctggggggattttattctataaatcttccactatcaattgtaatctatttccattttctactcaagagagaattaaaactatgatacttgacttatgagaataagaataaggaaaaacaaaaacccatcatgtgaggttggaagtggggagagtattcccaggtccgacactaaccttgaattgtcctcttgaagaatgccttgcaggcttcacatgatgctaccccatagtggtacccagaagcgatgtcaccacacactaaacacagtctcttgggcatcgagttgagcatgta

SEQ ID NO: 72921 - DNA, 601 bp, Human
tgtttttttaagtcttccactgattccaatgagctggcaagcttgagaaccactgatatgtgggaagatagactttgtgtccataactggttgttaggaagacacattttgtaaaccactgagcagaaccattggtgtgctgtggatcctcaaaatatatttttttcttcccctattttcttcaaaagtgaattacaagagacctaaaaacgtgaaatctaatttttttgccagaatatatatctatagctttttcatgaactgaattctagatctgtagattaccagtttaaaagggcawaaacaaatttcagtcctatttttctacactgtatggcggaaataatgttatttataaatctgaaatctatgaagtttggggtatatatcacttatatatgttggaggtatattttatcattcaatgccattttattggtataatttggaaggttttttttaatataaattcatttaaaagttagaaaaagtatatccaaccataaggaaaaaagaaagatgagtaggtaattaaatttgtctagagcagtgattcttaaaattggtccctggaccggcagcatcatcagcattacctgaa

SEQ ID NO: 72922 - DNA, 601 bp, Human
ggaattcatctcaatccacaacctttgggaacaaagctttaataaaatgtggataagaggacactccaaccagcctgctgtctgaatcacaggttctcagtaaatattcgttgaataaatgggagtggttttcacactgagaacctcttgcttatatcagcgcactcagtgctcatgaatttatcccaaaatatttgcttatctttgtgtagttaaaattcagagctgtgtaaactgagttaacaaaatcaaattaataacagtttgaattgtatatactttgtaaccataaggattatarcactgtggaacaatggctggtaaacacccaaagatttgaggtgtgctttcattctcaagttttgtagtgttaccaaatagactgaagagatttctcaaatgctcagaagtgatgaaaagccttgtgcacagaccattgtttttagctttctcgctttccatgtgattttatatttcattttaaacttaagtattctgaggttaatgccttcaatttatagatgaggataaagaaaataaaaatccagtaaatgaaagatttttgtaagaaaatatcaataaatatagcaacgatgagcca

SEQ ID NO: 72923 - DNA, 601 bp, Human
tgtgctttgctctgttaagcttttggtagcatttcagcatcctaaagaataatcatgcatagaattccaattgctctattctaattattgctcagtaaataactattgcagagctattaatgtctaacctataaaatgttttgagacatgtattaggaaattttttcacactgttattctatctttacaaaacataccgaagactcgagggtttaatcccctcaaccctaaaaattgttacttcctcaaggcaggagacatttgttagaggaattcatctcaatccacaacctttgggaamaaagctttaataaaatgtggataagaggacactccaaccagcctgctgtctgaatcacaggttctcagtaaatattcgttgaataaatgggagtggttttcacactgagaacctcttgcttatatcagcgcactcagtgctcatgaatttatcccaaaatatttgcttatctttgtgtagttaaaattcagagctgtgtaaactgagttaacaaaatcaaattaataacagtttgaattgtatatactttgtaaccataaggattataacactgtggaacaatggctggtaaacacccaa

SEQ ID NO: 72924 - DNA, 601 bp, Human
cagggtagcctcaccaagtgctgcgcagctgccagctacaagcacagccaggtgggcaagtccagagtgctaatctggacagtgacatctctgtctcctgctcaaaatccttgaaacttgctctctccaatacggagtaaaactgagcacatacatcaatgccaagaatcaccctgtgctttgctctgttaagcttttggtagcatttcagcatcctaaagaataatcatgcatagaattccaattgctctattctaattattgctcagtaaataactattgcagagctattaatgtctarcctataaaatgttttgagacatgtattaggaaattttttcacactgttattctatctttacaaaacataccgaagactcgagggtttaatcccctcaaccctaaaaattgttacttcctcaaggcaggagacatttgttagaggaattcatctcaatccacaacctttgggaacaaagctttaataaaatgtggataagaggacactccaaccagcctgctgtctgaatcacaggttctcagtaaatattcgttgaataaatgggagtggttttcacactgagaacctcttgcttatatc

SEQ ID NO: 72925 - DNA, 601 bp, Human
tttaagaagtatttttcccaactttttaaacgtatatatttattacacactcgataaccaatcctaaaaataaattgttaaaataagaagtaagatggctcatgcctgtaatcccagcactttgggaggctgaggcaggaggatcatttgaggctaggagtttgagaccagcctgggcaacatagggagatcccgtctctacaaaagagtgaaaaattaggtaggcatggtagtgcatgcctgttttccagctacttgggaggctgaggggaagggatcacttgagcccaggaggtggagrctgcagtgagccaagatcacatcactgtacaacagcctgggcaacacagtgagaccctgtctcaaaaataataagaagatatattaaaaaggaaagatcttaacagatgatggtgtacatgaaaatgcctatggatgcacacgtcccttaagtcaatgagagtagaaccaggccctggtgaggcaggagtcacatttatgtaacggcctgtccattggggctctagtctagcaaggcttgttgtcaaggggagttacataatctcttccttttccttggagagctttaatggaggggagg

SEQ ID NO: 72926 - DNA, 601 bp, Human
ctagtgttttgtctattaaataatgaaatatgtaatacttgggtattacttatacttgggtataaggatgttttccttctcttgcctccttaacaagagtctaggggaaactcttaatgagaagttcccaaaaaaaaagaaaagaaaagaaggaaggaaggaaagaaagaaggaaggaaggaaggagggaaagaaggcagactccaatcatttatgaattaaggccaaaattggaattggaaaaaaaatcagaagaataacaatatcacatccccaaaattactatgcctagaaaatgacrtgaaatcactgctgccactgtaaccctattggatgacagggtagagctgtcaaagttttgtaaaaagtattttggtcagccaaaaacaaaaacaaaacagcaaaactttggcttctacccaactaaatgctgacataattcaatagtttttcaatgataacttgaaaatagtcaacaagtaaaatattcctttctatttacctttcattgaaatccatgattaattgtctttcacaacagaaatagcacattcagctctgaaaagaacaatttgtattacttttctcaagatatggtctg

SEQ ID NO: 72927 - DNA, 601 bp, Human
aatactttatttctagcactataatgaggagttagaatggctatattatctacacaaagaaaactatttataaaattattttctttattatatggacataaaaacttcaggaggctagtgttttgtctattaaataatgaaatatgtaatacttgggtattacttatacttgggtataaggatgttttccttctcttgcctccttaacaagagtctaggggaaactcttaatgagaagttcccaaaaaaaaagaaaagaaaagaaggaaggaaggaaagaaagaaggaaggaaggaaggagggaaagaaggcagactccaatcatttatgaattaaggccaaaattggaattggaaaaaaaatcagaagaataacaatatcacatccccaaaattactatgcctagaaaatgacgtgaaatcactgctgccactgtaaccctattggatgacagggtagagctgtcaaagttttgtaaaaagtattttggtcagccaaaaacaaaaacaaaacagcaaaactttggcttctacccaactaaatgctgacataattcaatagtttttcaatgataacttgaaaatagtcaacaagtaaaata

SEQ ID NO: 72928 - DNA, 601 bp, Human
gaatactttatttctagcactataatgaggagttagaatggctatattatctacacaaagaaaactatttataaaattattttctttattatatggacataaaaacttcaggaggctagtgttttgtctattaaataatgaaatatgtaatacttgggtattacttatacttgggtataaggatgttttccttctcttgcctccttaacaagagtctaggggaaactcttaatgagaagttcccaaaaaaaaagaaaagaaaagaaggaaggaaggaaagaaagaaggaaggaaggaaggagggaaagaaggcagactccaatcatttatgaattaaggccaaaattggaattggaaaaaaaatcagaagaataacaatatcacatccccaaaattactatgcctagaaaatgacgtgaaatcactgctgccactgtaaccctattggatgacagggtagagctgtcaaagttttgtaaaaagtattttggtcagccaaaaacaaaaacaaaacagcaaaactttggcttctacccaactaaatgctgacataattcaatagtttttcaatgataacttgaaaatagtcaacaagtaaaat

SEQ ID NO: 72929 - DNA, 601 bp, Human
gggtatcccagtcatattcccaatatcaaccaaagttaataatttagtgtacatttactatgggtcaagtacttcgatattcattctctcatgtaaccctcatcacttgggaaacagaggaaaagaggggttaaggtctcacagctggtaagtggctgagacttgggcctggctttatataaatccaaaaccgatgctataatgaacatctttttaaaatctcatatttttaaatatacaatttcccaccttttaaatgtgggggaaagaagaatactttatttctagcactataatgagsagttagaatggctatattatctacacaaagaaaactatttataaaattattttctttattatatggacataaaaacttcaggaggctagtgttttgtctattaaataatgaaatatgtaatacttgggtattacttatacttgggtataaggatgttttccttctcttgcctccttaacaagagtctaggggaaactcttaatgagaagttcccaaaaaaaaagaaaagaaaagaaggaaggaaggaaagaaagaaggaaggaaggaaggagggaaagaaggcagactccaatcatttat

SEQ ID NO: 72930 - DNA, 601 bp, Human
gaattttatgttttatgcaagttccaaaattcaggcttgttttttgatgtatgcagtttcccattcttattcacagggaaataaagttaattgagcacgataagctaaatataactaaacaaatttccagacagttcacctaaatgcctccaatcatataaaggcaccatcagtgagaaatggctacagggagagagggtttacgatcatagctaaagggtggagacagctgtgagctctggaaggtgacatacctgtccttctagtttagcatcaaggataactctgtgctagattacaygaaccatccagcctctgggtatcccagtcatattcccaatatcaaccaaagttaataatttagtgtacatttactatgggtcaagtacttcgatattcattctctcatgtaaccctcatcacttgggaaacagaggaaaagaggggttaaggtctcacagctggtaagtggctgagacttgggcctggctttatataaatccaaaaccgatgctataatgaacatctttttaaaatctcatatttttaaatatacaatttcccaccttttaaatgtgggggaaagaagaatactttattt

SEQ ID NO: 72931 - DNA, 601 bp, Human
ggtgcttgctgtactcttgtcctaggtcctgcaatgttcagagcggacttagttccataatggtcactcccacacctcacacagggaagatatgctactacttcagtgcctaaatttcacaagtgaagctaaactgagaattttatgttttatgcaagttccaaaattcaggcttgttttttgatgtatgcagtttcccattcttattcacagggaaataaagttaattgagcacgataagctaaatataactaaacaaatttccagacagttcacctaaatgcctccaatcatataaagscaccatcagtgagaaatggctacagggagagagggtttacgatcatagctaaagggtggagacagctgtgagctctggaaggtgacatacctgtccttctagtttagcatcaaggataactctgtgctagattacacgaaccatccagcctctgggtatcccagtcatattcccaatatcaaccaaagttaataatttagtgtacatttactatgggtcaagtacttcgatattcattctctcatgtaaccctcatcacttgggaaacagaggaaaagaggggttaaggtctcacagctg

SEQ ID NO: 72932 - DNA, 601 bp, Human
ttacttctatatttaatttaacactgcattcaaactgataatcactgcgattcatcaagtcaatttagacatttccatattattttggatttcaattttataacatattagagttttaaagctaccaattactataaactgaggtagttattttctctagacactatttgggttaaatacattttattagtttcctttggaaggttcatatcatgtacactcaatttgtaagttcttattttctctatggctgaaaacattctaagactgaaacagcacatgatggcaaaagaaatgcaayaccaggaaagatcctctaggactacactgcctgcttcaggaaggagtcatacaattcagtgtagtaaagcagttggttgcatcagatccaagggctatgcccgcatgcctttagcatatggcttgcaggaaaatgactaatcttaatgccccatgtttaaggtgagatttaggctcacattaatgccactttagcctcagacaagaaaagcccttgcctgaaggctgtgggctttagaaggtatacgtagcacaaagatcccactcaaagtgtgaagggaaaaaagcccagctggagccg

SEQ ID NO: 72933 - DNA, 601 bp, Human
tatgaaacccattctatcacttcttccagatcactgtgaagtaacagagacagtaggaaagaaggttacccttttgcaaatacattgctaggaaaattaattttgtttgcctaatctgacatgagctatagttgggcattaaaagttttgttgcaaatttgtgtccatcctgaataccattggcatataccccttacatgggataggctcttacgtagtgtcacccaacaggaaaatataccctacaaatcaaagctaaaatgatatgcctattttaaatgactttcaaaatagagtaacmtaatgctatgtgtttaataaacatgtaaatcacaccagagattcttttttctgcaaactggagtttctaatatttgaaggacaaaaatctagtgaggatcattacattttattctatttttctttccttgatcaaagatcaaccatgaaatacaatctctgaaaataatcactctgattttgcacaacccaaagatcttttttcatcagccactctgttactttgtcttaatttacattgattctgttttctaattagctagccaacacacacacacactcacacacacacatatattca

SEQ ID NO: 72934 - DNA, 601 bp, Human
cgctaggagagctcagagacttaacaggttgtagtttggggcaggttaagagaactctcctccccccaaaaaaaatcagtggaagaaatggtaatgcaagggcttcttttccataagagaatgattgaatcgggaacaggtacgtttgagtaacctagacgggtcaggataggggatgctcccacactggaaccagataggcaccaggtcttatgccagctgcacccacagtcagcacctgaagggcagctttccatccacgctactccgtccgaggacactagctcaggagatctatagrgaattgattttattttctgagtgcagagggttttattaaaggaaaaataaataagagtacatgctttgattaagtatgcgtgtgtaaagagaatttattccagaattacatccgtattttttttggattctaacataggccatatcacacagtagaatccatgaaatatgggcttatgtaacaggtactttataagttctgttaaaatataaagatagaactaagtttaggccgggtgcagtggctcatgcctgtaatcccagcacatcgggagaccaaggcgggtggatcacctgaggt

SEQ ID NO: 72935 - DNA, 601 bp, Human
tagcagggtctgaagcagccttatttgtcatgacttggttctgggttaagggagcacaaggaggaatgaaggaaagctattagagtgctaagaaaggcactcatgtctttgtttgggagtttatcttgtaatcaaagaactgcctccagtaccttcatcaaaacaaatagtcatcagataatagagattatggatggcatgtcctctggggaaagtccagtgatctgtaggcaaagagtcagccacacccgcttcctgaaagtccactcacaaatgtaaaattccaccttgcaaaaggcakaaaagtcaatggcatttttataagaattaattggaagtgatctgtgaagtcccttagactggaacataaaaacaatacaaacttccttctcaacagttactcgctaggagagctcagagacttaacaggttgtagtttggggcaggttaagagaactctcctccccccaaaaaaaatcagtggaagaaatggtaatgcaagggcttcttttccataagagaatgattgaatcgggaacaggtacgtttgagtaacctagacgggtcaggataggggatgctcccacactggaaccagata

SEQ ID NO: 72936 - DNA, 601 bp, Human
tttagcaaatcatattgagtcatattcccccacaactagttaccaagcaaaagtgacccacatcaataggaacttctgacaacacaactctcatcattcattttttgttttctttcctacatttagagtgaacattctaatataccctatctggctttagccataaccaattttgagttcactggaggaatggcttttattgtataactatttgaacatatgtacaaaaacatgcattttgaaaaatataaagcacaaagtatcattcctattgttttgctctcaagcatttaacatgccrttcagtagactgaggctattctagcagggtctgaagcagccttatttgtcatgacttggttctgggttaagggagcacaaggaggaatgaaggaaagctattagagtgctaagaaaggcactcatgtctttgtttgggagtttatcttgtaatcaaagaactgcctccagtaccttcatcaaaacaaatagtcatcagataatagagattatggatggcatgtcctctggggaaagtccagtgatctgtaggcaaagagtcagccacacccgcttcctgaaagtccactcacaaatgtaa

SEQ ID NO: 72937 - DNA, 601 bp, Human
caggaaaacacatcactgccctgggctttaccaaaaaaagaaaataaaatcctgacccatgacttttactcatgtcaaaattctgaaccccacccagccatacctcatgagttacctaacagcttctatagtttgacttttaacaagaactgatgctccctttcttacagatttagcaaatcatattgagtcatattcccccacaactagttaccaagcaaaagtgacccacatcaataggaacttctgacaacacaactctcatcattcattttttgttttctttcctacatttagagtsaacattctaatataccctatctggctttagccataaccaattttgagttcactggaggaatggcttttattgtataactatttgaacatatgtacaaaaacatgcattttgaaaaatataaagcacaaagtatcattcctattgttttgctctcaagcatttaacatgccgttcagtagactgaggctattctagcagggtctgaagcagccttatttgtcatgacttggttctgggttaagggagcacaaggaggaatgaaggaaagctattagagtgctaagaaaggcactcatgtct

SEQ ID NO: 72938 - DNA, 601 bp, Human
atcctgtacctaattttgagcttatgtgaaactttttaaattgtataaatcagctccaatgactaggccgtcacatcactgaagtctcattatcagcaactttaaaagaaagtgaattcatgtggtttataacttgagtgagttaatgtgttttataacttctaagaaattgtctaagttcatctagtagtatatcaggaaaacacatcactgccctgggctttaccaaaaaaagaaaataaaatcctgacccatgacttttactcatgtcaaaattctgaaccccacccagccatacctmatgagttacctaacagcttctatagtttgacttttaacaagaactgatgctccctttcttacagatttagcaaatcatattgagtcatattcccccacaactagttaccaagcaaaagtgacccacatcaataggaacttctgacaacacaactctcatcattcattttttgttttctttcctacatttagagtgaacattctaatataccctatctggctttagccataaccaattttgagttcactggaggaatggcttttattgtataactatttgaacatatgtacaaaaacatgc

SEQ ID NO: 72939 - DNA, 601 bp, Human
gtgctctgttgatggtaatataaaattgtactgccgctctagaaaacagtacgggagttcttctaagaattaaaaatagaattaccatgtgatccagtaatttcacttcttggtgtatgcatacatccaaaagaattaaaaataggatctcaaacaagtatttgtacacccaggttcactgcagtattatttacaatagccaagagatggaagcaacataaatgtcagccaagagaggaatgcacaaagaaaatgtggtctatccatacagtggaatgtagtagtcctctcttatttgcgwtttcactttcagcggtttcaattacccaaggtacagtacagtaaaatattttgagagacagagagaccacattcacataacttttagtactgtatattgttataattgtcctattttagtattagttatttttgttaatctcttactgggcctaatctataaattaaactttatcaagatatgtatgtatagaaaaaaaaaatcctcatctctatacggttcagtcccatctgtggtttcaggtatcctctgggggccttggtacacatcccctgcagataatgggggactcctgtatta

SEQ ID NO: 72940 - DNA, 601 bp, Human
ttgggatgattaaagaaatgagataattaatgtaaagcacatagaacaatgtgtgacactttgcaaaatcaaatatattcattattattataaattaaactaatatatttattattactattaatattattggttaacaaattcttcacctaaaggcattgcattaagctcaggaatcttaagacagctatgtacattatccatatatataaaattacttatggataagcctaaggtgataaaagattagaactttggtgtatatataaatttggcatatctataaaatctctcaaaaatrtttaaacattcacctcctacccattaggatggttgctactgaagaaaaaaaaaaaaaaacagaaaataaccaagcactgaaaagaatacgaagaaattagaacacttgtgctctgttgatggtaatataaaattgtactgccgctctagaaaacagtacgggagttcttctaagaattaaaaatagaattaccatgtgatccagtaatttcacttcttggtgtatgcatacatccaaaagaattaaaaataggatctcaaacaagtatttgtacacccaggttcactgcagtattattta

SEQ ID NO: 72941 - DNA, 601 bp, Human
aatcatgatagaagtgcctacttcattgggatgattaaagaaatgagataattaatgtaaagcacatagaacaatgtgtgacactttgcaaaatcaaatatattcattattattataaattaaactaatatatttattattactattaatattattggttaacaaattcttcacctaaaggcattgcattaagctcaggaatcttaagacagctatgtacattatccatatatataaaattacttatggataagcctaaggtgataaaagattagaactttggtgtatatataaatttggyatatctataaaatctctcaaaaatatttaaacattcacctcctacccattaggatggttgctactgaagaaaaaaaaaaaaaaacagaaaataaccaagcactgaaaagaatacgaagaaattagaacacttgtgctctgttgatggtaatataaaattgtactgccgctctagaaaacagtacgggagttcttctaagaattaaaaatagaattaccatgtgatccagtaatttcacttcttggtgtatgcatacatccaaaagaattaaaaataggatctcaaacaagtatttgtaca

SEQ ID NO: 72942 - DNA, 601 bp, Human
ctgagctgccttctggagtggtcacaaagtttatgcaaatggacaattattctcacatcaaaacaggagagaaataagcctctttcttcctaaaataaataattaaataatacagaagtgtcatcagtggcgacagatttttaggatcagtttaagactaacaaacaaaaattgggtggagaaaggaatgtcagatgataaaaatccagagaactgacacaggaaatggaaatggtggtggcactgaagagttgcgctctcaagcttcacatttaagggatttctaaaaatgaattgcaargcgtttaggtatttttaagacttagttcttactgtctcctttctaaaaaccttgaatattatctaatcataacatttggcatattcttaattcctcatttttattttaataacttaaacgattttgcccatggattaaaattctctcaagaaaaatacaatctaaaatcattcaatcttttaaaagcttttaaaatatacaaggcagtgtaatgaaggggttaagaggacaggctctgggttcaagatttcggggacccagttgttctttgggcaattacttctctgtgcctcaagttcc

SEQ ID NO: 72943 - DNA, 601 bp, Human
tagattaaaaaaatttttctctttctatcattcatcataagaaaaacaaaaaaaagagaccaagagcaacaacaacaacaacaacaaaaagggactgattctgagctgccttctggagtggtcacaaagtttatgcaaatggacaattattctcacatcaaaacaggagagaaataagcctctttcttcctaaaataaataattaaataatacagaagtgtcatcagtggcgacagatttttaggatcagtttaagactaacaaacaaaaattgggtggagaaaggaatgtcagatgatamaaatccagagaactgacacaggaaatggaaatggtggtggcactgaagagttgcgctctcaagcttcacatttaagggatttctaaaaatgaattgcaaagcgtttaggtatttttaagacttagttcttactgtctcctttctaaaaaccttgaatattatctaatcataacatttggcatattcttaattcctcatttttattttaataacttaaacgattttgcccatggattaaaattctctcaagaaaaatacaatctaaaatcattcaatcttttaaaagcttttaaaatatac

SEQ ID NO: 72944 - DNA, 601 bp, Human
ttgtctaaaccatatggacaaaaggctgcaacgacaaaaatactttacagtctattatccattatttcctttcttgctcacgactctgtaaggtagtttcccccaagttaggtacagaaactttttaaagaaatctttgtaaattgataataactgagaagaacagatggaagaatgagttggaaaacttttactttaagtatcacaaaatttgaaattgttttccatataaaacataggcgaaagctctggggcacagtgaggtttttccaaaagcaggaggtactttggaagtagtgargatgctctggaggcaaaagcagggaaaaaaaagtacacttgaggacaacacattgggctacattccttcctttgaagatttttgtgcttatctctgatcgtcctcaaatggaaactgtaaatagtatgcactgaaaagaaaatggatatcagaatgtagatttgggatatgtattcagattcattctaaaggtaaattcatattttcagctctacattctaaattaacaaagatgtccttgaactaaataatctctcagtagtattctttctagtattatcagagatgccctttttttaa

SEQ ID NO: 72945 - DNA, 601 bp, Human
cagaccggtacaagtccatatgaccagttaggggcatttggatgataccctatatgataaaagcagttgattcttaaatagaaattttacttcttgagatttcccttctaccttaaacaagtataaccctttctaatactatccctaagtacttctgttcttggatgctatcaatgtgcccaaagtttgtttgtcagagaggaaaaaatggaattagagtttgcttttaagatcaagttcatatattcaacaaatatctgcatcctctaaaattaatactgatttggggaactccttgacmtaagtaatggtaattgatctgtgtgtaagctgtaggaggcagtataacatatagattacgagctaacatactggagtcaaattgggctgccttgttctaccattttccgtgtgactttggagcagctcttaaatttggagttaccttctttatgaatgacatgtggatgggtaataataattgatacattatggggttgctattaacattaagtaagatcatgtatttaagatgcttagcagagttcctgacagggagtgagtattgattataatattagcaataattacaacatcatta

SEQ ID NO: 72946 - DNA, 601 bp, Human
ttttgatgcctgacataggagcctgagagtgataggttcagggtggatcttggcattgtcttttgctgttgtcagacttatggtgtaagggcagctgtgggataggatagggttgcttttagagaacggaatctctcaacacctcaaaaagaaatcccttaacttgtctctgtaccagtatggttggtggctggtttaattccacagaaaccaaacagagcatgtcaccaaagcaacaggtgtcaggttgtacacaatgcattttaacaatcccaaaataatgttcttgttcctgatgggaaaaaaaaagtaatccataatcatgagggtgtgttctgaaatacatttaaaaaggactggtaagtgtataataaaaatacattggtgaaaatgatggagaatataaatgtctctcatccaaggactaaagaaattcaatgtttttagttctgatataatgatgtcttcttgtaaaaggcaactgttttttacagtgtaaaatgcatatcctacatgatgtgtacagtctcttcttcttagtttttaagctcttatagtacacagatcatgtcacagaagtctttataaaagagcttaaagg

SEQ ID NO: 72947 - DNA, 601 bp, Human
tttagtgtttagcttcaaattattcattaaaaatttagaataaaagtgttagcaattcactagtactatattatttggcataaaataacacagacttataggatatttgatttcaaagagattctaaattccagttgcttcagcccccttgttttatatagaagaccataaaaggggtaaatatgtaaggacttatctattatcactagaacctatgattgctccaccctctttataagaatatgggctagttaactgcagaaatgagactaaaactgagatatcccaacatccagttcawtggcctttaaatgcatccacaaatacttagatatcaatacctaagaacaggagaataacaaacactaagactcacaggtactctttgatgtgctttacattatgaactaccattctgtgattagagatttaaggcagagagagaataaggtaacatacccagaatcatatagctaacaagcactagagccaggatttgaacccaggcaatctggatccaaagtctgtgctcttaaatatgaggcatgctgcctaactctaatcttttaaaagtaattaattgaatgttgtttagaataga

SEQ ID NO: 72948 - DNA, 601 bp, Human
agatattgagaaggaaaggaagatagttgttcttaaaagtaccgaaatgtctgagaagtgagtttgtgaggcatcaaccacatctcatgaacacttcctgtctctaccttggagcacacacagtgcctatcgctgggtatgatctgattagaacagaggacaaaacatttgcaaagctcttcaaaaaccttatcccagccttatctcttgccacagtcccaggtcgacttctaccccatctcaagctcacccccttgtctgaaacccacatggcattacctgaagttcctagaaagcagcrtcctttcctattgctcctctctatgtgctgcttctatcatttcttcagtgagatgatcccagggctcccaagactgagttaggggtctttgtggatgtaactagttcatcccgtacttacctttcaggtgagtccctctcttagcacttaacacactttattatatgtatctgtggaattgcccccttcctgtcccaactgtatattctttgagggcagcgtcttactcctttcagaatcccctgtgtccaagagagtgtcaggtcaagtcaatgacccataggaaacattcatttgtca

SEQ ID NO: 72949 - DNA, 601 bp, Human
acatcccatttattgttatttaccttgaatcctaaggctttactctccagtttgcaaatattataaaataaaaccaccttcctcagatttatacaaggatgtgaaaatgaatatgccattcactcagaaacactgaaagattttgtccttgcaacacttctaggcagaatatttagctatgttttacagatattgagaaggaaaggaagatagttgttcttaaaagtaccgaaatgtctgagaagtgagtttgtgaggcatcaaccacatctcatgaacacttcctgtctctaccttggarcacacacagtgcctatcgctgggtatgatctgattagaacagaggacaaaacatttgcaaagctcttcaaaaaccttatcccagccttatctcttgccacagtcccaggtcgacttctaccccatctcaagctcacccccttgtctgaaacccacatggcattacctgaagttcctagaaagcagcatcctttcctattgctcctctctatgtgctgcttctatcatttcttcagtgagatgatcccagggctcccaagactgagttaggggtctttgtggatgtaactagttcatcccg

SEQ ID NO: 72950 - DNA, 601 bp, Human
aaataagttgtgtaggaacactacatctgttctcaagggattccaccaaatactttttggtgcttcctttagaactgccaccagagccactttacaaggtataaacagggtttgggaggccctatattatacctcattttcacccaaacgtattgccctttgcattttgacatgaagcccgatgatttttgtccattactaaattttaagtctacccttaaaggtcaatgatttgccatcactgaagctattgtgagactctgtctcaggctctaaaagaggatttccaaaaatactatamggaatgggtactatcactctactaatgggaccccagaccacctgccaggtgaggttgtggcatactgaagtgggaggagaggagcatcacatcaggataatagttagagttggctcttatcaaagcaatttcatacacaggagtgtgcacaagtctcatgctctttgcctctgcactgtctctctaccccataaaaaatgaggtgggggagaggagggtatagacaagaccttttgcaggttggttctttagcattctataggattaaattctgacaatcataaatgtagtatataagag

SEQ ID NO: 72951 - DNA, 601 bp, Human
tataattttctcacttactgcttaatagaatcttgcagctagctggcggatagaataacagggtgtatgtaaaactccagcctggagcgccagtggataatttgtatattcctttcagtcacttaatggacttttacagtttggcagtgaaagggctgaatgatgtaaattagcatggcatctcaaaataaaaatatatgtcaaatctttattcctgaataacatcactcccacatggtaatgatgcatttggatttatgtagttcctaagacttgtcctctttttcatacatacagacawcataattgtaaagccaatttgaaagcatctgtatatttctcccaattgttttaattttattaacagaactaaatagcttgcaatgacccacagggcactccaagtggggtttatccagttgcttttcaacattaagtgatttaaaaataatgggatttgcctcagtacacaattacagagcattggaatcatgcaggcaataatctgtagtatttttgttttaaaggccctaaaacataaacaagaaagaaagaaagaaaactctgtctttattgtatagtggcaaaggtttttccattt

SEQ ID NO: 72952 - DNA, 601 bp, Human
aacctgttccacttcctctttgaaaactgtatccccatccttcacatcaacaaacttctgacaagaatgcacatcaggcatgtgtgagctcacacctggactatggcagttatcccctccctgggctttttgcctccgtcctgacccactctaatccatgtggcataccgctgtcatcttcctttccctaggactgctttgatcacgtcattatgctgattttaaaaaatcaatagaattatttgccttcctgaatgaaatataaactataaggcttacaaacagggtcttctcccagcckttcatttacttttccagcaatattgctattattacctgacatgaactttttgaggcagccaatttgatttattcagtttttgctaagtgtccttcagactttcctctgagaattatctatctttgccactttttcttcttaaaattatttccaagcctccttgttcaactccaactccatcccaatctttcatgaaaacttctctgactatcccagcagaaaacgatttcttggttttcatattttttcaggtactctcatcatatccagacagataatattttgttatacctttcatac

SEQ ID NO: 72953 - DNA, 601 bp, Human
aaggcatgagtgctagtcctacgcacctttaacccagtgctaaaaacttctaccaggatgatccactgccacaaacataatcatcattcttttaaaacctgttccacttcctctttgaaaactgtatccccatccttcacatcaacaaacttctgacaagaatgcacatcaggcatgtgtgagctcacacctggactatggcagttatcccctccctgggctttttgcctccgtcctgacccactctaatccatgtggcataccgctgtcatcttcctttccctaggactgctttgatcaygtcattatgctgattttaaaaaatcaatagaattatttgccttcctgaatgaaatataaactataaggcttacaaacagggtcttctcccagcctttcatttacttttccagcaatattgctattattacctgacatgaactttttgaggcagccaatttgatttattcagtttttgctaagtgtccttcagactttcctctgagaattatctatctttgccactttttcttcttaaaattatttccaagcctccttgttcaactccaactccatcccaatctttcatgaaaacttctct

SEQ ID NO: 72954 - DNA, 601 bp, Human
tacctttcttcagactgacgtctcctcattaaatatcacattagtggattgcagggtagcacaaagactcaactactcagcaactgctaattcaacaagaagtaatacctaaccacttctaactactgaaaactggttaagtatgcatgacttgaaaaaaacacattatagtttgagatagcctatcagaattgcctaaattagcattctaattcagggcatttataataataaaagcaacaactttttaacaggaggttaaataataagagtaatattcattgcatcaacagaagtatayaccatcaccttccttggagatattactgatgctatactcttagaaaaccaaggataagtcaaagaaaccagggtggccgggtcacagctaagaataaaaggatttataatctgaactttagatgaaccactcttcactgcagagtttcttcaaccatctctgaatatttattttgcatcaaaagagtgttgctagtaattttctaagggttaattagtattctactactagatccttccaccctgttcggctccccctatacttacttaaaaagaaacaggcctttgctgtcttaggaag

SEQ ID NO: 72955 - DNA, 601 bp, Human
tcctagagggtagggacagaaattacatagttgttgctttagcacttaccagagccttacaacacaattctgtgcttggtaaatgcttactgatcatggtgatgataatgaagatgatggtcatcatcattatcatcctcatcatgatgtgtgttacataatttgcataattaattccaaacactgaagttccctgatgttagaacaaagaataaactgctatgaaattatatatttttaagattagactttgtatcatttatggtagtacctacatatttaaaatggcaactaagaaacmagaagaagatccaaactaaatttttttttcaattagtaccaatggcagtgtgtgggatgtgctctggggctgcctacagctttgtaaagaagctgcctttaaaataaagcttttctccccaatcagctctgtcacatagtgcttgaaggtctttcgttacttcctaaccctttccccttgtgattaagtgcattagtatcttaatgaaaatgcattctgtttattgccctcttgggaagggggaggtcatcacaccaaatgcataaattctcatcagagacggtccgagcataattgcaa

SEQ ID NO: 72956 - DNA, 601 bp, Human
atgaaatatacaaatatttcaggacctttgacatgtgtggaatagttgagtggcatctagaatcaataggttcagttcctggctccaccaattataaactgtgtgagcttaagcaatttgtttagcacagaacacatgtcactgttgctattttatgtttgttgttgttatccccaactgaaagcaaatagaaagcaattttaatatcatattttaagttctttgtaatagaaaataaagtctaaaagataaggttgggaaagaacaaagagtgctttaaacccaagattaattaaaaaamaaaaatctctctgcaaacctagtaatgagaagaaaaccaaaaattcaatgacagtagcctcttggtttgtcttcatcctttgctttctgcaaattgtaaagaagataaaagcactacggtcaagcatacctggtgtgttttcgctgtacatcagatcctcctaccttgtcccttcctgtcaatgtgaagtggttagccataagttatcagaaagtccaggtataaaggagtattctgccatcagagtcagggtacttactgttacctcatctttttctggtttctctaaaactggtggaa

SEQ ID NO: 72957 - DNA, 601 bp, Human
gaaatcactcttaattccctttgaatgagcataagtttagtttgagtctctacaacaaaactaagtggcaacataaatataattaaggccagaaattgactgtcaatcactgatcattaactttcagaaatatgttttgtttgttactctgctataggggttaaggcaatggctaagataaagagctccacttcacaaacgtaagctaccaccatcatcctaactgaaagaaaaactctgtcatgtgggttgggttgttgttgtcttaattatatgttttcctttatcaaaattgtccttmtggcaatttcacataagttttctttagcaagaaccaccttatctgtcttgttcactgttgtatcactggagcctggaatagtgcctggaacatgggaagaccttagtacatattcagcaaaaggattacaaacgtaaaacatgttaactctgaaaaatcctaaaagggccaaaggctataccataaaaagtacccccatcctcattttcattcaccaatgtgacactgtcaccaatctttaggtatccttccttccttccacttctccatgtatacacatgtatatccatcactgtgtat

SEQ ID NO: 72958 - DNA, 601 bp, Human
tcacttgagctccagaggtcaaggctgcagtgagccaagatcatgccactgcactctagcctaggggacagagccagaccccttctcaaaaaaaaaaaaaaaaaaaaaaatgcccacaaaaatttacttatgaagttaacaggattcttacaattctccttgctcattttaaaatgtgtgccacttgtccattttctttggtgggacattagctttctcctccctctctgctttctcttcttcctcctcttccttttcctttcaagacaaaggagtaagttctcctttctgaagctaaacsagtaattttaaagcttccttcacctcgaatattgttagtgaaaacctctgcttgggttaaagcccctttttttcctttttatactgttgtctctcttcatttgacctaaggtcagatattaaagactaaatttcctcatgaaatttctgagcaaattttcacttattgatgtgcttctataaaaagtttagaaagcacccctaaggccattgacattgccaaaggataacaaattacatgaccttgggttggtctagcaagtcaagctcatagtgtctcctgctaagcatgtactagacc

SEQ ID NO: 72959 - DNA, 601 bp, Human
tgtgtgtatatgtagacatgcacaaattgtcttctctaaaaaggtggaaacagaaaatatactccatggactgtgttgagatcactcagaataaacagaacatctggacaactaattccctaatgtaaaagaagaggatctccatactcctaccatttcttccacccaaggatttcctaaacattaggtcagcactgttaatctatgactcagagaaaaagatgaagacctttaatttcatagagactggcaattctggatggatttaaaataatttgtcaagctaaaggatttaagctgkgcaaaaatggcgtgacccttttgagatacagtgtcctcaaccttaccatttgaccttcatgactcctgatgtacactgccttctctaactcacaatcagtccaatactctagcctgctcagttatcccataaagacttttcctggaccaatcaccatcattatctctgacttcagcagtcccatcaaactttaggtaagaagcctggttccctcagaacagaatcctaaggaaaagtcacctcctaaattatgtcatttatttatataccttaagctcaaaaccccttgttagactcata

SEQ ID NO: 72960 - DNA, 601 bp, Human
tactcctgctgatagggtaaactcagaagactctcagagttcccactgccatatataaatcaagactcaagctgtggttccagcaaaacagctctgggataatttttctttatatcctggaggctcagcccagctgattggagagatgtaatggcagttaaaagagtaaatgtataatctgtgctctctcatatatgtgtgtatatgtagacatgcacaaattgtcttctctaaaaaggtggaaacagaaaatatactccatggactgtgttgagatcactcagaataaacagaacatctrgacaactaattccctaatgtaaaagaagaggatctccatactcctaccatttcttccacccaaggatttcctaaacattaggtcagcactgttaatctatgactcagagaaaaagatgaagacctttaatttcatagagactggcaattctggatggatttaaaataatttgtcaagctaaaggatttaagctgtgcaaaaatggcgtgacccttttgagatacagtgtcctcaaccttaccatttgaccttcatgactcctgatgtacactgccttctctaactcacaatcagtccaat

SEQ ID NO: 72961 - DNA, 601 bp, Human
caaatggaaatgacaaatggggacaatcaaataaatgattaacttttaatagtatccctactaaatcagggggaagaaagctaaaggaactgtttcttaggatttcagcctttctctctgtcctctctaagacaaatgcagggagcacagatttattcagctgaaataatctgtagtgctgcaactgtttagttcacatcaaagattctatctacttcatttctaatgtaattgtgattttaaaatatatacataaatataaaattgttttggagaaccaggtatgcaaggagtatgtgayagtcttctatgagccacacggattacatgcagaatcatggacaaatctttaaaacattagaacttcaattttccccttttatataatagatgagattataatactccagtggtacactatggccatatcctcaaaacaactgaggcagatggtgcacaaagtcagtggatcagattcattcctctctacaaaagcacaacttataagaaatgtggttctgatagttcattttctaaaaactcagccagagactaaagctatgccacaaggcaaaatttttctttatgttccaatttggat

SEQ ID NO: 72962 - DNA, 601 bp, Human
ggctggccttctagtgcctgagcaaatgttcaagcaggtttcccctgcttggggctaaatccatcagggatttttttaatccaaaaagaataaaaatatgtaacatattagataaatgctggcttcctaattcaagttcacaaatggaaatgacaaatggggacaatcaaataaatgattaacttttaatagtatccctactaaatcagggggaagaaagctaaaggaactgtttcttaggatttcagcctttctctctgtcctctctaagacaaatgcagggagcacagatttattcagytgaaataatctgtagtgctgcaactgtttagttcacatcaaagattctatctacttcatttctaatgtaattgtgattttaaaatatatacataaatataaaattgttttggagaaccaggtatgcaaggagtatgtgatagtcttctatgagccacacggattacatgcagaatcatggacaaatctttaaaacattagaacttcaattttccccttttatataatagatgagattataatactccagtggtacactatggccatatcctcaaaacaactgaggcagatggtgcacaaa

SEQ ID NO: 72963 - DNA, 601 bp, Human
gttgtatttgctccaaaacttctgtgtgcagaagcctggttgggggatattaattggacaatccagggagaagccactaaataagggctcaggtggcctcaaggaaaacacttacagctgagaactgagagggaggccagggaaaacggacttgacctcctatgggggcaacatgctggcttgaactgagacacaaaaccagaaattggtacagaaaccaggtctaagtagaaacacatattaagttaaaccaagtaatgtaaattacctcatttttacacattctactccttaaatttcycatatccccaagacacatacaaacgctagtaaaatggtgcagacataataaaattatgattgtgcagcctatgtagaaaagatttaatagatgaaaatgtaattcttgagaaaaataggaaagggattttgatcctagatacacataatcttttgagaaacaggttaaccaaagggcaattgctaagataccctccctttgggttttgccataggtcccatttcatctcagatagtcatctataaaagaagagtatcttacagttggggcttttaaaatagcagaagtcctgacattcct

SEQ ID NO: 72964 - DNA, 601 bp, Human
actccacaaggatagaaactcttttgtccatgttcacaaagtgaatggtatggagccagctctcaaaacacacttgttgaatggatgagtcaaggatgagtgaataaaagtttggagatagacttacaatgtgtattatttggactgatagctagaaaacagctcctgggcagaataacctcaccccaactctagatgttgtaaagaacaggatgtacttctgccatagcagatagaaatatttacacagatcaaaccataaggcatgaatccacgttccttccaaatacttccaaattaygtatgaattgataataacctaagactggctaaggtcagagtaattgccatttaattggcttcaaatatactaatgattatgataatgttgatactgaagaacctaataggcctggagacaaatgtctaagagagcagagaggtgaattaatgggaggcaggagtagggaggggaccattatagaagtcacaagtttggaaatcaccaaatggtaattcagtagggttgtgaagaaatttggcttttagaggaaactatgagaacaacaacaacaatcccccacccgctcccaaaaaagaa

SEQ ID NO: 72965 - DNA, 601 bp, Human
cagaaagtgtgttaaagaatccaagttttaaggggaacagaaaacaaagtcatctgcactatggaagcctatttttttctttctttgtttcccctcctttttctctctcctccctccttttttctttgctctctctctctctactctctctctctccaccaagcctccttccaaaccccatattttgagactgaaaccatgaaaccattgccatgagaactgtagtacaggcacaaaaccagcatcaaaggatataagtgccacacagaatcctgatatgctgccattaatttgatgttcrggggtcaatacaagggtggaaaggtagcaggggaaggagaaagagcagagaagagagggaaacaattgctatgcatgaacaatttgtacttgctacttctctggctagagtaatgcctttgaggcagaacttgagcaggcaagtaaagagctcacaggttctaagctacccgcagctttgaacccaagttgtttagagacttaaaaacaacaactatagcaaatggtttttaagggacaatatggttgttaaatattctaggtggtgatagaagtgctttcttcacctataatatacctt

SEQ ID NO: 72966 - DNA, 601 bp, Human
atagaactatactgatcattccttttccacgctcagcccagtatctctgaagcataatgcttcaggtatcagtgacagggataagcttccaaatgtacaagcttcgggttatcttggatgaatgtgattttactttcaactcttagatactgtagggtcaaaggtagaattgccaatgagaattaaagatccctttaattagataacagtattcaaagacttgtaaattcccaagaagccactttgcaaagcaagagttacagtgttctcctgggggaaaagatgggcagtgggcttttatttttttttttctcagctattcaccactatgagagaatttttgaaaagaacaaaatggaatacattgtaagtaattcagaatgcctccagactttacaattctccctagagaaaaaactcaaacaatttgaagtcttcacaaactgcatccaaatcctttttctaacttcattaagctccagtacttaaaaatcgttcatagcaagtactttaattagagacgagccagtgcagaatagctggacaggcagtgcgtccacccagcgagcagactgcccaggggggacagtctccacctcac

SEQ ID NO: 72967 - DNA, 601 bp, Human
tttgagatcaatcttcaaaatagttttccagaatttctctcaatagctctaaacaataacaatttggtaaagattatggtattggttaaaagggtagataaacctaattacagttattgatgacaaattactgcaactccaatctctaacagaaggtattagccagcattttactggtcagcagtaaaccaccaatggacaaagaaattcacctcatagatctacatagaactatactgatcattccttttccacgctcagcccagtatctctgaagcataatgcttcaggtatcagtgamagggataagcttccaaatgtacaagcttcgggttatcttggatgaatgtgattttactttcaactcttagatactgtagggtcaaaggtagaattgccaatgagaattaaagatccctttaattagataacagtattcaaagacttgtaaattcccaagaagccactttgcaaagcaagagttacagtgttctcctgggggaaaagatgggcagtgggcttttatttttttttttctcagctattcaccactatgagagaatttttgaaaagaacaaaatggaatacattgtaagtaatt

SEQ ID NO: 72968 - DNA, 601 bp, Human
aaaaaaaaatcctgatacttttctatcacattaaaaacgggcagaaaagtagaaggctaacttgttaactcctcacctgataaactttcaaggatggaactcagattctgtatgcatcactcataaggccaattgcatccccaaaaatagtcacaggaagttgctacgttcaaactgtgtatgtatacagtcactttctcagtgcacatgaaaatctgtaaccatgttagtagcaaggagaaagctcatccttcaagattcatgggctacttattgtcttggtaaatagtgtttgttttakgaatacttggaaaatgcatttacatcatatttcaatggattaaagatttttgtgtgtgactaagatgtttagaagtactattgtcaagggaaaaataattattcttgtgttatgaagacttataaacagcccaggctctctaaacatcatttaattttcttcctttggtccctctccaatgtagaccaaatctcagtgtgttcagtgttaatgcaaaaaacctaatttaggtctttcctcaaaagggatatatgtacgtatataagtatatatacgatatataaaatacataccacacat

SEQ ID NO: 72969 - DNA, 601 bp, Human
atttctccatagataaaagagtgagatttttcatcagattttgtcagtgttgtgttgcatttatctcttcaaatgttcctgttttctttttttaaatatacataaatttagatttgtcagtgacggggaaaaatgatgatgaaacacattttctgttctaggaagctgagtccatcaggttaaacagagggaaaagaaaaaaaaaaaaaatcctgatacttttctatcacattaaaaacgggcagaaaagtagaaggctaacttgttaactcctcacctgataaactttcaaggatggaaytcagattctgtatgcatcactcataaggccaattgcatccccaaaaatagtcacaggaagttgctacgttcaaactgtgtatgtatacagtcactttctcagtgcacatgaaaatctgtaaccatgttagtagcaaggagaaagctcatccttcaagattcatgggctacttattgtcttggtaaatagtgtttgttttaggaatacttggaaaatgcatttacatcatatttcaatggattaaagatttttgtgtgtgactaagatgtttagaagtactattgtcaagggaaaaataat

SEQ ID NO: 72970 - DNA, 601 bp, Human
ccctgtgacagcatgttttgtgagtgtgacgtccactgcaaagggtctgtcaaaaagcacctttcagaaaatgaaaagagaatgctgtcctgatgataaacctaatttctccatagataaaagagtgagatttttcatcagattttgtcagtgttgtgttgcatttatctcttcaaatgttcctgttttctttttttaaatatacataaatttagatttgtcagtgacggggaaaaatgatgatgaaacacattttctgttctaggaagctgagtccatcaggttaaacagagggaaaagaaaaaaaaaaaaaatcctgatacttttctatcacattaaaaacgggcagaaaagtagaaggctaacttgttaactcctcacctgataaactttcaaggatggaactcagattctgtatgcatcactcataaggccaattgcatccccaaaaatagtcacaggaagttgctacgttcaaactgtgtatgtatacagtcactttctcagtgcacatgaaaatctgtaaccatgttagtagcaaggagaaagctcatccttcaagattcatgggctacttattgtcttggtaaatagtgtttgt

SEQ ID NO: 72971 - DNA, 601 bp, Human
tttttcaccagagcagactctaatcaagtgtgtagatgctgcaatacaccaaatggcagaggagaattaatgttcctcttgtgggttcctgaagtgtcttaccaccaggaagtaacttgcgcactgaatagaacagggatcattagaaacagttatgcaaaacttaagaacagaaatacccttgctttatgtgaaggttagaatttgatgattttgttttggtgtccttggggtggagacttaggcaaaataccaaatcatacccacagtcacagagctcaaattaagaggggggaaatgmcagtttacaattcctctcatctattgttggcttcaaacactgttagaataatgttcccaagttaattctttgcttgtaaaaattttaaaagaaaaagggccacatatacacagtaatttttgaggccaactccctctccacaaattacccacgaaaatgaaaacttttgacaccaccattttaagtaaaaccctggtgaagtcactgaaaacattggggaagtaacttgacttttaggcacatgttgctttccttatcacgaagtcaggattagatgacaaataaatactaggggaagtg

SEQ ID NO: 72972 - DNA, 601 bp, Human
tcagggttgttttattaaagacaaaagtgggaaggaaagatttttttttcttaagcataaagtataaaagccacataattttgcccattgggtttatatggatataagacaccaccctgagaagcaaatttaagacatagttagcaagtcaagtcagaatggaatacctatgaaaaataagtaaaatttccctattggacttattaactccaatatctaagtcactccctggggagaatttggctcttatataggaatgctaactttttttcaccagagcagactctaatcaagtgtgtaratgctgcaatacaccaaatggcagaggagaattaatgttcctcttgtgggttcctgaagtgtcttaccaccaggaagtaacttgcgcactgaatagaacagggatcattagaaacagttatgcaaaacttaagaacagaaatacccttgctttatgtgaaggttagaatttgatgattttgttttggtgtccttggggtggagacttaggcaaaataccaaatcatacccacagtcacagagctcaaattaagaggggggaaatgccagtttacaattcctctcatctattgttggcttc

SEQ ID NO: 72973 - DNA, 601 bp, Human
aaacatcagcacataaaccaataagctgacagtggaaaatttcagggttgttttattaaagacaaaagtgggaaggaaagatttttttttcttaagcataaagtataaaagccacataattttgcccattgggtttatatggatataagacaccaccctgagaagcaaatttaagacatagttagcaagtcaagtcagaatggaatacctatgaaaaataagtaaaatttccctattggacttattaactccaatatctaagtcactccctggggagaatttggctcttatataggaatgytaactttttttcaccagagcagactctaatcaagtgtgtagatgctgcaatacaccaaatggcagaggagaattaatgttcctcttgtgggttcctgaagtgtcttaccaccaggaagtaacttgcgcactgaatagaacagggatcattagaaacagttatgcaaaacttaagaacagaaatacccttgctttatgtgaaggttagaatttgatgattttgttttggtgtccttggggtggagacttaggcaaaataccaaatcatacccacagtcacagagctcaaattaagaggggg

SEQ ID NO: 72974 - DNA, 601 bp, Human
tctcactttgcacatcacaagactaggacagatgcccttcctttgtgctcccatgccactttgtcctataccccacagccagttatatggcaaactcttcaaactcctgttcacctagaactctccatcacctagattaccacttggaacaagagatggtcaatatatctttgctaaataagtcaatgtataaaggaaggaatgaaaccaagacatgagagaaacatcagcacataaaccaataagctgacagtggaaaatttcagggttgttttattaaagacaaaagtgggaaggaaakatttttttttcttaagcataaagtataaaagccacataattttgcccattgggtttatatggatataagacaccaccctgagaagcaaatttaagacatagttagcaagtcaagtcagaatggaatacctatgaaaaataagtaaaatttccctattggacttattaactccaatatctaagtcactccctggggagaatttggctcttatataggaatgctaactttttttcaccagagcagactctaatcaagtgtgtagatgctgcaatacaccaaatggcagaggagaattaatgt

SEQ ID NO: 72975 - DNA, 601 bp, Human
ggatcaaatcctaaagactcaagctaacagccaatttggagtagattcccttatgattttacttctggagttgagaaatatgtgaataaacatggggccaattattatcatcaaatgaataaaaagtcttatttttaaatttgattggggacagaaagatcatagaaatcaactaggaaggaaagaaataaaattcattctgaaaatgacaacaagtctaggcataccctaccctgatgccaacaccattggctcattcattcattccctgaagttgtagccatagtgttcctactaaaayataaatctaatatgatcccaaacaagaaaaagcaaaaccttcaaaacttctcattaacctcaggcaaagtccaaaacccttaaattgatttcaagatccttcattatcaagtccctgactccatcttcatcactagtaacctgcttcttcacatcatccatgaccctttggccatttgtaacaactctcatttcctcgaaggagcaaaactctctctcagcctctgagcttgtgcaatgactgacctctccacttggaatatctgctctctttccctccacccttcacgagttaatgtct

SEQ ID NO: 72976 - DNA, 601 bp, Human
tctaacccattttcaagggacttgtttccagaactggaagaaatgttacatatggttatgatggcatgatttgatacggagagccttgttctttgtagaaatcaataataaacatctcgaatccagataggaataactagtttgtagctacaaattttaagattgtatctgtaaacttggaaacctcttaattcataggtgccattttttaaaatgtataaatttcctggtcactcaatcctttctcttttaccaggtccctctgcctctacctcccatgcaccccattcctgaattcccytccttttctttttggtcacattgtatctggtttttactctctgagatgccagctcggcttcctcaacacatctcagtcctgtttagttctatttccactctgctccatctagtggaatgctgatttttacagtatggtgccagctttgcttactctactttgctgcgcagggtcaagatataaacattgaaacaaaaccaaactttaacctttgatagataagttaagtatcatttcccaaatacctggacagaaaccagaattccacgagcatgcttatgtgaagaaagtggaaacatg

SEQ ID NO: 72977 - DNA, 601 bp, Human
tgtccctgtcctagtccagcaaccctcccgccacatttggtgcattcctctgtcttactacctccccactctgttcacttctttcaaggcaggactaatattttatttcagtctgtcgttgtttctaccctagattattgcaggaggttcctcgctggtatctttgtaactggccttgcccgctgccttatcccttggccacactgcagtctgactcattgttctaaaaatgagagagtcagggcatagatagccaaatagattagaatcaaaagtaacagcactgtaagttattccatgragctaaggtttatttttctctatctttgtgcccagggctctgccagaacctaaaagacctaaagtataagataagcagtatttctggaatttgtgaccactaaagtctattaaacggcaaggaaatcctccaaagcagattttctaacccattttcaagggacttgtttccagaactggaagaaatgttacatatggttatgatggcatgatttgatacggagagccttgttctttgtagaaatcaataataaacatctcgaatccagataggaataactagtttgtagctacaaatttt

SEQ ID NO: 72978 - DNA, 601 bp, Human
ttagtattcatgaaataataacaataataatagctttgttcctttctcagaaacacgtactggctcaaaactgttgttatattaactcttaactaccacatctattctaatgtttctctaaactgggtccaccctgcttatcaatccttatcacctaccaaatgtcccaatagtaccatttgatcatttttgtcctcactttacttatgaaaactctttactgatgctcatttggcaaaaaaaaaaaaaaaaatctatattaacacttgttctccatatgaagttgatccttataataacrtcttgcttttcctattttcacctggaaacatcatgcttccctacacaaacactaaattccaggtgtctagagatgataacataggaagcaatatattgtagtaattaagattcaaactctggagtagactgctcaactccaaattccatctccagcacttaaaagttatatgagctcaggcaagccttttaacttctgtgtcttcgtgtccatcattatctgtaagatggggataataatatctatttcatacagttgttataagaatcaaatgagcttctacatacatatacagtgctt

SEQ ID NO: 72979 - DNA, 601 bp, Human
tctaattctactatttctacaggattagtattcatgaaataataacaataataatagctttgttcctttctcagaaacacgtactggctcaaaactgttgttatattaactcttaactaccacatctattctaatgtttctctaaactgggtccaccctgcttatcaatccttatcacctaccaaatgtcccaatagtaccatttgatcatttttgtcctcactttacttatgaaaactctttactgatgctcatttggcaaaaaaaaaaaaaaaaatctatattaacacttgttctccayatgaagttgatccttataataacgtcttgcttttcctattttcacctggaaacatcatgcttccctacacaaacactaaattccaggtgtctagagatgataacataggaagcaatatattgtagtaattaagattcaaactctggagtagactgctcaactccaaattccatctccagcacttaaaagttatatgagctcaggcaagccttttaacttctgtgtcttcgtgtccatcattatctgtaagatggggataataatatctatttcatacagttgttataagaatcaaatgag

SEQ ID NO: 72980 - DNA, 601 bp, Human
atccctgaaagtctcacccaaattcaagcttcaaatttttaactgcttctaagtcattttgatttggacaccccattattacctaaaacccagcataccttaactaaactcatgatgaatataagttcagtacttatcagagggcttataagaaacagagaaagtactctaaatattaattaagtaaattactatttcttctcatccgagtttctactctcaatttcctcaattctgttacttggcttccggtaccctactttgtttctctgaaataattgagttgtcttacgttgttccyctcattgaaccttcattcaaaatgctcaccaaatatctcaattctttcataacagactctgtcagatttaactctgaatgctaccaccctcagacagtgatcatcttatacgtgggccaatgaaactgtctcctcttttagcccaattatgaactgtctctttcccctttcatctaattctactatttctacaggattagtattcatgaaataataacaataataatagctttgttcctttctcagaaacacgtactggctcaaaactgttgttatattaactcttaactaccacatcta

SEQ ID NO: 72981 - DNA, 601 bp, Human
tcacccaggctggagtgcagtgccgcgatctcggctcactgcaagctctgcctcctgggttcacgccattctcctgcctcagcctcccgagttgctgggactacaggggcccaccaccacgcccggctaatttttgtatttttagtagagacggggtttcaccatgttagccaggatggtctcgatctcctgacctaaactctaacttttaagaacaaatatgatacatagaacagggaagatactgcttgcagcattatatagattagcatcacccatataggttataccatttttatckcactaaattcctgcatcctgtaaataacacacccacatgtggagaccagaacataccaacataaaatattccctgcccctgttcttctggcaaagagaaaaggtaccagtgacaaaactatactattgagggaccaaggaaattgaagagttactttatcaacttctgagggtgtaaggaaacataaaacaaagctagccaaatgcttacaaatactgataagaataactagaccatgtagcactgaaaacttacccaatgtcacgttaaataccgacctttctaggagacataacctct

SEQ ID NO: 72982 - DNA, 601 bp, Human
gaaaaagggagatacaaccatgtgaagtaagctaaacagttcttatagaagatatcatcatgtttaaaatattcatccttttttcctctggaagtacaaaatatttacttctgtagttacagttcaatgcaacttatgactaaaactgtcatcagctgaaatcattaaacttttttttttttttttttttttttgagatggagtctcgctctgtcacccaggctggagtgcagtgccgcgatctcggctcactgcaagctctgcctcctgggttcacgccattctcctgcctcagcctccygagttgctgggactacaggggcccaccaccacgcccggctaatttttgtatttttagtagagacggggtttcaccatgttagccaggatggtctcgatctcctgacctaaactctaacttttaagaacaaatatgatacatagaacagggaagatactgcttgcagcattatatagattagcatcacccatataggttataccatttttatcgcactaaattcctgcatcctgtaaataacacacccacatgtggagaccagaacataccaacataaaatattccctgcccctgttcttc

SEQ ID NO: 72983 - DNA, 601 bp, Human
catttctttatcaaaatactctacattaatttgagcatatgaagcctgaaaataaattactagtatattttgaaaggaatctctctatttttagatgggattagcatttattagagatatggaaataaaggaaaaagggagatacaaccatgtgaagtaagctaaacagttcttatagaagatatcatcatgtttaaaatattcatccttttttcctctggaagtacaaaatatttacttctgtagttacagttcaatgcaacttatgactaaaactgtcatcagctgaaatcattaaacttttttttttttttttttttttttgagatggagtctcgctctgtcacccaggctggagtgcagtgccgcgatctcggctcactgcaagctctgcctcctgggttcacgccattctcctgcctcagcctcccgagttgctgggactacaggggcccaccaccacgcccggctaatttttgtatttttagtagagacggggtttcaccatgttagccaggatggtctcgatctcctgacctaaactctaacttttaagaacaaatatgatacatagaacagggaagatactgcttgcagcatt

SEQ ID NO: 72984 - DNA, 601 bp, Human
ggcatggaattcaagcaacaccttccatcagctggatcgtatctacttctctatccttagctccaaattctgccttttacaaaaacttgactctagccaaaatgatacttactatatcaggaaaacaccatgaaagttatccttctgaggcttcatttgaccacaatgacctcaatggagaaagtcctttgtcttgacctctgcagttctaagaactaacatttatttaagaacagtagaaatttcacttccaaaggactgcttaaaacactctggtcatcttaaatcagttcaggaaccraaccctgatggctggtgcctgccattttaaatggaaactcatctctgctttcttgaattattagttttcttttaggcattctctgatccttctcaactgaaccttcagccctttaggaatacagactccatacttgaaattccctcacatgttagaatggcctacacgttgtaaaaattttgtttactatgatattaagagaaaggtatgtttcttctttttattaagtagctccaatggaaaacaaatgaaaattaacacacacacacacacacacacacacacacacacgcttcccat

SEQ ID NO: 72985 - DNA, 601 bp, Human
cttcccaaccataatttttgaggttaacattaaaatccaattgtatttttcacaacatagaatggtttgtttagttgaagacttaacagatgcctaaggaattgacttgataactgaataatccacggagtacacccaatgcatgtggccaggagagtcaagctgaactacaaatatctagtcagtaaaatgccttaaaatgttttcaaactaatatgcctattcaatgtgaattagaaaagctctaagtaggcaacaccgagtcaagaagattgaaagcacacactttctctgtctatgwtctttctcgaaatttcaacaagtcaaacataatcctgttattaggtactaaaaatctacataaatacatgtagagaaaaatttttcctataacttaggagccttccacactctaatagcaaagaatatagtgtagtttttttaagtccaggctcagaagccaatttctgggtttcaatccctactgtgtaacttaccagctatgtgattctgatcaaattatctaatatctcagttccccaattttctcatccacaaaatgggttaaaaatcgtatctaattcatagcattgttttgagg

SEQ ID NO: 72986 - DNA, 601 bp, Human
atgaatattttacggtaatgcttcaatattaaaatccccatattgagattctagagtaacatacaaattatatttaaccatcaaaaaattcattgaagtacttattagagtatcagtaataatagtcattaaaattttatgatcacttaaaagaacactgaataaagacagtttagcaaatgccctatttacatattttaacaagactcacatagtaatatcaaaatcacacattgaatttgagagtaaaattacacttgccctcaaaagaacagatatattatggatataccctgatagrtttgcgtgttttcccaatagtggggcgagttgcactgattcattcacactgcctttttggaccagctgcaacattataaacattatacaagatctgactaagaatcaggggttcaatctatgaataaagaacagaattaactaggtaggttatacaggaattgaatctgccaccttagcctcatttggtaccatgtcctattttgttcagctacaatcttacatattcatctacctaatttacatatatataaataagtaatatgtatataacgattcagacatccgtatgtatacatta

SEQ ID NO: 72987 - DNA, 601 bp, Human
ggagatctgcccgcctcggcctcccaaagtgctgggattacaggcgtgagcaccaggcccagccaaccttgcctatttctaggcaaggtctccacctcagcctgatcacattgtgggtgtcagtcatttgctttctatagccaggataaagcatctcaccccatataagaaggctccaggtcctaagcccaatgtgttgggattatactagggtcgctgtggtggatgatcacagaagagggtccactggatcctggctgtcactactgtgtgcccacagagacttggaaagtaactaccycaaagctacccaaacccgtgggtgcaggtggcttttgttaacagtgaaagcctaccaggagattggtagtaaattcaagatacatgctctactctgaaccatttgggggaatgggcgcagtgacatagaaaaacgcagctttagctaatgtcctcttcacaattatctttctcaaatcaaaaagtgccagactaaaaaacaagcgtgtctgattaaaaaaattttagaaaggttgatttgtttccctctttctctcatcgatttctctacattttgtttataaatgcaaatgtgttagga

SEQ ID NO: 72988 - DNA, 601 bp, Human
tttttttttcctgagatggagtctcactctgtcgcccaggctcaagagattctcctgactcagcctcctgagtaggagggattacaggcacccacaccacacccagctaattttgtatttttagtagagacagggtttctccatatgggtcaggctggtctcagactcccgacctcaggagatctgcccgcctcggcctcccaaagtgctgggattacaggcgtgagcaccaggcccagccaaccttgcctatttctaggcaaggtctccacctcagcctgatcacattgtgggtgtcagkcatttgctttctatagccaggataaagcatctcaccccatataagaaggctccaggtcctaagcccaatgtgttgggattatactagggtcgctgtggtggatgatcacagaagagggtccactggatcctggctgtcactactgtgtgcccacagagacttggaaagtaactacctcaaagctacccaaacccgtgggtgcaggtggcttttgttaacagtgaaagcctaccaggagattggtagtaaattcaagatacatgctctactctgaaccatttgggggaatgggcgcagtga

SEQ ID NO: 72989 - DNA, 601 bp, Human
acacatgttttaaggtagctttcctgcatgacgtacaatctctgttaataactttgcatcagaagcccagctagctacagggaagaccccagttcttggcatttcagagtggtcagctggtactgaaaagtcaactctgtgtttggtatatggcattgtgagaaacattaatctccccctaccatcatagacctttttatcctctccaggctttaatgctgtcctcactctagtgttacccatatgtggaaagaagaaatactgtccataagaccagcagaccttgcctatttctctctcttttttttttttttttcctgagatggagtctcactctgtcgcccaggctcaagagattctcctgactcagcctcctgagtaggagggattacaggcacccacaccacacccagctaattttgtatttttagtagagacagggtttctccatatgggtcaggctggtctcagactcccgacctcaggagatctgcccgcctcggcctcccaaagtgctgggattacaggcgtgagcaccaggcccagccaaccttgcctatttctaggcaaggtctccacctcagcctgatcacattgtggg

SEQ ID NO: 72990 - DNA, 601 bp, Human
agaacaaaaatatatctagactctttgagcacttctttcctaaagaaatcgggttatactttcaagttctttggcatatttttctactacggagctcattctgtaggttagtctactcaccctggtctatttccttaacgtagggcttgtttacacatgttttaaggtagctttcctgcatgacgtacaatctctgttaataactttgcatcagaagcccagctagctacagggaagaccccagttcttggcatttcagagtggtcagctggtactgaaaagtcaactctgtgtttggtayatggcattgtgagaaacattaatctccccctaccatcatagacctttttatcctctccaggctttaatgctgtcctcactctagtgttacccatatgtggaaagaagaaatactgtccataagaccagcagaccttgcctatttctctctcttttttttttttttttcctgagatggagtctcactctgtcgcccaggctcaagagattctcctgactcagcctcctgagtaggagggattacaggcacccacaccacacccagctaattttgtatttttagtagagacagggtttctcc

SEQ ID NO: 72991 - DNA, 601 bp, Human
ttggtttgtggagtgatcagactaggggaagttttttggaaatttctgggttactgttgggaatttttccagaaatggattcttcttctttggaagtcttttggtcattagtttaaatactatattggaaaatttctacataaagatttgtaatgtgcccccaattttctgtttataggatttataagaatattattgtaatggtaacatcttgtaatggtgacaatatttctattaattttatgaaaccctataccactgctttaatctctgcagtaagaagtcattattttttaaagcrccaaacacagaatgtgtttattacaattcttcatgacccaaattatttttggcagaggtgctataagtttttccctctttatttataaaaatacattatctgtaattctgggaaattgaccacaaaatgacgtggaaagcaccttaaaatctttacgtatgagaccacgtaaagcctcataataactactgtgatataacattgttgtgttcaaccattacatcatttgttttactcaaaagtgtgtgcctctctacgtataccaattttaacaacgttgtattttactgttcacatcct

SEQ ID NO: 72992 - DNA, 601 bp, Human
tgaagaaattttcagcttttcgaattgaactgtaaattgtttctgctttccatagtatcttaaagggatttcagggggaatttttgtttggtttgtggagtgatcagactaggggaagttttttggaaatttctgggttactgttgggaatttttccagaaatggattcttcttctttggaagtcttttggtcattagtttaaatactatattggaaaatttctacataaagatttgtaatgtgcccccaattttctgtttataggatttataagaatattattgtaatggtaacatcttrtaatggtgacaatatttctattaattttatgaaaccctataccactgctttaatctctgcagtaagaagtcattattttttaaagcgccaaacacagaatgtgtttattacaattcttcatgacccaaattatttttggcagaggtgctataagtttttccctctttatttataaaaatacattatctgtaattctgggaaattgaccacaaaatgacgtggaaagcaccttaaaatctttacgtatgagaccacgtaaagcctcataataactactgtgatataacattgttgtgttca

SEQ ID NO: 72993 - DNA, 601 bp, Human
gctggtaattttattagaaccattaccagtgaagaaattttcagcttttcgaattgaactgtaaattgtttctgctttccatagtatcttaaagggatttcagggggaatttttgtttggtttgtggagtgatcagactaggggaagttttttggaaatttctgggttactgttgggaatttttccagaaatggattcttcttctttggaagtcttttggtcattagtttaaatactatattggaaaatttctacataaagatttgtaatgtgcccccaattttctgtttataggatttayaagaatattattgtaatggtaacatcttgtaatggtgacaatatttctattaattttatgaaaccctataccactgctttaatctctgcagtaagaagtcattattttttaaagcgccaaacacagaatgtgtttattacaattcttcatgacccaaattatttttggcagaggtgctataagtttttccctctttatttataaaaatacattatctgtaattctgggaaattgaccacaaaatgacgtggaaagcaccttaaaatctttacgtatgagaccacgtaaagcctcataata

SEQ ID NO: 72994 - DNA, 601 bp, Human
cagaataagcaggatgattcaactggtcttcaggggccttctcctctgctggtaattttattagaaccattaccagtgaagaaattttcagcttttcgaattgaactgtaaattgtttctgctttccatagtatcttaaagggatttcagggggaatttttgtttggtttgtggagtgatcagactaggggaagttttttggaaatttctgggttactgttgggaatttttccagaaatggattcttcttctttggaagtcttttggtcattagtttaaatactatattggaaaatttctrcataaagatttgtaatgtgcccccaattttctgtttataggatttataagaatattattgtaatggtaacatcttgtaatggtgacaatatttctattaattttatgaaaccctataccactgctttaatctctgcagtaagaagtcattattttttaaagcgccaaacacagaatgtgtttattacaattcttcatgacccaaattatttttggcagaggtgctataagtttttccctctttatttataaaaatacattatctgtaattctgggaaattgaccacaaaatgacgtggaa

SEQ ID NO: 72995 - DNA, 601 bp, Human
aactcaggttcttccaaaactgctttgtgggacttatttaacctaaaagctcagtgatgtttacctgtgagcctgcagcagcgcagtggaataacttaataaatggaagtggcagagacacctttatgtttcctatgcaaatactgcttacaaaagccattaatgggaattatggaaggggaaagccaactaaatacatgggccagaataagcaggatgattcaactggtcttcaggggccttctcctctgctggtaattttattagaaccattaccagtgaagaaattttcagcttttcraattgaactgtaaattgtttctgctttccatagtatcttaaagggatttcagggggaatttttgtttggtttgtggagtgatcagactaggggaagttttttggaaatttctgggttactgttgggaatttttccagaaatggattcttcttctttggaagtcttttggtcattagtttaaatactatattggaaaatttctacataaagatttgtaatgtgcccccaattttctgtttataggatttataagaatattattgtaatggtaacatcttgtaatggtgacaatatttctat

SEQ ID NO: 72996 - DNA, 601 bp, Human
aacacacatataaacacactcatgcactcatgtgtgcactcagacacacataggaaattcaaataagccttcaaagaaagtctcctggaatatctgctgccaatgagtttatcatcagtattgacggaacatgaactcaggtcacaaaactatgggttttggtcacaaaactgggtttagaggcagtgagaggaggaggtgagacaagaataaaacttattgcctgccctcaagggcccagaatctaccgggggactctaataactcactgtcatatattttgtactgtgctagaggtatrtaaaaaaaaaaaaattcctatgggaatataggacaagaaacaattcttcctgaggattcacaaaatagaagtgctttcttttggatatgttgaatttctccaggcaaagatgagggtgagaagagcattccaggttgagagaatgaagaagcagaaatatggaggcatgaaaagcatgctatgagcaggcaagtggctgaaacatctggtgcctaaagaaggctagggagagaacattttaagttccaattgtgaatggctgcttatataactactagagagtttggactttttcctatg

SEQ ID NO: 72997 - DNA, 601 bp, Human
tgtactgcctctgagaggagtaactaacattgcaagaagcatctcagttgggaggccgaggtgggaggatcacttgaggtcaggagttcgagactagcctgaccaacatgatgaaactccgtctctgctaaaaatacaaaaattagctgggcgtagtggcaggtgcctgtaatcccagctactcgggaggctgaggcaggagagtctcttgaacccgggaggtggaggttgcagtgagccgagatcatgccaatgcactctagcctgggcaataagagccaaaagtgaaactccgtcctcaaaaaaaaaaaaaaaaaaaaaaaaaatcatctcagacacagtttggcacacggcaggtatttgatataagtggtaagttctctccatttgtctgtttcttgtgttttcttttcatataaatcaataatcagattctcctagagtagcctgaagacctaattccattggtataccagatcttagcagggagtcattagatacaaaatcttataaaggtgtgtataaatgtgaagtctacttaatgtaacacacatataaacacactcatgcactcatgtgtgcactcagacacacataggaa

SEQ ID NO: 72998 - DNA, 601 bp, Human
tgctaccaagaaaaaaattgtgtgtgtgtgtgtgtataaataaatatatatgtatatgtacatgtgtgtattttatttattgataatgttgagcactaatcctgtgaaaaacattgtcttaagtgctttacatgtattaactcatttattccttagaacaaacctgtgagaaaaaaggaaaggaaacagtggttaagtaagtgcccaggtttacttaccttaaaatggtagaggcagaactggaatctagctattgtactgcctctgagaggagtaactaacattgcaagaagcatctcakttgggaggccgaggtgggaggatcacttgaggtcaggagttcgagactagcctgaccaacatgatgaaactccgtctctgctaaaaatacaaaaattagctgggcgtagtggcaggtgcctgtaatcccagctactcgggaggctgaggcaggagagtctcttgaacccgggaggtggaggttgcagtgagccgagatcatgccaatgcactctagcctgggcaataagagccaaaagtgaaactccgtcctcaaaaaaaaaaaaaaaaaaaaaaaaaatcatctcagacacagtttggc

SEQ ID NO: 72999 - DNA, 601 bp, Human
cattcatttcaatcttctttcttaggggatcataaagtaaatttcctctaagtgatgaaagaaaaggagggagatacttctagacatctaagaccttcttagggaatcactgattcaccaaatcataacctaatccttcctggagctcctggagttcaattcacagaaatgataggactggacaacattactgggcccttgtgcatggaatgtgtggatattctagagcccagacactgaactcagaagccagtgttccatttttggctctttactgatgagtagccgcctttaatttaayccaccttttcaaccggaggcactgttaaacagttccttaggtctgatggttcttggggatctaagctcatttaaaataggcagaaatcactaaccatattattaaaatctaatgaagcaatcagattgcatcttgttataaaaaccactttaccaattccctctagttcacaaaacacctctgaaattaatatatctagagtaatatagctaaaaaagaggaggaattgtgtcttctgaaagatgtacaaataaatgacatacatgtcttctttgtagcacagtggtctccagtacatat

SEQ ID NO: 73000 - DNA, 601 bp, Human
tttgctatatgagacacagacaaatctttgaccaatctttaattagtatcactgatgaaatatttattcttttaatttgaatttagaaacccaataaagccatgtttgcatcttttatcaacttaaatattatcctcctttattgcttttgtcatgactgtagattctgaagatgttctcctgaaacaatgcgtatttcatgtatgcatagttgccctggtctcattgcttttggggcaaatatttaatataggcattcaggtcatacattcatttcaatcttctttcttaggggatcatraagtaaatttcctctaagtgatgaaagaaaaggagggagatacttctagacatctaagaccttcttagggaatcactgattcaccaaatcataacctaatccttcctggagctcctggagttcaattcacagaaatgataggactggacaacattactgggcccttgtgcatggaatgtgtggatattctagagcccagacactgaactcagaagccagtgttccatttttggctctttactgatgagtagccgcctttaatttaatccaccttttcaaccggaggcactgttaaacagt

SEQ ID NO: 73001 - DNA, 601 bp, Human
ccactgttgaggggtggaaaggaaaagattttcatctggttaacagagaaaggtaatttatcattagataaacccacagattgatctgtagatattctagggaatccttgaaagaggctgttcacagggaaccctcttgttatataatagcaattgaacccataatggttttgttgtccttaggaaactgtaaagaatttctacattcataaaatcatgttacctagaaagtataaaagaaatcttgtctattccaatgacattcagactcctgagagggttaaagacagttccagctgamtgctgaccacaatccctacacccccatgaccctggcctggagaaaagtggatggagttagatgtggaaaaaactggccaccaaaactgacaatagtacaggtttgaccatcatgacctctctgtcacttgtttacatttattatgtagacaagcaagaacactgcggcatcagcctaacttacaaaataaaagtaaatgagatcagggtgagcacaatggtcaggaaggctggacagagtgggcgcttgcacggcaatttacatgctttatatttgaaagaaagaaactgaatgaagaga

SEQ ID NO: 73002 - DNA, 601 bp, Human
tcataaaatcaaatgaaggcaatgtgatctgtactttcacaatatgagaaaactagacatatggagcagtttgcaaaagattatcaatcattctattaaaaaaaaacaaagtgtgaaacaggtaacattatgatcttcacacaacacattagccagtatctgagtaagattttagaaaagggtatgagaatgtctctcaggaatgagaatagcatcaacatctcccttacaaaaggaaatttttaaggtgtgaaagaggattatatctaaaaataactatatgtgtctatgtatactgtcrccaatagtaagatgattgttgtactataattatacaagattaaggtaataataacaaaaggaaagaaaaattttgtgtggaactcgggaaagacatttgctatattatgtatagatctgccatctagttcattagtgccaaaatgatttgctttctgaggatcaatcattagaggaactctaataaaaatttcaatgaaactatgaaagagaaaagtaaacgaaagactgggtttcatccttatgcacccaatctgcaagaaaagcaaaaatcaataaagagagcttaaattaaaaaaaa

SEQ ID NO: 73003 - DNA, 601 bp, Human
tagtaaaacatctgtttgggaaagaggaaatataaactcataaaatcaaatgaaggcaatgtgatctgtactttcacaatatgagaaaactagacatatggagcagtttgcaaaagattatcaatcattctattaaaaaaaaacaaagtgtgaaacaggtaacattatgatcttcacacaacacattagccagtatctgagtaagattttagaaaagggtatgagaatgtctctcaggaatgagaatagcatcaacatctcccttacaaaaggaaatttttaaggtgtgaaagaggattakatctaaaaataactatatgtgtctatgtatactgtcaccaatagtaagatgattgttgtactataattatacaagattaaggtaataataacaaaaggaaagaaaaattttgtgtggaactcgggaaagacatttgctatattatgtatagatctgccatctagttcattagtgccaaaatgatttgctttctgaggatcaatcattagaggaactctaataaaaatttcaatgaaactatgaaagagaaaagtaaacgaaagactgggtttcatccttatgcacccaatctgcaagaaa

SEQ ID NO: 73004 - DNA, 601 bp, Human
agtggccagtgctcggctttcccaagtgcacaatggggcttcatctgagagtgtcacagaaagctagaaactgtgccaactgtcaatgtcagggcaatgggtctttaatagagtggcactgtcaggaacaagttaataggaaacagacacaaggatacaattctttctctctcctagtgtcctgaatcccagccccccatatcacaaagaagagcaggtttagagctgagagacaatagcttaataaggggcatataggcttaagagagctttcataaatggatcatcaacctcatctctraaaaacagtgacctttccataaaagtgcatcctatgacattagaatgggattgggtcactttcttgatccaataatctgttgctaatacctagcattcacgccctaaccaccctgcatacattcttttccttggcctgtaccatctaaaatatttgcctgttgttccttgatctaaacatgcattcttgacctttttaacttaaaaccacaaagtatatcatcatttttcaccaaatacactgtaacatttttgtgtaggatgaattatctttgaaatatattgaaactctagccctctg

SEQ ID NO: 73005 - DNA, 601 bp, Human
aaaagaaagagtgtacataaaattaggaaactgcggttccacctgtgttagagtccagacagtgaatcggaaaccacagtaggcacttcaacagggagaattcaatatgaaaactttggtccaaagggtgttggagaattacaggagcaaaaactgaacagggattgtaactacaggaagcaactactgcctctggaaattgtgggaataaaaggaagtgttcggcacatcagaatctagaagctcagtgaagagggcctgttggactgagactggtatcagaggagtcaaagccagtggycagtgctcggctttcccaagtgcacaatggggcttcatctgagagtgtcacagaaagctagaaactgtgccaactgtcaatgtcagggcaatgggtctttaatagagtggcactgtcaggaacaagttaataggaaacagacacaaggatacaattctttctctctcctagtgtcctgaatcccagccccccatatcacaaagaagagcaggtttagagctgagagacaatagcttaataaggggcatataggcttaagagagctttcataaatggatcatcaacctcatctctaaaaaa

SEQ ID NO: 73006 - DNA, 601 bp, Human
gttaccatcttgttataatctggcagaggtgataatttgaaggaaatttgtgtactgtttttcaggttatgaagcacttcatctagcttacctcatctgattcgcatatttattgtatgagataggtattactatgtttctcattttaaaaatgaggaaggtgaggcagattcaatccattacaaggtttgtgaattacagtgagtacttctaacatcagtactacacagctgtcttccctacatacaggggactgtttgcatttcagcattatcaaaaagaagaagaaatctattagagaaagaacagccaccgaaataagttggtattgttcaggttgctcaatgtgaatgaataacagtcactatgccatctcaattaatgaatggatgactgtagtaatctatcttcttttccattgttgcttagctttttaactaaaatggacagtcttctattgttaattgttttctttttaaagaagagggaaaaaaataaaatgaataaaatcaattatacttgttggtgaattccatatatttgaggcacaactttactgttttaattaaatggaaatataggctcattgttttaaagacaa

SEQ ID NO: 73007 - DNA, 601 bp, Human
cttggcctggctgttctcaaactcctgacctcaggtgatctgtccacctcggcctcccaaagtgctggaattacaggcgtgagccaccacacctgggctggtgttaccatcttgttataatctggcagaggtgataatttgaaggaaatttgtgtactgtttttcaggttatgaagcacttcatctagcttacctcatctgattcgcatatttattgtatgagataggtattactatgtttctcattttaaaaatgaggaaggtgaggcagattcaatccattacaaggtttgtgaattayagtgagtacttctaacatcagtactacacagctgtcttccctacatacaggggactgtttgcatttcagcattatcaaaaagaagaagaaatctattagagaaagaacagccaccgaaataagttggtattgttcaggttgctcaatgtgaatgaataacagtcactatgccatctcaattaatgaatggatgactgtagtaatctatcttcttttccattgttgcttagctttttaactaaaatggacagtcttctattgttaattgttttctttttaaagaagagggaaaaaaataaa

SEQ ID NO: 73008 - DNA, 601 bp, Human
ttcaagatggtgctgtcatctatctttttttttttcttctggagatagagtcttgctgtcaccaaggctggtgtgcagtggtacgatcttggctcactgcaacctccacctcccaggttcaagcgattctcctgcctcagcctcccaagtagctgggattacaggcatgcaccaccacgcccagctaattttgtatttttagtagagatggtgtttctccatcttggcctggctgttctcaaactcctgacctcaggtgatctgtccacctcggcctcccaaagtgctggaattacaggcrtgagccaccacacctgggctggtgttaccatcttgttataatctggcagaggtgataatttgaaggaaatttgtgtactgtttttcaggttatgaagcacttcatctagcttacctcatctgattcgcatatttattgtatgagataggtattactatgtttctcattttaaaaatgaggaaggtgaggcagattcaatccattacaaggtttgtgaattacagtgagtacttctaacatcagtactacacagctgtcttccctacatacaggggactgtttgcatttcagcattatcaa

SEQ ID NO: 73009 - DNA, 601 bp, Human
tgggaatccatcggtctaccttgacataaataaataaatgaataagctgatggggaatggaataattatagtctcaatttatcgcaccacaaaattcttattactctccaagggggaaagagcaactttatagtggaaaagcctggtagatacccccagtcaagtgaccaagataatgtcatcagtaatgagacaaagggcaatttgtgccatctgatataatgcgatgagatcactgcatcacttctgtgatattcctgccaaagacacataacctgaatctaatcacgaagaaacaccrtaatagcccaaattgaggaacactctacaaaataactggtctgcaatcttcaaaattgctagtcatgaaagtcagggaaagaatgtcaatttaattagaaactcatattttgtgtcaatgaaattaaactggtcttagaatttccagtaatcctttgaatatctttatttttacttccttccatgtggctcacactctcttttcttttattctctccttttttccttatttttccttttctccagactccaaaaagttactgttgcctggaagtaatattacctccagtggatcttgatt

SEQ ID NO: 73010 - DNA, 601 bp, Human
ggctctctctggaaaaatctgggacaatttgaggatcaaaataaataatgatagcaatggattataactcattgaataaaatgggaatccatcggtctaccttgacataaataaataaatgaataagctgatggggaatggaataattatagtctcaatttatcgcaccacaaaattcttattactctccaagggggaaagagcaactttatagtggaaaagcctggtagatacccccagtcaagtgaccaagataatgtcatcagtaatgagacaaagggcaatttgtgccatctgatayaatgcgatgagatcactgcatcacttctgtgatattcctgccaaagacacataacctgaatctaatcacgaagaaacaccataatagcccaaattgaggaacactctacaaaataactggtctgcaatcttcaaaattgctagtcatgaaagtcagggaaagaatgtcaatttaattagaaactcatattttgtgtcaatgaaattaaactggtcttagaatttccagtaatcctttgaatatctttatttttacttccttccatgtggctcacactctcttttcttttattctctcctt

SEQ ID NO: 73011 - DNA, 601 bp, Human
gtgaggagaacctctttttttctaaagaattgactcttggcaggcccccagatagcttcagaattagggctggtcaccagaaataccaagtcttgattaaaaacttagaactttcagccacactcccatcaacttccaaagagaagagaaggactgaagactgagttcatcaatgatgaccatgatttaatcattcatgcctacataatggaaacattgtaacaccacctaacagatggagctcgaagagcttctaggctggtgaacacatcaacatgctggaaggtggtgtgccagagasagcatggaagctctgtgcccctcccagtcaggcttatgggactgagctctttacatgtgtgacctgttgctagtagcattgtagatagcatcagaattgaactgaagtactggatacccagttggtgcctagagaatcagagaactgattgttggtgtttgaaaacattcaaaaacaataacagtagtatctacatcttggtttcttaatttcattttataccacaaataaataaagctcctgggagacatggctgacactgaggttgtggcatggaacatacaaaaccagcctggagca

SEQ ID NO: 73012 - DNA, 601 bp, Human
cgtggtatggaactggattagttttggtatttttgttgttaaattccagaaaaaaaactcatgagataccactctagagtgctttacactgaacattatgaacataaaccatacaatcaacactgatttatgtaatgatgtcacatatgttaagaacagacaaaataatttggatgaatacatttttaaaaagtccaaactggcttcttccctcctctctgtctggaatttaagaaataagaagtctactgaaatcttacaccctgaaaaattgtttcacttacgaaggacattaatatgytttctgtgctaaagatctggttagaattttggagaaaatgaaggcagaaggcaatagaattgccaaaaagactgagtattattcagtaatttcaagtctttagacagtattgtgagagtatgggagaaatgtaatcaactacaaacccggttttgtttttttttaatacaagaaagtataagccacaagacagtatctcaattagactccaattcaataactaaagaaggggatgataacgtaagttcctttttctatctcctaaagcttacactttgttggtacatgactttctaagct

SEQ ID NO: 73013 - DNA, 601 bp, Human
ttgcttatgaggacaaatttatggaaaataaccaagagtaaagctttgttcttattaagaaacatgaatatgtatgtaattttagccagactaaattaacccaaaaatgaataaataaaaaaaggacaataattgttgtcacaagagaagacttgtctcccttccccctcttagaaaagcatttatgctcagaatttttttaaaattcacatttttaaataaaaccatttggaaagaaacaaaaggaaaagaatctgcaaggaaaccattaaggagtaagaagcatgtatagttcacctcmttagtaataaaccttcttaaaacagggagagcctgcagtttaaatacagtgcttgatataaacataagacatgaaacttagtgttcatgcaagcagtgcattattgctgaagtgtgtcaattttctaagcatgactatttagaaaggttacattgagtcatcaatcctaattctacattaaacatcttgtgaaactccatgtgctctgaacagagtaagatcctattttagcagcaacagtataaataggaagtaaatataaaatgtatcacagatagtcctgtgaatttttctgtgtct

SEQ ID NO: 73014 - DNA, 601 bp, Human
ctttcaacactttcttttatcagcaccaacataatatttaaggtgacattttatcctccttgaaacttcaacatctgctgttcaacaaatacctgtattatgagtaagtgtttaataaataatatcacattactgatacttcaatacaaattagacattataaatcctatatatatctgtgataaaatgacaatggaagtaaaatagctgtatatttcatgtaaaaatttagacatacattccatagtatgtctatgaaatagacaagaaaatcatttttgcacaattataacttgtttcwcaatccgtaatgttgcttcaaacttataatttggaccaaaatggaattacatctgaaaaatctctagtgcatttagtaatggttagacaatctataccttgattacagtatgtgcccactctgaactttaaaaagaaggaatagcaattttatagtaatctgataaagaagcatttggacctttggggaaagagttaatgaattacagatctgaaaccgggtttcatggattcactgtgaactttcattctaatagttaaagtagatgtctatcaaattgcttatgaggacaaatttatg

SEQ ID NO: 73015 - DNA, 601 bp, Human
taatgtcttaaaaatcaaaaggcatttggctaaagatgaccagatttcattaagtatgccacaatggtgaaaattaatgtttcatctcaacatctacagtcacccttttggcagaaatcacattatgtatagatatatatgtatacctctgtatatatgtatatacatgcatacttgtacatatatccacacacaggggtacatacatagagataaacataaaaacacagacacaatcctaaaccagtaagacattatcaaatttctttatttttctgataatgatttggcccagccacaygattctgtgagaattattcatttgcacaagtttccctcccaaaagaacccatgttctatgagtttacattagcatttacatcaagtcacaaattcagacaactacagggactacctacacaaagtgagtgaatgaaagggactatgtgtttaaataaagagagagagagagagagagagaaaacaaaaacaatgggcatgaactgtggtgaacccaagagcatttacccccaaaggacacagccactgctcagtgccagttagatatttattgccttgtgggagtggggtgggcaatctt

SEQ ID NO: 73016 - DNA, 601 bp, Human
ctgtataaacagaagcacaaatattatttatgcaaaattcaatgccctgtaaaatgaattaaatatgaaatcaaccaagcaggtttacaagttgctgggttgagagcccacagtcactttggttcatttgatggaaatgaatatagtggaatatagtagagtctaatgatcaaaaaagcagacatggatttaaaatatagatttttttaaaaaaaaaggaaatagatggcagagaaaggtgccatatgagcctggagggcatttggtttcagcatatgtgaatctagatcatacgggcaaycttggaagagcctatgaagctcaaagaggaacttatggaaattctaataggggaaaactttatctctgagccaatgtgttagcaattcactgaagacaataaaatgtattaccagactggagcagaaatcctgagtgtgtcaattattagataccaaagagaggcatgatgtttgataatatttctctggtgatcattataacttggcaaagttgaaattcaaaataaagtaaatctagtataacgaatatggtatatgttcccaggtcatgtgtaaagagaattatacctctttaggaa

SEQ ID NO: 73017 - DNA, 601 bp, Human
actaattcacaattaaatgtgacactggcagcaataagtttaacccaataataatagttataacagtgcacagcaccccatggggatgctctgtataaacagaagcacaaatattatttatgcaaaattcaatgccctgtaaaatgaattaaatatgaaatcaaccaagcaggtttacaagttgctgggttgagagcccacagtcactttggttcatttgatggaaatgaatatagtggaatatagtagagtctaatgatcaaaaaagcagacatggatttaaaatatagatttttttaawaaaaaaggaaatagatggcagagaaaggtgccatatgagcctggagggcatttggtttcagcatatgtgaatctagatcatacgggcaaccttggaagagcctatgaagctcaaagaggaacttatggaaattctaataggggaaaactttatctctgagccaatgtgttagcaattcactgaagacaataaaatgtattaccagactggagcagaaatcctgagtgtgtcaattattagataccaaagagaggcatgatgtttgataatatttctctggtgatcattataacttggcaa

SEQ ID NO: 73018 - DNA, 601 bp, Human
tactaattcacaattaaatgtgacactggcagcaataagtttaacccaataataatagttataacagtgcacagcaccccatggggatgctctgtataaacagaagcacaaatattatttatgcaaaattcaatgccctgtaaaatgaattaaatatgaaatcaaccaagcaggtttacaagttgctgggttgagagcccacagtcactttggttcatttgatggaaatgaatatagtggaatatagtagagtctaatgatcaaaaaagcagacatggatttaaaatatagatttttttawaaaaaaaggaaatagatggcagagaaaggtgccatatgagcctggagggcatttggtttcagcatatgtgaatctagatcatacgggcaaccttggaagagcctatgaagctcaaagaggaacttatggaaattctaataggggaaaactttatctctgagccaatgtgttagcaattcactgaagacaataaaatgtattaccagactggagcagaaatcctgagtgtgtcaattattagataccaaagagaggcatgatgtttgataatatttctctggtgatcattataacttggca

SEQ ID NO: 73019 - DNA, 601 bp, Human
ctactaattcacaattaaatgtgacactggcagcaataagtttaacccaataataatagttataacagtgcacagcaccccatggggatgctctgtataaacagaagcacaaatattatttatgcaaaattcaatgccctgtaaaatgaattaaatatgaaatcaaccaagcaggtttacaagttgctgggttgagagcccacagtcactttggttcatttgatggaaatgaatatagtggaatatagtagagtctaatgatcaaaaaagcagacatggatttaaaatatagatttttttwaaaaaaaaggaaatagatggcagagaaaggtgccatatgagcctggagggcatttggtttcagcatatgtgaatctagatcatacgggcaaccttggaagagcctatgaagctcaaagaggaacttatggaaattctaataggggaaaactttatctctgagccaatgtgttagcaattcactgaagacaataaaatgtattaccagactggagcagaaatcctgagtgtgtcaattattagataccaaagagaggcatgatgtttgataatatttctctggtgatcattataacttggc

SEQ ID NO: 73020 - DNA, 601 bp, Human
acagatttgagatatgatcgaacggtaaaataacttaaaggatgacagccaaataataatactatttgatgtttgagtgatttatagaaatatctagtatcatgttttatttcctgccccctcccatcactaataatattatttagattgtgattattttagaagagatacagaaacaaatcaaaattctattttttaaaaaagatgattttcctgagtttagctgtaagtacacaacacaaagttaaatagagaattcataattatctaattaaactaatacctttaaaatattcaaacsaaccattttagcagaaacaaacaataataatatttatgatcagaacctgggaaatccagatttgtcataagcaaacaacaacataatccaaatatttctactaaaggtggcaaagcctgtctctgtataccttttcaatcttaaacacaaacaatttctgtttggactccacttgaaaaccacttttgaagaagtttaaaaataagatttctcccaggaaataaaagacccacagtgttcaatgtttgacaggattggaagttaattaaggcaattagattttccattcatgtgtagact

SEQ ID NO: 73021 - DNA, 601 bp, Human
cattccctggacatagacttaagctatgatttctcattagtagtaataaatgcaaataacatgttgagttaaaaataaatacaaatcgaacaaaaaatgaagagaggtcagataaagagaaatataatacaaattaccaaataagattatttttatgtaattgtttctaactaccactaatttatagtaattttattatatgctctggcctaaaatttttagccttgcatacatcaaaatgaaggataactaataatcaatcattaaatccctatgagcttgggccattgtctgcaatcaygattttgtgaagattaaagtttcccttattaaggttttcaactgtaataacataatactttatcttaaatcctttatcttaaatattatgcaaagaatatgtcaaagcaaataaagcatagtttgctagtcagaatggttcaattctttgtctggctctttccataactatttctataaactttgatgagtctcttaacttatttgcttttccaaatataagatggatgtaaagagtatatcctccatgatgttttgctgtaatgatccaataacattacattatggttattatacgaat

SEQ ID NO: 73022 - DNA, 601 bp, Human
cttctagaaaagtcattggaaaacaaactctgcataattgggatactacatttcttcttactaaaaagcaaattttatagtgataaaaggtacattgcaaaggacagaagtatttaaccaaaaagtaacgctatgaagattaaaatattctaagtcaaaaacattgaatgaaaattctatctctatcaccattccctggacatagacttaagctatgatttctcattagtagtaataaatgcaaataacatgttgagttaaaaataaatacaaatcgaacaaaaaatgaagagaggtcagrtaaagagaaatataatacaaattaccaaataagattatttttatgtaattgtttctaactaccactaatttatagtaattttattatatgctctggcctaaaatttttagccttgcatacatcaaaatgaaggataactaataatcaatcattaaatccctatgagcttgggccattgtctgcaatcatgattttgtgaagattaaagtttcccttattaaggttttcaactgtaataacataatactttatcttaaatcctttatcttaaatattatgcaaagaatatgtcaaagcaaa

SEQ ID NO: 73023 - DNA, 601 bp, Human
gtcccccacatcccttcctgtgtgtgtgtagatcaataactatctatgcattcactcgtacatttacctcatccttcccatctatccattcatttatcctagctatacacctatccagtgaaaaacctttcacataagtcctgattttacactttatttcctaaaataaagactaattagataatgcattcttttatttgtaattttatttatatgatagtagaaaaatgattagttattgatactcataaaaacagattacataattattagtaaaaattgacagggactccacatgcartattatactcatcaagtttagatagcgattaatggtaaaaatttctagagccaatatattttaaaggatcataagaactgatactcgtgatttttcatcccctgtcaaaagcaggctaatatttccaactccaactttttcaattcaagtagaaaatatttatactgcttttaactcgttttcaaaatctggaaaaatctgtcttctatgcattgtctagtaggatgatgatcttattattggtattatttggtttacctgatttcatgcttggtgaaatgtttgaaccaaaatcctagt

SEQ ID NO: 73024 - DNA, 601 bp, Human
gttgattatcttttaggagaacacacaaatacttggttctagatgaagcctgaattgtcatattgaagtatcagaatatagtgtaaataacatcaggagacaactttgagaaaagttaaataggttaaacaaacaaatatcaaaacccaaaaaagttaggtaaggttattaagcattcactgaaaattgccatgcatgttgttcacaaagaagttatatttctttattgctgcttttaaagcactccatgcctacagcagatgtattcctttgtttatctaatttctaatgttctgttttyattgcatctatatttaataaagtttaatgccttctacttctctccactttcatcatgatttattttttttcatctctttctcttcaaaattttcttcagaatagttttccagttgaaggtgaccacattttttctggtcatctaagatacattcaaacctctttcattataagaattttgaaaattaaaaatcttagtagaaaatcaaaagcatatgacactaattatatcctcacgtttgtcatccaattccaacccaatgagaacatttaatctgatattattagaagtgtgaagaga

SEQ ID NO: 73025 - DNA, 601 bp, Human
atatatgttttaaaaatccttcaaaaaataaacactagagacaaatggaaagcatcacatcaaatgtgttttattgctcaggggcatgtgagggtttatggaaggggctgtaaagtcttggtaacagaatgatttttcttgttggccctattttcaatttctatatgtagcttaagattttatgctttcttctaagtgaggagatacaaacgggtgagaataaacccacatatttaaatgttctatgtactattactgtagaaaaccaggactttaaatgaggttcttgtgaacacagccraagttcccaatgtgtttatcagactctttgcctctcgctctaagtttttaacttttttaacccaatataaaaacacttcacataacttagagttaaatatagcattcattttatctccttttatgaaagaatgtggcttgtccaagctataattagcactttttctaacataacatttaaacatttatgaatatggctcccatattaattataattatttcaaatacacaacagataatattctatcatcatcaaattgagtaggcagatttgggaggaaatattcccaaatactacgtt

SEQ ID NO: 73026 - DNA, 601 bp, Human
tcaggctggggcgattttatctcctggaggacatttgaggctgtttgaagacagttttgtttctcacaattcaggggtgctactggcatctagtgggtagaggccatgggtgccgctaaacctcctacaatgaacaagggcagcccctcatgacaattatctcgtcccaaatatcaataatgccaaggctgagaaatcctgggtgaaaatgatgatatttaaaatgtgtgtatacatatatcataatgatatattaatataaatgatatatatcaatcacctaaaaaagtgtctatggacmcttcaacaaatgtgagtcttgtttctttcatctctaaacccttcaatagtgctttccttacaaataagttttcatacactgttgaagtaaattctggctgttcccactgcattaatcaacaattgtcttacatcttgcagtaaatcctttctttttatttttctaaaagtcatacagatgtgattacaatccaactgcaatatcaaatatccacacaatcaaattcttattcttcttttatatgtagtaatccttgtgtaggtgtcttctaaagaatatacaagctcacctatttaacta

SEQ ID NO: 73027 - DNA, 601 bp, Human
gggacaacttgagcagaactctccgaaataatgggtggtttggaaccatagtgacacagcttttcacgctgttgttaataacaatattatcatcattatcattttgaaataggttttttaaatgcaataaactggagactaaaatatcttgattctactccaggaagccactctgaaggtactggatatggctgtgaatttgtgcaagtgttttttacctctctctacctcaaatctccttatctttgaattgagaataataatacctgattcctgggttagaacagtggttttcagtttkggggaagagggtcaggctggggcgattttatctcctggaggacatttgaggctgtttgaagacagttttgtttctcacaattcaggggtgctactggcatctagtgggtagaggccatgggtgccgctaaacctcctacaatgaacaagggcagcccctcatgacaattatctcgtcccaaatatcaataatgccaaggctgagaaatcctgggtgaaaatgatgatatttaaaatgtgtgtatacatatatcataatgatatattaatataaatgatatatatcaatcacctaaaaaag

SEQ ID NO: 73028 - DNA, 601 bp, Human
ttttttttaaatttctgttaactcttgttttgctaatccctttctgaaaagccaagatattccttgcaatcatttacaacaccctcaggtatcacgaaaatcagagctgtgaatcactactccacagtgaactcttctgacatttgctatagagagagaataacgtcagtccccaccaattctaagcctcagcttaagactgaacccataatcgtatagtaattgtttccaccactggaaatggtgttactcatagttatttaaagttgctatctttacaaaagtcactagagcccctttrctgtgacaagtccctttgtaagctgacatttctacttggatgcacagtcggacctacatatttatcactcactttccttactagaaagttcaaaagaaattgttgacttttattggtttttattatgctttatctgtatgatatcaaaatattggccttacaaatcttttatttcagggacaacttgagcagaactctccgaaataatgggtggtttggaaccatagtgacacagcttttcacgctgttgttaataacaatattatcatcattatcattttgaaataggttttttaaatg

SEQ ID NO: 73029 - DNA, 601 bp, Human
aagaccaagacaggtgaaatttcagttctgatttggctttaattccggctatgaccccagttatcaggattggttcatgttatcaagaacacaatttcacttttatcgaggcagaaatgtgacttttatctttactttctccagcctttacttccctgtctctcagtccatatagctgtagtgtggtcctctactgaccaacctcctgaacccagggtaaggcagcacactttgatatcagaacaccctctccttctacctcaagcactgtatggcataggtattattaaatttttttttwaaatttctgttaactcttgttttgctaatccctttctgaaaagccaagatattccttgcaatcatttacaacaccctcaggtatcacgaaaatcagagctgtgaatcactactccacagtgaactcttctgacatttgctatagagagagaataacgtcagtccccaccaattctaagcctcagcttaagactgaacccataatcgtatagtaattgtttccaccactggaaatggtgttactcatagttatttaaagttgctatctttacaaaagtcactagagcccctttactgtgac

SEQ ID NO: 73030 - DNA, 601 bp, Human
cataagctttacaaaaacaaagagttttaaagttaagaccaagacaggtgaaatttcagttctgatttggctttaattccggctatgaccccagttatcaggattggttcatgttatcaagaacacaatttcacttttatcgaggcagaaatgtgacttttatctttactttctccagcctttacttccctgtctctcagtccatatagctgtagtgtggtcctctactgaccaacctcctgaacccagggtaaggcagcacactttgatatcagaacaccctctccttctacctcaagcrctgtatggcataggtattattaaattttttttttaaatttctgttaactcttgttttgctaatccctttctgaaaagccaagatattccttgcaatcatttacaacaccctcaggtatcacgaaaatcagagctgtgaatcactactccacagtgaactcttctgacatttgctatagagagagaataacgtcagtccccaccaattctaagcctcagcttaagactgaacccataatcgtatagtaattgtttccaccactggaaatggtgttactcatagttatttaaagttgctatc

SEQ ID NO: 73031 - DNA, 601 bp, Human
ggaagaaaaattataggaatttttttctatttgatatcattacaatagagatcaattgaaaaatgtaactgaggccccccaaacttgagcaaagtcctccttcttcaatgggtaattatttaatttgtcacgttaaaaataaacaagcagacctgaagatttgccatattaataaacaaagacaattttttctaaaatgcattcattcatttaattgttaaaataccattctgttattttaaaccaagttgtctggcaagatccataaatatgtttaagccatttatataggtcagctaayatgggttatgctttttaaagcaccatctgactaagcacattctgcattttgctaacaaagttacagtacataataatattttaatcaaccaaaaagaacaataatagatctgactgttgggctgataatcgtcttatcacaccctgtgaaacctagctctaatatttgacagagcctccattacttggcaacccattcgaaaaaaggccaacaatggagagggagtgaagtggagtgtgcagtacctccgtatctacataaaagagattagaggcgacagcgttccattttacagctcaa

SEQ ID NO: 73032 - DNA, 601 bp, Human
tgacagctcaagttttctgattttactttcagaatcattcgacccttattaatcacaactacaggtatacaggtatataactaccaggtacattaaaaataacctttaaatatttcataattgtattctgttttttgttttttgttttttgtttttttgttttttttgcgatggagtcttcctcttgttacccaggctggagtgcagtgacgtgatccgggctcactgcaacctccgcctcctgggttcaagtgattctcctgcctcagcctcctgagtaactgggattacaggcacacamcaccacatccagataatttttatacttttagtagagacggggttttgccatgttggccagcctgatcttgaactcttgacctcaggtgatccacctgcctcggcctcccaaagtgttgcaattactggcgtgatccaccgcacccattccataattgaatattctcataatttaaacagtcttattaagtgccaaggttttgggtcttatatttaactttcttccacttaactaaaagacttaactacttcacagttctaaaatcattaggttacatacacaaaagaaaagttaatcctg

SEQ ID NO: 73033 - DNA, 601 bp, Human
tgggaacaagcaaaagcaatgctggaacggagacacatgagcacaggatatttagtatgatgacagaattgtatattaggtcaaaaacaatggcatgagtggtgaggacaggcctctctgagcatttttcacaactttggcttgtctcttgaactagatctctgcctaggaaacctagctacttctctgttggtctacttttttgtttccagcaagggtagctgcagaaaatagagtccctaagtaatatttcagattatttttttcaaaacttatttctcaacttactggttcctatttygatgccatagttgtgacttcagaaactattaaactggtaaattttcagttgttttaggcttaaccaaagaggctggactaaatcgtttagacgccaatggtcctgcccatgtagaataaaattatgacagtatctacacaatgattctcttggttaaataagcttttctcccctctctattaaaattgatgtttgttctgaatttttataaattgcttttatgaatatgaactttttagatcacttggttttaattgtaatgacaatctatggcagtaccttgaaaataaaaatgaacac

SEQ ID NO: 73034 - DNA, 601 bp, Human
tgacctgggccaggtctataggatattgatgttttgataatcctcaggtaagtttcaggaaatttcaggcttctaaaagattataatatgtggtgaactgaatgactgagctcatcctgtcactttatcgttcaaaagagcttagcaattaccatgaacttgccttaaaatgataacatattttaggacatagtacatgtagaaatcctcagcactcaggaattgttttcaaaagtattgggaaatctttctgtgtgtaaaataattcaaaagttccaattttaatcttttcaaaatgcarttcaactcaggtcatcttcagctaaaactttcaatagcacttcactgccttcagaataaaatttgttttccttagcataaaattcaaggtttttcatgatggggtccttgcagatctttccagcctcaagtcacatcttcttcccatgctcctccttctaagtctccatgtgactctgtaggagaggactatcatagccctcataattcagttatagttgtcaaatcacctccctgaatcacccaccacacagtgaagatgttaaaagcagaatttgtgctgtattcatgtgtgtatcat

SEQ ID NO: 73035 - DNA, 601 bp, Human
ttgatttgctaaaaggagcttagggcaactattaatcaatatatccagagtgtcaaagccaaggccaggatagacacgcattcatttggagattggctgaggcagataaagggggacgcaggggaaaaagtgcgaccagcccactgaagggaagtgggattagggttggagagagggtcaaaaaggagcaaaggggaaaacaaaacattctatgcatcatgttctgcactcctcccccaacttttcttttagaggtggaaaaagcttttttaatcaagcatttaagcatatatgaattatrctaattatgccagcttttatataacaattttctcacaaaaccacgaggctttctctctttaacttatcaagtagcttaagaataactaaaaagtcagaggtaacagctccattaacaaaaaagaagagtgccagaaaaaaaaaatatatgacctgggccaggtctataggatattgatgttttgataatcctcaggtaagtttcaggaaatttcaggcttctaaaagattataatatgtggtgaactgaatgactgagctcatcctgtcactttatcgttcaaaagagcttagcaattac

SEQ ID NO: 73036 - DNA, 601 bp, Human
atagaaaactgtttctcggatgcctgatgtctccagctgccacacaatttatatctctttcctctgctctttgtttttcagccattttccctgaatgtcaaagtcaatttagtgcatttcactttgctgaataaatcagaggcgaaatccttgctaaaagtgaaaatttgatttgctaaaaggagcttagggcaactattaatcaatatatccagagtgtcaaagccaaggccaggatagacacgcattcatttggagattggctgaggcagataaagggggacgcaggggaaaaagtgcraccagcccactgaagggaagtgggattagggttggagagagggtcaaaaaggagcaaaggggaaaacaaaacattctatgcatcatgttctgcactcctcccccaacttttcttttagaggtggaaaaagcttttttaatcaagcatttaagcatatatgaattatactaattatgccagcttttatataacaattttctcacaaaaccacgaggctttctctctttaacttatcaagtagcttaagaataactaaaaagtcagaggtaacagctccattaacaaaaaagaagagtgcca

SEQ ID NO: 73037 - DNA, 601 bp, Human
ttcctccccaagtgtccatattgagttcagttcaactccctttctcttttcttcatccacaccagcaccattgcctttcacacatcaaaaccacactttgtttcttgaacctggtggttacttattcactgaaccttggtctaacaaggaggtaggctgactcagtcacataaaagaacacagccaaggctgacattcttgggggaaaaaaagcatacagatgagcaaaggtacatggcttttctctactgaggtttgtgatccaaaattatttcaaattctccttctagtggaaaaagcyctatcctttaaaacacatacacactttactataaatcactagcactttcaaggtaacaattctattttgtgtttaaaatgacttgaatatttcttttccaaaataattaggttattttccagttttcacgaactaattttgataggtacaaagctggattacccagctattatatgcacaaaatatagtgtgtgttatcatatcagaaattctaagttcagctgagtaatacaggtgccctctttaaaaaaaaaaaaaacctgaatagttaaaacaattttaagaaatcacttctctgcc

SEQ ID NO: 73038 - DNA, 601 bp, Human
tgttaagatacatcatttgaggctgagcgcagtagctcagcctgtaatcccagcactttggaaggctggggtgggtggatcatctgaagtcaggagtttgagaccagcctggccaacatggtgaaactcctcctctactaaacatacaaaaattagccggacttggtggcatgcacctgtaatcccagctactctgcaggctgaggcaggagaatcctttgaacccaggaggtggaggttgcaatgagccaagatcatgccactgcactccagcctgggcgacaagagtgactctgtctcaaaaaaaaaaacaaaccaaagaaaaactcatttgagctgagtgcagtggcttatgcttgtaatctcagctacttaggaggctgaggatggaggactgctagagcccagtagttccaggttgcactgagctatgatcatgccactgcattccagcctgagtgacagagcaaaaccccatctcttaaaaaaactaatttgtaaaatgccattaatatggatagttggggtcacttttgctgtcagttagtacaactttcctgttagatttgttgaaaattaaagaaaagagaataataaaaat

SEQ ID NO: 73039 - DNA, 601 bp, Human
attttagtgaaataatatttctgtaagagtctagtgctgtggacacacttggtacggtgttaagatacatcatttgaggctgagcgcagtagctcagcctgtaatcccagcactttggaaggctggggtgggtggatcatctgaagtcaggagtttgagaccagcctggccaacatggtgaaactcctcctctactaaacatacaaaaattagccggacttggtggcatgcacctgtaatcccagctactctgcaggctgaggcaggagaatcctttgaacccaggaggtggaggttgcartgagccaagatcatgccactgcactccagcctgggcgacaagagtgactctgtctcaaaaaaaaaaacaaaccaaagaaaaactcatttgagctgagtgcagtggcttatgcttgtaatctcagctacttaggaggctgaggatggaggactgctagagcccagtagttccaggttgcactgagctatgatcatgccactgcattccagcctgagtgacagagcaaaaccccatctcttaaaaaaactaatttgtaaaatgccattaatatggatagttggggtcacttttgctgtcagt

SEQ ID NO: 73040 - DNA, 601 bp, Human
tcttctacttgaaatcttctaattgaggttatttatgatggctgaattggggaggaagcagcaggattttagtgaaataatatttctgtaagagtctagtgctgtggacacacttggtacggtgttaagatacatcatttgaggctgagcgcagtagctcagcctgtaatcccagcactttggaaggctggggtgggtggatcatctgaagtcaggagtttgagaccagcctggccaacatggtgaaactcctcctctactaaacatacaaaaattagccggacttggtggcatgcacctrtaatcccagctactctgcaggctgaggcaggagaatcctttgaacccaggaggtggaggttgcaatgagccaagatcatgccactgcactccagcctgggcgacaagagtgactctgtctcaaaaaaaaaaacaaaccaaagaaaaactcatttgagctgagtgcagtggcttatgcttgtaatctcagctacttaggaggctgaggatggaggactgctagagcccagtagttccaggttgcactgagctatgatcatgccactgcattccagcctgagtgacagagcaaaaccccatc

SEQ ID NO: 73041 - DNA, 601 bp, Human
aaaagtgtgtttttttctaagagaaaaaaagttttcttcttaagagtcatagcaaagtatgtataaacaatgggggcgttatgaccatttagcatacaacacagcctgcttagactgttgccaatgagtgattttggcaggttaaattggttcttctacttgaaatcttctaattgaggttatttatgatggctgaattggggaggaagcagcaggattttagtgaaataatatttctgtaagagtctagtgctgtggacacacttggtacggtgttaagatacatcatttgaggctgagmgcagtagctcagcctgtaatcccagcactttggaaggctggggtgggtggatcatctgaagtcaggagtttgagaccagcctggccaacatggtgaaactcctcctctactaaacatacaaaaattagccggacttggtggcatgcacctgtaatcccagctactctgcaggctgaggcaggagaatcctttgaacccaggaggtggaggttgcaatgagccaagatcatgccactgcactccagcctgggcgacaagagtgactctgtctcaaaaaaaaaaacaaaccaaagaaaaact

SEQ ID NO: 73042 - DNA, 601 bp, Human
ctagtacatttaaattcatatgaaaataatattttactgcaccataagagatccaagtgtacataaaaagctaaaacaaaatccctactttgagtttacataccttgtatatcattcctgacactcgctataggaaaaaaaaataacctggcaaaaattaatataaaaattgtggactactccagaaatcaaaaattttaaaagtgtgtttttttctaagagaaaaaaagttttcttcttaagagtcatagcaaagtatgtataaacaatgggggcgttatgaccatttagcatacaacayagcctgcttagactgttgccaatgagtgattttggcaggttaaattggttcttctacttgaaatcttctaattgaggttatttatgatggctgaattggggaggaagcagcaggattttagtgaaataatatttctgtaagagtctagtgctgtggacacacttggtacggtgttaagatacatcatttgaggctgagcgcagtagctcagcctgtaatcccagcactttggaaggctggggtgggtggatcatctgaagtcaggagtttgagaccagcctggccaacatggtgaaactc

SEQ ID NO: 73043 - DNA, 601 bp, Human
aagaataagagcagcttgacttattttttttttttcctaaaatgctgaccatgtcaggaagagttagtttctccaggaactcacagctgctccttctccctctctccctctgcagcccaggccaccatgtgccctggcacaaacgtgctgactggtggaggaggcccagcacttcaggtaattaatcctttcctaatgtaggttaagcaggtgtgaagcctccctcatacagagaggaggtggctgctctttggagacacccctagtgttatggtatttaattgggctcagatgattctcwgaaactgggtaggtgtgttgctgacctggacattcagttttcaacttgcttaagtgaaatccagttgaagaaattggtcttttccccttctggactttctaatattaacaatttgtggttgccagaataatgcccattctggcaatgaaaatataatttcctcattggaagcaaagttatgtgattactggagactagcagagtttcagattaagttgaattgactattgctctcagaattatcatggatggggtttattcattatatttctctcctttccaaaatacaatgcactagta

SEQ ID NO: 73044 - DNA, 601 bp, Human
ctccccttaaaatacaaaggtctagcaaattatctccaaaggccattccagctctatcatcccagaatcgactttttggggaaagggatctagctttgatattattccatatattagaaaggggtgttacaaagcttcctctagacatgcttttaaataaacaatcatattttgaaagtttgggaacatttattataaagctctctcttttagaataacagcaattcacagaaacaaagctgaaaaatctgaagtaattattccatgtttttccgcaaaagatgaatttaagaaacattgygttgaacctctgagagtgcattcctcttttaggtatgcaaatctgtgctgaggacaccctgccactgggttttgccatgacacagacaaatcacaagaataagagcagcttgacttattttttttttttcctaaaatgctgaccatgtcaggaagagttagtttctccaggaactcacagctgctccttctccctctctccctctgcagcccaggccaccatgtgccctggcacaaacgtgctgactggtggaggaggcccagcacttcaggtaattaatcctttcctaatgtaggttaa

SEQ ID NO: 73045 - DNA, 601 bp, Human
gcacaactgagcattaatagacctgagttttagtctcaactctgtctctgactagcttgtgacctcatgcagatcattcaactttcttgatcttaagcatctttatccataagtgaatgtgcaagtaaaggcatttaacgtttgttgaacacttgaaattatatgtcaaagattagactgggcacttggcctgcgttagctcattggattatctcagcaatccatacagtaggtattgctaaccccaacttatatatgggcatactgagttcatgggatgtggcaataccaagatttgaaygagggtctctaactacaaagacagtacgttgctgactacaatatggtgcctccccttaaaatacaaaggtctagcaaattatctccaaaggccattccagctctatcatcccagaatcgactttttggggaaagggatctagctttgatattattccatatattagaaaggggtgttacaaagcttcctctagacatgcttttaaataaacaatcatattttgaaagtttgggaacatttattataaagctctctcttttagaataacagcaattcacagaaacaaagctgaaaaatctg

SEQ ID NO: 73046 - DNA, 601 bp, Human
taggaaaaagttaagatgataatttttaaatatctaatactatgcataagcaggaatagtatactcttttctgaaaaactgttagtgataatgataaatatcaataatgcacaactgagcattaatagacctgagttttagtctcaactctgtctctgactagcttgtgacctcatgcagatcattcaactttcttgatcttaagcatctttatccataagtgaatgtgcaagtaaaggcatttaacgtttgttgaacacttgaaattatatgtcaaagattagactgggcacttggcctrcgttagctcattggattatctcagcaatccatacagtaggtattgctaaccccaacttatatatgggcatactgagttcatgggatgtggcaataccaagatttgaatgagggtctctaactacaaagacagtacgttgctgactacaatatggtgcctccccttaaaatacaaaggtctagcaaattatctccaaaggccattccagctctatcatcccagaatcgactttttggggaaagggatctagctttgatattattccatatattagaaaggggtgttacaaagcttcctcta

SEQ ID NO: 73047 - DNA, 601 bp, Human
tgtactgatctgccagaaacagtgtttgttcaaagatagcatcaatgcttacatggtatgttcaaagatgcttctattttgtgcagagagatatagtagagaggctgacggagatttattattgggtgtgcctttaaagcatctttaaattcatgttattttatccttctgttgtctttactatttagctctgcatcaagatccttggcagttgttccatcaaccaaactctcggccacttgggctgttggccatgttccccaatcacaaacctcagtcagtctctctactatatctctcygcacaaaatagaaagattctgaaccatatctataaattaatagtccttcagaaacagatttaatctgatatattcacagagtatacccaggctataacaaataacataggcctattgtttatactttgtgatatctagtttttcaaatatccaaaataactttcctaaaacatattcactgctattaatctatcttcaagaaatatattgtccatataaatcatgtatatctatatatataaaatgtgatataatataggaaaaagttaagatgataatttttaaatatctaatactatg

SEQ ID NO: 73048 - DNA, 601 bp, Human
ggagagaacaaaagtcaacggcaggagatgtaacacaaccttaacaatcttgagaaaaacaatggttgtaatcagttctatattcccatattaagtcatggtcaatgaagaatcttttcttaaagtaaagatactgccattctccttaatgcagaaaataggtctctgttcataaagagactccatttctgaagtagtttaactatttaaaatccaaatggtttcagaacaaccatgcatatagagtttaagaacagcataaaagtcctttcaggcagattctggctctcagtttagtccrcagactatggctgataatcagaacatgggaatagagagccgcagaacggtcaatgctgaaatactaggccaggaggcgtggttgacatctgacttacatcactctcaaaacacttcttcaagactcttgactatgtgagacagaagaattaaaattatgatcacgaataggctgcagaacaacagtcttgaaataaaatttcaaaaaatattttgataatgcataaaccatgcatcatagtcataaaatactcacagagacagtctcccaagaatagcagtgttagtaaagcttatcata

SEQ ID NO: 73049 - DNA, 601 bp, Human
gaggataacaagccaagtatggacgcaacatggagcccacacctctgaactgtgctgttgccggagagaacaaaagtcaacggcaggagatgtaacacaaccttaacaatcttgagaaaaacaatggttgtaatcagttctatattcccatattaagtcatggtcaatgaagaatcttttcttaaagtaaagatactgccattctccttaatgcagaaaataggtctctgttcataaagagactccatttctgaagtagtttaactatttaaaatccaaatggtttcagaacaaccatgcrtatagagtttaagaacagcataaaagtcctttcaggcagattctggctctcagtttagtccacagactatggctgataatcagaacatgggaatagagagccgcagaacggtcaatgctgaaatactaggccaggaggcgtggttgacatctgacttacatcactctcaaaacacttcttcaagactcttgactatgtgagacagaagaattaaaattatgatcacgaataggctgcagaacaacagtcttgaaataaaatttcaaaaaatattttgataatgcataaaccatgcatcat

SEQ ID NO: 73050 - DNA, 601 bp, Human
cagttctgctaacagatgaggcagaggtcttgaaaatggacttgtttaacctatactataggtttaaccaaaagaacaaagctagtaattaaaccttcacatacatttgacaccttgacaccttcccatacatttatctttactggattactctacattgtgcaaatccagctgcgatgtcattttcttcaagaaatctaccctgattccaaatgttagagtttccaccatggtacacctatagtacgctgggctactccatcagtgcacatagagcactgttataaatgcctccttgctygtccgtattccccaatagactctaagctttaggaaagtgtgcccccatctaccctacttacttttgtatattgccttgcagagtaattaccgtaaaggtacccaacacatttaaaataattaagtaaataatgcagtaaaaattttaattttgtcaatttcaaatgagagtgtttattaagtaagattccaaagaatttgcttttctccatgcaaataagggacctagcaggccaaatgattggtactgccaaatgttaagctctaaattttaactgtatagaacatgacaaatctgtca

SEQ ID NO: 73051 - DNA, 601 bp, Human
ttggctagcaaaacaatcacctagaaagacctggacagtatttttaaaaattcacatcggttttgcagaaagaaaaacaatgccggaaatcaaactttgagtggatatggacaaaagaaaaggtacggaagtggcataaaattgcttttgtaaactttggctcattttcataaggtttggctcattttgcctgcccacctgtatggcatgcaaggtgaatcaaacgggtacacatgtgacattttataagttgattatgttgattcaaaaatttgtcttgacctctctctcaagtgactgyatgttctcattgtctaaatttgaagcctcttggcttggtctataactagagtctaacacaacttttatagtataattccttaaaatttaaaagaatgctctttcttcgatgaatgatgtccttcagttctgctaacagatgaggcagaggtcttgaaaatggacttgtttaacctatactataggtttaaccaaaagaacaaagctagtaattaaaccttcacatacatttgacaccttgacaccttcccatacatttatctttactggattactctacattgtgcaaatccagctgcga

SEQ ID NO: 73052 - DNA, 601 bp, Human
tacaccaataacgcaggtgtctgacacacagctatgcaacattccctttagccggcaaacattgagatcagtagttaggttgcacgtagcactgccaattttttcaattagacccattattgatttgatgaaaaagcaaattaaacataccatggtggtatgtaaattggttagagagagcataaagttctggtacaaagcttcaaaggcatgagctatatggctttcatcagcagtaactcattaggggttcctggcaattgctgctatatatggggttccttgagctacgtgggttggytagcaaaacaatcacctagaaagacctggacagtatttttaaaaattcacatcggttttgcagaaagaaaaacaatgccggaaatcaaactttgagtggatatggacaaaagaaaaggtacggaagtggcataaaattgcttttgtaaactttggctcattttcataaggtttggctcattttgcctgcccacctgtatggcatgcaaggtgaatcaaacgggtacacatgtgacattttataagttgattatgttgattcaaaaatttgtcttgacctctctctcaagtgactgcatgt

SEQ ID NO: 73053 - DNA, 601 bp, Human
aaattttattcttcaagctgaaagccaggtgattaattctcatagcatagtgatcaattggtgcagatgctccacctgtattaatgtttgtttttgtacacattagtagcaggagtacaccaataacgcaggtgtctgacacacagctatgcaacattccctttagccggcaaacattgagatcagtagttaggttgcacgtagcactgccaattttttcaattagacccattattgatttgatgaaaaagcaaattaaacataccatggtggtatgtaaattggttagagagagcataargttctggtacaaagcttcaaaggcatgagctatatggctttcatcagcagtaactcattaggggttcctggcaattgctgctatatatggggttccttgagctacgtgggttggctagcaaaacaatcacctagaaagacctggacagtatttttaaaaattcacatcggttttgcagaaagaaaaacaatgccggaaatcaaactttgagtggatatggacaaaagaaaaggtacggaagtggcataaaattgcttttgtaaactttggctcattttcataaggtttggctcattttgc

SEQ ID NO: 73054 - DNA, 601 bp, Human
tatcaagtatttaaaacttagccctacatttacactcccaggtacaattaattgtccagaggcacacatttaatggggctgcacatacacgtctgctgacatcaccctgtcaatggtgcaagcgtgtgtgttaatacatttcatacattaaagatgtaaattttattcttcaagctgaaagccaggtgattaattctcatagcatagtgatcaattggtgcagatgctccacctgtattaatgtttgtttttgtacacattagtagcaggagtacaccaataacgcaggtgtctgacacasagctatgcaacattccctttagccggcaaacattgagatcagtagttaggttgcacgtagcactgccaattttttcaattagacccattattgatttgatgaaaaagcaaattaaacataccatggtggtatgtaaattggttagagagagcataaagttctggtacaaagcttcaaaggcatgagctatatggctttcatcagcagtaactcattaggggttcctggcaattgctgctatatatggggttccttgagctacgtgggttggctagcaaaacaatcacctagaaagacctg

SEQ ID NO: 73055 - DNA, 601 bp, Human
aggactagtctacattagtaatttggtttagcatagtggataatgatcagggtttggaatcatagacctaaatttaaatttcacctctgctatctctttatatatatatatatatgttctgggatacatgtgcagaacgtgcagatttgttatataggtatacatgtgccatggtggtttgctgcacccgtcaaaccatcagctacattaggtatttctcctaatgctacccctcccctagccccccatcccctgacaggccccggtgtgtatgttccactccctatgtccatgtgttctyattgttcaactcccacttatgagtgggtgagaacatgctcatctctgctatcttactagctttgagatctcaggcaagttgtttgacttcgttaaacttcaattttcacagttataggagaggccatcttcaaatctaggtttaagattaattgagataatatatgtaaaataatcagtatcaggcctggcacctagcaagagctcagtgaatgtagctggatgatgttgatgttgttgatgatgatgatgatgatgatgataccaaaatccattctggattgggatgagaaagagtaaa

SEQ ID NO: 73056 - DNA, 601 bp, Human
ttattgatattcaaataataagaaattgtttgatgaatacacacatacttatatgtttgttaaaatgcatgctgtttactcgatgtgctacaatggcctctttctccccattatatgtgaatatgtaattaacaatgcaataaatatctcccatgaaatttccaagaaaactcttaattcaaatgttccctggccactttttagagttcactattttttctgttttatttttaaataccaaagataaaatgtactgctcggtcacagagtgctcatgaaaatataccctgtctgctctgcycaaaaaatatttattgatcttattgatgaagatgacttcttgtcaagtgagagactagagatgataataaaactatcctacttatgtattaatttataagatttgcaaaattgaataagaaactaaaaaactcactcataggatggtttaagacagatttctcaacatcagcactattgacataattctttgatgagagcaggaggtggggggattgtcctgtgcgaggtaggctatttagcggcagctctggcctctacccactggatctccctcccctgactgtaacaatcaaaatat

SEQ ID NO: 73057 - DNA, 601 bp, Human
aatagtatccaccatcagatgaacagggttgaaacagtattctacactttgcaggattttatttatgtttaacacgataatgacaagtagaagttactaacatgtctttttaagagatagttcagttaaaaacatgaagagattataaaatcttatttttttgcatttatgttcaataatgctgaaaatgcaaaaaaacttagagatttgtttcaaatgttgaatagaaacttttgataacttgaattcatatgtgttgtaaaatgtgaatagcaattacttgagtgatactattcaggakgcaaatgttcatacagagataactgtgtgcacttggaaataaactttgggtcttggtttcctcatccagacaaaataggtggatgatgacaacaatttcacagggatgttgtaggtatcaaatgcaagtgaatattaaatttatttagaatgattttataatctcaacatcattgtgcatatgataatcattgtcattattattttttcatcaagagtaataataattcagaactgcaaagtgcagagacatttcacataggtgaatttcattatataaaactccaaaacatgttttaaa

SEQ ID NO: 73058 - DNA, 601 bp, Human
gtccattttctgtctccttcactagaatttacattccacaagagtggggattttttggttacatttgttcactgctggatcgctagtgtttagcagagacttacacatactaggtgctctataaaatatttgaaaaaatgaatgaagagatgaatgacaatatgcacagcattagcagtgtattgtgaatttagtagttttataatggaatgtgctcaaaatatattagcttgttgtctcacctttgacgcaaaaaaaaagcgaattaagttaatttgagatgtaaaaatacatacaaaawtcattactaccaaaatatttcttaattctaccctctaaagaacagtcaaaaagttactttaaattttaattttattaaaagaatcttgaaatgaagtgaaaaattaaaaaaatcataatttaaccaagaaatttaaaataggccctatttctgctaacctaatcattcttggagatgctgtctggccacattgtatgtagaatttatgtactttaatatttccaccttattgcatatctattatagaggtagccttgtgagccttctctcttattaatatttcccatagaattcatatac

SEQ ID NO: 73059 - DNA, 601 bp, Human
tggagggattgctcctcagttataaggaaggaaaaagtcaacctggagattttatatatatatatataccaatatataccaatccacatcttagctaatggttaaatatatttgctgacaatttctttatttagtgaatttgaagaattttcatatatatatatataagcctttagtaagaatggcatgtccctgacatcacttgaaaatatacaattttcgtttggttgcttagtatggccattaacacataggttattatgtgagacaacacacttgaaaataccaggacagtcagttycccttcccccctaccttgttttcagccaccctccctgaccctcggttcattctactccaatcacttgggcctccttcctgttcctggaatgtccaagcacactcctgcctcaggacctttgtatatgctgtccttcctgtccattttctgtctccttcactagaatttacattccacaagagtggggattttttggttacatttgttcactgctggatcgctagtgtttagcagagacttacacatactaggtgctctataaaatatttgaaaaaatgaatgaagagatgaatgacaata

SEQ ID NO: 73060 - DNA, 601 bp, Human
agttgtataaataaagtctaacttcagatctttggagggattgctcctcagttataaggaaggaaaaagtcaacctggagattttatatatatatatataccaatatataccaatccacatcttagctaatggttaaatatatttgctgacaatttctttatttagtgaatttgaagaattttcatatatatatatataagcctttagtaagaatggcatgtccctgacatcacttgaaaatatacaattttcgtttggttgcttagtatggccattaacacataggttattatgtgagayaacacacttgaaaataccaggacagtcagttccccttcccccctaccttgttttcagccaccctccctgaccctcggttcattctactccaatcacttgggcctccttcctgttcctggaatgtccaagcacactcctgcctcaggacctttgtatatgctgtccttcctgtccattttctgtctccttcactagaatttacattccacaagagtggggattttttggttacatttgttcactgctggatcgctagtgtttagcagagacttacacatactaggtgctctataaaatatt

SEQ ID NO: 73061 - DNA, 601 bp, Human
tgccttttcccttcctttctgcaggcaaatacctcttaaacaatccaaacatatctgaaatatttttctctaagtatttctttaataacctcaaacagagaggcacttccttctctcctgctttctcctctactacttggccctatttctattactgcattgtgtcgacactactaaagtcattatctcttctatgatatcaaaatgtattcctctttgtaattctagtgcttggcaaatacttggtttttaaaaaattaaaaattttgtgtgtgtgtgtgtgtgcccagaacttggaagktctcaaggacctaaattgtcttaattcatgtttgcagaattgaaaaatcaacaactggtgggaatggtcacatcttgaatgaggacaaaagcgtgagtctgtgagaagcgcttaagagcatggcccctagagctcttcctggcacctatctccccaccccactactgtctgtctttctgctctaatggaaagggaaatcagaacgtggtgaaacctttccactgctaccgcacagccagaggtgactcgggcagctgagtaattcctccagggaaacgcaggataagcctgagaagcttg

SEQ ID NO: 73062 - DNA, 601 bp, Human
ttgtatttctgtgcactggatatttcttcacctttgtgtgaaatgccttttcccttcctttctgcaggcaaatacctcttaaacaatccaaacatatctgaaatatttttctctaagtatttctttaataacctcaaacagagaggcacttccttctctcctgctttctcctctactacttggccctatttctattactgcattgtgtcgacactactaaagtcattatctcttctatgatatcaaaatgtattcctctttgtaattctagtgcttggcaaatacttggtttttaaaaaaytaaaaattttgtgtgtgtgtgtgtgtgcccagaacttggaaggtctcaaggacctaaattgtcttaattcatgtttgcagaattgaaaaatcaacaactggtgggaatggtcacatcttgaatgaggacaaaagcgtgagtctgtgagaagcgcttaagagcatggcccctagagctcttcctggcacctatctccccaccccactactgtctgtctttctgctctaatggaaagggaaatcagaacgtggtgaaacctttccactgctaccgcacagccagaggtgactcgggcagctg

SEQ ID NO: 73063 - DNA, 601 bp, Human
catatcaaaatgtctaaaattgaactcattttcctcccagacttagatcatttttaaatactgaacaacacagagttgaaatttgggagttagctatgttttgacttctatgtctaatttttcctatgaaatatctcatttccaaaactaatttctagtcccactgtctagctcagttcctcattatcttccacctgaactaagtcaatagcctcccaacttatgatttccctgactcaagtctcttttcttctagatctgtattaatcaggggtcacctcttccttgttgtgatggtttytctctgtgaggtccacagaatccttcattgtcagggcccaatttacttttctttcttcattttttggtaagaatgatgatgatgacaattattattactattaaaatttgtaaaattcactgagtactaaattccagtcaccatgctagtgcttccatttatcatgagctgggcattatgaatgcaacaaaagaaaaatatggattctttggggccttatattcaaggggtggggtggaataaataaaaatatagcaggcagtggtataatactgcaatagagaaacatgaatacaaaac

SEQ ID NO: 73064 - DNA, 601 bp, Human
cagggaaaacatgaatccaaaacaagcctttcctgcatgaatggacagtcttcctgcccgaatcaaggctgagtgtattttatcctgcaaacatgatctcacctcccatattttagataaatgaaggacatcagatataaatacccttgacctacttcccttcttgtctgtagcaggactaattcttaacaccttctcacttgtctgtaagttaaagagactgctctttcttcctaaggaaggcctttcctatgttctcaatccatctgctctggccaccttgaagattttgatccaccarttttctacttggcccctctccatttcttatacttataatctctccttctcctcaagttccattccttcatccctctattctgataaaatcttacttccatactggcttttccccaatagctagctctctgtctctgtctgtctgcctatctgtttatctgtctttttccctctctgttcactgcatcccttcaccacgaaaattcctgacaaaatggtgtacatgcacttttgcactaaattcatctccattccactaaagtctggattgcatctcagctctatcatactgtaatcacca

SEQ ID NO: 73065 - DNA, 601 bp, Human
gatgttcctcaatatgggcagggaaaacatgaatccaaaacaagcctttcctgcatgaatggacagtcttcctgcccgaatcaaggctgagtgtattttatcctgcaaacatgatctcacctcccatattttagataaatgaaggacatcagatataaatacccttgacctacttcccttcttgtctgtagcaggactaattcttaacaccttctcacttgtctgtaagttaaagagactgctctttcttcctaaggaaggcctttcctatgttctcaatccatctgctctggccaccttraagattttgatccaccaattttctacttggcccctctccatttcttatacttataatctctccttctcctcaagttccattccttcatccctctattctgataaaatcttacttccatactggcttttccccaatagctagctctctgtctctgtctgtctgcctatctgtttatctgtctttttccctctctgttcactgcatcccttcaccacgaaaattcctgacaaaatggtgtacatgcacttttgcactaaattcatctccattccactaaagtctggattgcatctcagctct

SEQ ID NO: 73066 - DNA, 601 bp, Human
taattcatcctcagctggacccaatggcttttaggcactaggctcctctttgatgaactacagacagatctatcaggcccaaacaatatccaggcgaggcagctataatagctacctacagatgaagccatagataaagataaactataaatctacacacacaaatgcaggcacattgcctggggatgacagaggagagaggatgagacacttgggaaaggtagttgctcccacgaaggccacctcctgtgcttctcgctcattcactccagaatggggtggattttataaaagacagcaraaccccagtgaacatctcatttattctccgtatctcgaaatcaaatgagagaaggaaagggtgtccatgagcattgtatttagtgcattatttaaagggcagagactactcagatatcctaatgtctatttcagtagtgaaagagaaagctagatatatgagatgttattcctggcacatagcactaacacagcaatccaaaataagtactctgagacaaattcgattatagctcatgagtatctctttcatggatattaatatctttaaaacaataattcaagaacaacaaaaattcat

SEQ ID NO: 73067 - DNA, 601 bp, Human
atgtaataaaggccatgtaattatgaaattttacagccattatcaaggctgatggctcgtaattcatcctcagctggacccaatggcttttaggcactaggctcctctttgatgaactacagacagatctatcaggcccaaacaatatccaggcgaggcagctataatagctacctacagatgaagccatagataaagataaactataaatctacacacacaaatgcaggcacattgcctggggatgacagaggagagaggatgagacacttgggaaaggtagttgctcccacgaaggccrcctcctgtgcttctcgctcattcactccagaatggggtggattttataaaagacagcaaaaccccagtgaacatctcatttattctccgtatctcgaaatcaaatgagagaaggaaagggtgtccatgagcattgtatttagtgcattatttaaagggcagagactactcagatatcctaatgtctatttcagtagtgaaagagaaagctagatatatgagatgttattcctggcacatagcactaacacagcaatccaaaataagtactctgagacaaattcgattatagctcatgagt

SEQ ID NO: 73068 - DNA, 601 bp, Human
gcattttgacataacggggatcaagccgctgcttggtatcccagagctgcactaaagtgaccgctaaacagagctgcacagatggagggatattaaatgccgcactggaaagtaatttcaaataataaaatatcaatatttacattttaattacccctactgagagctgctctgtcattttcactattgccgacgcagcaaggggtagtggaatgacattgcggctctggccgcaatgactattttgtttccattaaagaatgacaagtgttttacaggcagtgacactcggtgtgtgagyaagaatgacagcagatcagaaaattcctattaagggactaaatgcctcaacaagagaatttactctgagcaccagctcctccttgaagcacataatcctttccaaattttctgctgaaagtttattattggggaggcccaagggaagttttagtctcccatgaaatatttagatccgtaaaacattatatgatgattgtcaatttaaaaacaataatacttgacgggaacaaatatccagaagttatgtgtaaatcacaacgaggttgggggttttcttttttcatattctctcatttaa

SEQ ID NO: 73069 - DNA, 601 bp, Human
aaaactagaaggaaaagagaagtgctcactggaccccagtctgattttggattaaacactgcctattcaagtaaggtgaaagttcaaagtttttcctaatactgcttgcattaatgaaggtagagttgctggctttaaggctcagggtatcttgtcaaaaagatctttgtgtaactgttttcccgtttgtgaaggcctcacctacacgcacattaagcacagaatgacaggcattgtgagaacctgggtcatttcatatgggttaacctaaaaatttgaaaattgtatttaagctgccacrtacaaaagggagttgtgattatcttgtgtactttcactgaaatgaccaagaatcaattctatcttggatccctaaaagaaaaattgcttataatttctgtactgcctttaaaaacataacttcaaatcctttcagagttacctaattggtcccttgatatagaaatacaaattccaataaaagcactaattattatagacttggtgtttgtggagttaacgctgttatctcttcttgtcttactattactagttacaagtaaagcagaaaaaaaaatgaaaatccttcaggtgtgctttt

SEQ ID NO: 73070 - DNA, 601 bp, Human
cagcactttgggaggcccaggtgagtggatcacttgaggtcaggagctcgagaccagcctggcctacatggtgaaaccccatctctactaaatatataaaaattagctgggcatagtggcatgggtatgtattcccagctactcaggaggctgaggcaggaaaatcgcttgaacacaggaggcaaatgttgcagtgagctaagattgcacaactgcactccagcctgggtggcagagcgagactccatcaaaaaaaaaaaaaaaaaaaaaaaaaggggtgggggaaagaatagtaactgcyatggttgcttcatttctgttatttgtaatccaacattagagtctaatattgtaagaaccttttaaaaagcacattccacacactgaataaattgaaataagctgtagtgaattaacattaaaatatagatagatatattaaggtctatctatctatctatctatctatctatcttcactgatgtagtacaagagacaaaactagaaggaaaagagaagtgctcactggaccccagtctgattttggattaaacactgcctattcaagtaaggtgaaagttcaaagtttttcctaatactg

SEQ ID NO: 73071 - DNA, 601 bp, Human
tttttaaaggtgaaatgaactgcttttcttgggaatatcccacaattaaaagaaatttataattagtgacttagcttgccaggtgcggtggctcatgcctgtaatcccagcactttgggaggcccaggtgagtggatcacttgaggtcaggagctcgagaccagcctggcctacatggtgaaaccccatctctactaaatatataaaaattagctgggcatagtggcatgggtatgtattcccagctactcaggaggctgaggcaggaaaatcgcttgaacacaggaggcaaatgttgcaktgagctaagattgcacaactgcactccagcctgggtggcagagcgagactccatcaaaaaaaaaaaaaaaaaaaaaaaaaggggtgggggaaagaatagtaactgccatggttgcttcatttctgttatttgtaatccaacattagagtctaatattgtaagaaccttttaaaaagcacattccacacactgaataaattgaaataagctgtagtgaattaacattaaaatatagatagatatattaaggtctatctatctatctatctatctatctatcttcactgatgtagtacaaga

SEQ ID NO: 73072 - DNA, 601 bp, Human
cattttcccacacgtgaagtttaataataatatttttaaaggtgaaatgaactgcttttcttgggaatatcccacaattaaaagaaatttataattagtgacttagcttgccaggtgcggtggctcatgcctgtaatcccagcactttgggaggcccaggtgagtggatcacttgaggtcaggagctcgagaccagcctggcctacatggtgaaaccccatctctactaaatatataaaaattagctgggcatagtggcatgggtatgtattcccagctactcaggaggctgaggcaggaraatcgcttgaacacaggaggcaaatgttgcagtgagctaagattgcacaactgcactccagcctgggtggcagagcgagactccatcaaaaaaaaaaaaaaaaaaaaaaaaaggggtgggggaaagaatagtaactgccatggttgcttcatttctgttatttgtaatccaacattagagtctaatattgtaagaaccttttaaaaagcacattccacacactgaataaattgaaataagctgtagtgaattaacattaaaatatagatagatatattaaggtctatctatctatctatc

SEQ ID NO: 73073 - DNA, 601 bp, Human
atcccagctgtaatttttggttaacttttttcaaacaacaaattattggcacttctgccttcctttctactttttaagatttgattttcactatttctaactcaaaaatatatttaaagtataaaatgaatttttatgaattttcattttcccacacgtgaagtttaataataatatttttaaaggtgaaatgaactgcttttcttgggaatatcccacaattaaaagaaatttataattagtgacttagcttgccaggtgcggtggctcatgcctgtaatcccagcactttgggaggccsaggtgagtggatcacttgaggtcaggagctcgagaccagcctggcctacatggtgaaaccccatctctactaaatatataaaaattagctgggcatagtggcatgggtatgtattcccagctactcaggaggctgaggcaggaaaatcgcttgaacacaggaggcaaatgttgcagtgagctaagattgcacaactgcactccagcctgggtggcagagcgagactccatcaaaaaaaaaaaaaaaaaaaaaaaaaggggtgggggaaagaatagtaactgccatggttgcttcatttct

SEQ ID NO: 73074 - DNA, 601 bp, Human
cttctcatgagaacattttccacactaaaaaacttgcaagaagattgagaaatcctggcattttatcattatgggctgcttcactctgaatcaaaaacagcaaggaggagacaaggcaataaaaatgcatacataaggcgtccccttctcagtccagtttagaacaatgggtcctcactaggtaaacactcacttgtcagaagtacttgcaacactacagtcattgcagcaccaagggagtaagggcccttcctatgataaagcagcagattagacagttacaaacagcaaggagggttcytgtctgttatgtcctttcactgtgtctttacacacaggtgttaatgtaatttaaatgccacttagacatgtttcaggtttatcagactagtttgtgtatccattcttacataataatttcaaacaggaaccagttctacctgctgtgggaacctgcataactatagatagctctatgcaaataatctgggcaagtcaagcagaatctatttaaatctaaaagaaatcaggtgggactttgaggaaatgaagcaggaaccaaaaacattttttaataggtcagaaccaggatcacattatt

SEQ ID NO: 73075 - DNA, 601 bp, Human
atgtctacttttttaacgtaaatttttaggcaatcccaacctaatttttgtcaagtgtaagaaggagcttctcatgagaacattttccacactaaaaaacttgcaagaagattgagaaatcctggcattttatcattatgggctgcttcactctgaatcaaaaacagcaaggaggagacaaggcaataaaaatgcatacataaggcgtccccttctcagtccagtttagaacaatgggtcctcactaggtaaacactcacttgtcagaagtacttgcaacactacagtcattgcagcaccragggagtaagggcccttcctatgataaagcagcagattagacagttacaaacagcaaggagggttcttgtctgttatgtcctttcactgtgtctttacacacaggtgttaatgtaatttaaatgccacttagacatgtttcaggtttatcagactagtttgtgtatccattcttacataataatttcaaacaggaaccagttctacctgctgtgggaacctgcataactatagatagctctatgcaaataatctgggcaagtcaagcagaatctatttaaatctaaaagaaatcaggtgg

SEQ ID NO: 73076 - DNA, 601 bp, Human
cagccagttctcttcaatttagaagtaaagttgatgtttcagtcatatggactagctgcttctcttatatttataagtaaccattcacaacagacttcatgataatgtcacaattacttttttgttatttataagtactgtcattaatttatctacctatcctagttgtacaattattttgacaatatgtatacatttatgttctgtagcttgcattttaagcctctgaaatactaacctagtgaagtcatggatgaaaacaatgctcattgcttctttctacttgcaggaataaaatatwatatgtctacttttttaacgtaaatttttaggcaatcccaacctaatttttgtcaagtgtaagaaggagcttctcatgagaacattttccacactaaaaaacttgcaagaagattgagaaatcctggcattttatcattatgggctgcttcactctgaatcaaaaacagcaaggaggagacaaggcaataaaaatgcatacataaggcgtccccttctcagtccagtttagaacaatgggtcctcactaggtaaacactcacttgtcagaagtacttgcaacactacagtcattgcagca

SEQ ID NO: 73077 - DNA, 601 bp, Human
tcgtataatgctcttttcttataagtgcctataaagtatataggatttttatttggagccacttagactctgataaagtcctgcctaaatttattaacctcagccagttctcttcaatttagaagtaaagttgatgtttcagtcatatggactagctgcttctcttatatttataagtaaccattcacaacagacttcatgataatgtcacaattacttttttgttatttataagtactgtcattaatttatctacctatcctagttgtacaattattttgacaatatgtatacatttatrttctgtagcttgcattttaagcctctgaaatactaacctagtgaagtcatggatgaaaacaatgctcattgcttctttctacttgcaggaataaaatataatatgtctacttttttaacgtaaatttttaggcaatcccaacctaatttttgtcaagtgtaagaaggagcttctcatgagaacattttccacactaaaaaacttgcaagaagattgagaaatcctggcattttatcattatgggctgcttcactctgaatcaaaaacagcaaggaggagacaaggcaataaaaatgcata

SEQ ID NO: 73078 - DNA, 601 bp, Human
attaaggcactgatttcgtataatgctcttttcttataagtgcctataaagtatataggatttttatttggagccacttagactctgataaagtcctgcctaaatttattaacctcagccagttctcttcaatttagaagtaaagttgatgtttcagtcatatggactagctgcttctcttatatttataagtaaccattcacaacagacttcatgataatgtcacaattacttttttgttatttataagtactgtcattaatttatctacctatcctagttgtacaattattttgacaayatgtatacatttatgttctgtagcttgcattttaagcctctgaaatactaacctagtgaagtcatggatgaaaacaatgctcattgcttctttctacttgcaggaataaaatataatatgtctacttttttaacgtaaatttttaggcaatcccaacctaatttttgtcaagtgtaagaaggagcttctcatgagaacattttccacactaaaaaacttgcaagaagattgagaaatcctggcattttatcattatgggctgcttcactctgaatcaaaaacagcaaggaggagacaagg

SEQ ID NO: 73079 - DNA, 601 bp, Human
agatccctcacccacagaaaatacatcaacatataacaaaaaggggtgcctaatgctttttcattaattcaatgaatgtttattaaggcactgatttcgtataatgctcttttcttataagtgcctataaagtatataggatttttatttggagccacttagactctgataaagtcctgcctaaatttattaacctcagccagttctcttcaatttagaagtaaagttgatgtttcagtcatatggactagctgcttctcttatatttataagtaaccattcacaacagacttcatgatawtgtcacaattacttttttgttatttataagtactgtcattaatttatctacctatcctagttgtacaattattttgacaatatgtatacatttatgttctgtagcttgcattttaagcctctgaaatactaacctagtgaagtcatggatgaaaacaatgctcattgcttctttctacttgcaggaataaaatataatatgtctacttttttaacgtaaatttttaggcaatcccaacctaatttttgtcaagtgtaagaaggagcttctcatgagaacattttccacactaaaaaactt

SEQ ID NO: 73080 - DNA, 601 bp, Human
tcacatagctggcgctcagtaaatatgtgctaaatgaatgaatagagaattcctcaacagctcattgactggctttcaaaaagatgcgacgttaggaatgaaaagaccattgcaggaaccagatccctcacccacagaaaatacatcaacatataacaaaaaggggtgcctaatgctttttcattaattcaatgaatgtttattaaggcactgatttcgtataatgctcttttcttataagtgcctataaagtatataggatttttatttggagccacttagactctgataaagtcctgcstaaatttattaacctcagccagttctcttcaatttagaagtaaagttgatgtttcagtcatatggactagctgcttctcttatatttataagtaaccattcacaacagacttcatgataatgtcacaattacttttttgttatttataagtactgtcattaatttatctacctatcctagttgtacaattattttgacaatatgtatacatttatgttctgtagcttgcattttaagcctctgaaatactaacctagtgaagtcatggatgaaaacaatgctcattgcttctttctactt

SEQ ID NO: 73081 - DNA, 601 bp, Human
cctaagcaccgccatccacctgccaccttactcttggcccttcactgatctctcaccaagttttctcttttatacatgtgaaatcattctcaaatacacacacttctttccattctcattgccatgatcgttgtcactgggtagcatctaagggcacttgtaaaatataaatgtgaagatgaagatgaagacataagcaggagacacagagctgagtgtaagtgacccctgaagtaagggagtggatgtgaagatctgctgcttgatagatgtatctgtatcctctggacagtggtttgcygtgttctagataaactcttcagggtggagatctctgatttgtttcctgctatgtctccagctcctcaaacagtgcctgtcacatagctggcgctcagtaaatatgtgctaaatgaatgaatagagaattcctcaacagctcattgactggctttcaaaaagatgcgacgttaggaatgaaaagaccattgcaggaaccagatccctcacccacagaaaatacatcaacatataacaaaaaggggtgcctaatgctttttcattaattcaatgaatgtttattaaggcactgatttcgtat

SEQ ID NO: 73082 - DNA, 601 bp, Human
aatgtcaaaacctacagctccactatttccctaagcaccgccatccacctgccaccttactcttggcccttcactgatctctcaccaagttttctcttttatacatgtgaaatcattctcaaatacacacacttctttccattctcattgccatgatcgttgtcactgggtagcatctaagggcacttgtaaaatataaatgtgaagatgaagatgaagacataagcaggagacacagagctgagtgtaagtgacccctgaagtaagggagtggatgtgaagatctgctgcttgatagatrtatctgtatcctctggacagtggtttgctgtgttctagataaactcttcagggtggagatctctgatttgtttcctgctatgtctccagctcctcaaacagtgcctgtcacatagctggcgctcagtaaatatgtgctaaatgaatgaatagagaattcctcaacagctcattgactggctttcaaaaagatgcgacgttaggaatgaaaagaccattgcaggaaccagatccctcacccacagaaaatacatcaacatataacaaaaaggggtgcctaatgctttttcattaattcaat

SEQ ID NO: 73083 - DNA, 601 bp, Human
atatttcctaaaaaatcttcctctagtaattcctccatggatgtcctaacatgttaagtgagctcattttcctaatcctaatgtcaaaacctacagctccactatttccctaagcaccgccatccacctgccaccttactcttggcccttcactgatctctcaccaagttttctcttttatacatgtgaaatcattctcaaatacacacacttctttccattctcattgccatgatcgttgtcactgggtagcatctaagggcacttgtaaaatataaatgtgaagatgaagatgaagacrtaagcaggagacacagagctgagtgtaagtgacccctgaagtaagggagtggatgtgaagatctgctgcttgatagatgtatctgtatcctctggacagtggtttgctgtgttctagataaactcttcagggtggagatctctgatttgtttcctgctatgtctccagctcctcaaacagtgcctgtcacatagctggcgctcagtaaatatgtgctaaatgaatgaatagagaattcctcaacagctcattgactggctttcaaaaagatgcgacgttaggaatgaaaagaccattgca

SEQ ID NO: 73084 - DNA, 601 bp, Human
actgaaactctctggtagaacacagaatttctttcattgtttgttccttttcccttttcctgccatatttcctaaaaaatcttcctctagtaattcctccatggatgtcctaacatgttaagtgagctcattttcctaatcctaatgtcaaaacctacagctccactatttccctaagcaccgccatccacctgccaccttactcttggcccttcactgatctctcaccaagttttctcttttatacatgtgaaatcattctcaaatacacacacttctttccattctcattgccatgatmgttgtcactgggtagcatctaagggcacttgtaaaatataaatgtgaagatgaagatgaagacataagcaggagacacagagctgagtgtaagtgacccctgaagtaagggagtggatgtgaagatctgctgcttgatagatgtatctgtatcctctggacagtggtttgctgtgttctagataaactcttcagggtggagatctctgatttgtttcctgctatgtctccagctcctcaaacagtgcctgtcacatagctggcgctcagtaaatatgtgctaaatgaatgaatagagaat

SEQ ID NO: 73085 - DNA, 601 bp, Human
atagcacagtaaaagtggataagaccataacaaccaaaaaagaaaagtattgcaaggatggatccaagtacatgtctatgcagaaaaggagagtttagtgcttggttgtacacattctcctaaatgtatccatatccatcactttctctcctcccctccattccagttttggttaggccttcatcatccttttggggtaaattttaacagcatccttaccaaaatccttttatatcttgtatttctttcttccatcctacccagggctagtcaagcaatctttaaaatatgaaacctatgycattccctcatcaaaatgctttctttgtttccatatctcctgcatgataaaactgaaactctctggtagaacacagaatttctttcattgtttgttccttttcccttttcctgccatatttcctaaaaaatcttcctctagtaattcctccatggatgtcctaacatgttaagtgagctcattttcctaatcctaatgtcaaaacctacagctccactatttccctaagcaccgccatccacctgccaccttactcttggcccttcactgatctctcaccaagttttctcttttatacat

SEQ ID NO: 73086 - DNA, 601 bp, Human
attaggcttccaatggttctactgtgacaaagttcaaatcaactagtatttagagtatctattacaagtgaagcactatgttcagtaccattggaatatgcaaaatgaataagacataatccttgtcatctaagattttatagcacagtaaaagtggataagaccataacaaccaaaaaagaaaagtattgcaaggatggatccaagtacatgtctatgcagaaaaggagagtttagtgcttggttgtacacattctcctaaatgtatccatatccatcactttctctcctcccctccatyccagttttggttaggccttcatcatccttttggggtaaattttaacagcatccttaccaaaatccttttatatcttgtatttctttcttccatcctacccagggctagtcaagcaatctttaaaatatgaaacctatgtcattccctcatcaaaatgctttctttgtttccatatctcctgcatgataaaactgaaactctctggtagaacacagaatttctttcattgtttgttccttttcccttttcctgccatatttcctaaaaaatcttcctctagtaattcctccatggatgtcc

SEQ ID NO: 73087 - DNA, 601 bp, Human
aggagagaagcatggaccagactagcctgcagagcccgcagaaggaacccaaacctcctgccacctgctcttgggcttccaacttccagagctgtgagccaatatatttctgtggtttatgtcacccagtctttggtactttgttttagcagctttagcaaactaatacagacccacaggtgaccttcttatctgtcaattgcaaactgtggactacacacttctgaggaatcttccagttccaacagtttctaattcagaataacaaaccgagctaatcatgaagcacaaggctgtctgrgtaacggtgagcacctcagacaaaatccatggactgggagtaaatagacctagaattgggtgccatctctgccaccaaagaactgtgaaacactgaggaatgactcaactttgctggtttctgctttctcatctgtaaaactagaaggtagaaaaagtattcctgaaggtttatttcagccttaaattattaggcttccaatggttctactgtgacaaagttcaaatcaactagtatttagagtatctattacaagtgaagcactatgttcagtaccattggaatatgcaaaatgaataa

SEQ ID NO: 73088 - DNA, 601 bp, Human
acacatgcttgtatccaaatgataattacttgtttatgtttataccaggtatttaatggtagtttatagctcttgggctacaagttagaggtcttcatcatctgtaatatttagctatctttggagagaaacctctttcccaagtgaaataaaatatgctttgcagttgtgtcgtttgaacttcatgttttgtacatcctgggaccttaatctttggtgtgtgacaggttatagttttaaatgttcagccatattacagctttttaaaatgcactgataccatggcacattttttcttccmcagctatagcccattccctgcatatcgctgacaactcggatctctcttcatctctgtcccagagtcagtgccatttaatgtatctcaggcattttgcttgcagaatgactctctaccttgacccgcagttaaatagcatgtttatctgcaatacagtgtgctccaaataaaccagatgacagttgggaataacatcatttggaaggattgaaaagcttctcaagaggcaggtacccctgaggtaataggcttgaagaaagcatgttttgtgccaaccgtcttgccttcttctactggaaa

SEQ ID NO: 73089 - DNA, 601 bp, Human
caccaaagagaaaagcctcgttcactattgttattaagctccaattatttaaaaagttaaatataaataaaggtaacagggtttggtgcaaaggagtcagattctgaatgtaaatactggctccacttagctactggctctttcaccttgagcaagagaaattaacttgtctcttaaatttcgtatttgggaaatataaaatatcacctacctaaacattaagctataacctgaaattcagtaagtgttgttgtatgattaatatatgttctttttatctgaattacctatgtgatcaatycttttctgcaaatctgggatgcattcatacacgcatatttaaagtccctctgagcttgagaaaacatatgcaaaaaaattaaaaagaaaatgttgttcaatagagaaagaggaagcagtacaattaagcctacttaggagtgaagatatatatttatatatcagagggactagatctgtattctaaagtgaagatacctgatgatcagaagcttttctcaagtcctaaaaaagaaatgtttcttaaaacttcacttttatttccaagtgtatgcctaagacttctaagggtaaccatcca

SEQ ID NO: 73090 - DNA, 601 bp, Human
aaataggtgagccttcttaattggctatttctccccactgatatttaacatgactttcttttaaaattagtgataataggtataaaagaaagtgtaatatgtagcagcctggcctccccaccaaagagaaaagcctcgttcactattgttattaagctccaattatttaaaaagttaaatataaataaaggtaacagggtttggtgcaaaggagtcagattctgaatgtaaatactggctccacttagctactggctctttcaccttgagcaagagaaattaacttgtctcttaaatttcrtatttgggaaatataaaatatcacctacctaaacattaagctataacctgaaattcagtaagtgttgttgtatgattaatatatgttctttttatctgaattacctatgtgatcaattcttttctgcaaatctgggatgcattcatacacgcatatttaaagtccctctgagcttgagaaaacatatgcaaaaaaattaaaaagaaaatgttgttcaatagagaaagaggaagcagtacaattaagcctacttaggagtgaagatatatatttatatatcagagggactagatctgtatt

SEQ ID NO: 73091 - DNA, 601 bp, Human
ctttgattagaagctcttaaaattttccctggatcactttgcgaacagcaaagtgaaagtcacaaaccagcttcttcaatttgtgggtatttgctataagttttatagacacagcttaggggaatataatagagatgtcgctttctttcattcgagaagaaaataccatgtaatctttaaatatacttgatttctggttgaagtctttaggaaaatcttacaggaagtcagattttcaactatctcatctctaaaaactactattggtaaacaacataaaagtaaaaaaaaaaaaaagaakaagaaggagaagaagaagcagctaaaaataaaaggtaaacaaacaatttaggccatagagctcagcacaacttggaaacatttctgtataatattaataattacaagcacaatggatgatgagttacaaataggtgagccttcttaattggctatttctccccactgatatttaacatgactttcttttaaaattagtgataataggtataaaagaaagtgtaatatgtagcagcctggcctccccaccaaagagaaaagcctcgttcactattgttattaagctccaattatttaaaaa

SEQ ID NO: 73092 - DNA, 601 bp, Human
gagctttgattagaagctcttaaaattttccctggatcactttgcgaacagcaaagtgaaagtcacaaaccagcttcttcaatttgtgggtatttgctataagttttatagacacagcttaggggaatataatagagatgtcgctttctttcattcgagaagaaaataccatgtaatctttaaatatacttgatttctggttgaagtctttaggaaaatcttacaggaagtcagattttcaactatctcatctctaaaaactactattggtaaacaacataaaagtaaaaaaaaaaaaaaraagaagaaggagaagaagaagcagctaaaaataaaaggtaaacaaacaatttaggccatagagctcagcacaacttggaaacatttctgtataatattaataattacaagcacaatggatgatgagttacaaataggtgagccttcttaattggctatttctccccactgatatttaacatgactttcttttaaaattagtgataataggtataaaagaaagtgtaatatgtagcagcctggcctccccaccaaagagaaaagcctcgttcactattgttattaagctccaattatttaa

SEQ ID NO: 73093 - DNA, 601 bp, Human
agcactctgcagaaggctcatctggtccgccagggacagcgtggagaagcctgcatggaaagatgggcagatcaagttactttaaagccataatttcataatgcaacattagtttcatatggtagctggcttctgcatcagtgctcaaaattatgctgagctttgattagaagctcttaaaattttccctggatcactttgcgaacagcaaagtgaaagtcacaaaccagcttcttcaatttgtgggtatttgctataagttttatagacacagcttaggggaatataatagagatgtcgytttctttcattcgagaagaaaataccatgtaatctttaaatatacttgatttctggttgaagtctttaggaaaatcttacaggaagtcagattttcaactatctcatctctaaaaactactattggtaaacaacataaaagtaaaaaaaaaaaaaagaagaagaaggagaagaagaagcagctaaaaataaaaggtaaacaaacaatttaggccatagagctcagcacaacttggaaacatttctgtataatattaataattacaagcacaatggatgatgagttacaaataggtgagcc

SEQ ID NO: 73094 - DNA, 601 bp, Human
ttataattttgctgactcatacaaaatttacaaaccaggtctagcaaatccctaaagaagttaaggagaggggtaaaactgacatattaaaaaaaatgtaacaatgactatgtcagtatgccaacctgaattagcaagagctatagctttgagggtgacaaattcttctttttccagcttcatgctcttgtatttctttaccagctgcaggatagcattatttagatcaagaaggcctgctaatttggactggtcttcgtccattatataatcgtctgcatagacaagttcatcctcaaaygaaagagaccggtatacgacaccaaggatcaaaatttccatccaagcactctgcagaaggctcatctggtccgccagggacagcgtggagaagcctgcatggaaagatgggcagatcaagttactttaaagccataatttcataatgcaacattagtttcatatggtagctggcttctgcatcagtgctcaaaattatgctgagctttgattagaagctcttaaaattttccctggatcactttgcgaacagcaaagtgaaagtcacaaaccagcttcttcaatttgtgggtatttgcta

SEQ ID NO: 73095 - DNA, 601 bp, Human
atagaaataattttgtcctgggagtgtccatttatgctattactacaagagcttttgctttgccatgatccaaattagtacatgcattagttgataaaagtttcaaagcattcaataagcaagtcaaatgaaattaattccctttaagtatatttttcttatttctaacttttcactagaaagctatactgattataattttgctgactcatacaaaatttacaaaccaggtctagcaaatccctaaagaagttaaggagaggggtaaaactgacatattaaaaaaaatgtaacaatgacyatgtcagtatgccaacctgaattagcaagagctatagctttgagggtgacaaattcttctttttccagcttcatgctcttgtatttctttaccagctgcaggatagcattatttagatcaagaaggcctgctaatttggactggtcttcgtccattatataatcgtctgcatagacaagttcatcctcaaacgaaagagaccggtatacgacaccaaggatcaaaatttccatccaagcactctgcagaaggctcatctggtccgccagggacagcgtggagaagcctgcatggaaagat

SEQ ID NO: 73096 - DNA, 601 bp, Human
cataataaagcattaagagaggcacaaagggaaaaacaacaaagcaccaacgatttttacttattagaggttgctattttagcatgtttcagttcgaatgtaaagaccagttattcccataattcttaacccttactgcataggcagaatttgacttctaaagaactccagaatgtaagaaaactgttctttgataaccaaaactcaaagcaacactaaatatattttcccaattgcacaatttgcatttttgagggaaaaatggtttgtgtgtatcaacaattcccttgttttaacttaygcataaaatacaatagaaataattttgtcctgggagtgtccatttatgctattactacaagagcttttgctttgccatgatccaaattagtacatgcattagttgataaaagtttcaaagcattcaataagcaagtcaaatgaaattaattccctttaagtatatttttcttatttctaacttttcactagaaagctatactgattataattttgctgactcatacaaaatttacaaaccaggtctagcaaatccctaaagaagttaaggagaggggtaaaactgacatattaaaaaaaa

SEQ ID NO: 73097 - DNA, 601 bp, Human
aaagatagggtcaaaacaaaagcagatggaggggcacggtgtgactgtcagtggtacatagcatcagagcacgttattgacacgcaggtatctaatgatcggcacgtcattaaggagggatctatcctgaactttatgcaaatgctaaaagagacttaagaccataataaagcattaagagaggcacaaagggaaaaacaacaaagcaccaacgatttttacttattagaggttgctattttagcatgtttcagttcgaatgtaaagaccagttattcccataattcttaacccttactgyataggcagaatttgacttctaaagaactccagaatgtaagaaaactgttctttgataaccaaaactcaaagcaacactaaatatattttcccaattgcacaatttgcatttttgagggaaaaatggtttgtgtgtatcaacaattcccttgttttaacttacgcataaaatacaatagaaataattttgtcctgggagtgtccatttatgctattactacaagagcttttgctttgccatgatccaaattagtacatgcattagttgataaaagtttcaaagcattcaataagcaagtca

SEQ ID NO: 73098 - DNA, 601 bp, Human
agtcgtcatccacaagtaagcaaaagcaatctggtttttcatttttcagcgcggctgagcccagcctgagattgatcgtcacatatggccccagaaaacaaactgtcaataccttgaatgctgcagaatttgaacaaatagccgtccgcccattcaagccactcattgcatcccatttaacagattttattgacagtttccttcttgtaattaaagggaaaactactggccggcaaccaagataaagttcaaagatagggtcaaaacaaaagcagatggaggggcacggtgtgactgtcartggtacatagcatcagagcacgttattgacacgcaggtatctaatgatcggcacgtcattaaggagggatctatcctgaactttatgcaaatgctaaaagagacttaagaccataataaagcattaagagaggcacaaagggaaaaacaacaaagcaccaacgatttttacttattagaggttgctattttagcatgtttcagttcgaatgtaaagaccagttattcccataattcttaacccttactgcataggcagaatttgacttctaaagaactccagaatgtaagaaaactgttc

SEQ ID NO: 73099 - DNA, 601 bp, Human
tttctccgtattgaggggctaagtcaatgatggaatcacctgcaagaatattttgggacagagacttttttttagaagaagcaatgttactcaactaccatgataagagaagaaaggagagcttattgaccatttctgactttagacatgaaaaataaatgaactaattctttaaagactttctaatcatcagtcactgctgtgaggtagtcacttcctctcccagaagtagaatatgtggattaggacgtttatctatcagaaatattaatgcttatacttctaagcaacagagacagaratgctgctactaattaattcagttactctaaattataatagtcataaagtacacatccaatatctaaaattatacatttttagcaattttgttgataaagttttagcattgctcagcattcatggttagttaataatttttaaaagcaatttgaaacataaaagatttaacacaggctttagtatattttaaaaacaattaaccaagtaaatgttttaaattagaatcgtttcatgattgccaaataaaaattcttcccaaaaccactgttataaaatatttcatctcattatgagagat

SEQ ID NO: 73100 - DNA, 601 bp, Human
atagaaatagctcattgatagcaaaggacagaaggtcccaccttctgcctcataatagccatgcatgattatcagctttcttcgcatacctgtgaaatagtactggacatgcctactgcacaggcatgttgtgggaatcaaataagattccctagaagaagcttaaaaaaggaaatgtctacagaaagattctgaaaaaggataatctcttgaccagcagctaaaactatctccagaatatcaaatcaactaatttagtcaaaattttgtaaaactggctaaggcccagttttactttatccacacacacacacacacacacacacaacacacacttacatatgtacatatatatacatgtatgaaaccaaactggccacctttacttaaaagtaatcaatctaaaattttcaggccatttaagggatattagacattatttaattcacctgccttattttacagatgagaaaacagttatgtatttaagcgatgtattctcaaaggaggtgaaatttggaattagagagtagaaaatattcctctttttaggtaaaatgcgtatatataatataatatatatatgcatggatgtgtgtac

SEQ ID NO: 73101 - DNA, 601 bp, Human
gttataatttcttggtaaacatttcatgttcaattttgtcactttcttgggtagttttatactcctctaactccaagaagatggcaagataaaggaagtgggcatgaaattctcaatcaaattaaaaatactaatttaggctcccagatgtgaaattgtaatgggtaaagtcttctgcattaatccttttagaaacatgtatataattatttgtggaatagaaatagctcattgatagcaaaggacagaaggtcccaccttctgcctcataatagccatgcatgattatcagctttcttcrcatacctgtgaaatagtactggacatgcctactgcacaggcatgttgtgggaatcaaataagattccctagaagaagcttaaaaaaggaaatgtctacagaaagattctgaaaaaggataatctcttgaccagcagctaaaactatctccagaatatcaaatcaactaatttagtcaaaattttgtaaaactggctaaggcccagttttactttatacacacacacacacacacacacacacaacacacacttacatatgtacatatatatacatgtatgaaaccaaactggccaccttt

SEQ ID NO: 73102 - DNA, 601 bp, Human
tatcaagtagggagctgaatcaaaaaaatgtttaggtttcttccaacccagaaatcttatgattttaaaatcgaaaatagtaataataattctgatttttctgcttaaccatggtgacaataatataactttccatttcagagctctccattaagatactgttagtttttttagaaggcctgttttccttatttcttgctgtggctaaaaagctagttttctttgacatttacaccagccacacaaatcactctgactgtatttatataaaatgttgaaccacagaaaacctccatggtcrtggttgtagtttctttccttcaggcttcttacaagtcccaaattactattaatattgttatgtttaccttgcataatgggatttacctgctaggtcttttctatttttctataattacttaaggccttccatctctctctccatatcttacacttttccagggggtttttaactcattttgctacaagtcataaagacaattatagtatactgggtaagtgaatgttgatatcaatttgggtggtgaatagttcaacatttcaaaacatcatagatgatctgcaccatgctaatgacgtt

SEQ ID NO: 73103 - DNA, 601 bp, Human
atcgagaccatcctggctaacaccgtgaaaacccgtctctactaaaaatacaaaaaattagccgggcgtagtggtgggcgcctgcagtcccagctactcgggaggctgaggcatgaacccaggaggcggagatggcagtgagctgagatcgcgccactgcactccagcctgggcgacagagccagactccgtctcaaaaaaaaaagaagaaaacattaatcattgtgtgcacagacatagctactccaaaatacctaagtcctgcttgggaactttcttctggacttttagaccattcttrgcaatactttctcaagagtgccaaatctcattttgagtatggaattgaatattagatacaggcacagtatattcagagtcgagcctagtatataacataaaccaacagtcagtgtaaacttttctgtgaaacgcaggacttgattttctttgatgtttgtgaactgcctacataaagatgggtagtaaggaaagggtgaatgggactctctccaatcattgaatgaatgaaacagaatgtcatggaaagaatagagaagtggaaaaaggtctattttctaaaagatactttgtatcttta

SEQ ID NO: 73104 - DNA, 601 bp, Human
gtatggggaaacactatggtgagtctctagatacacaaaagactgcaatatggaccttgtgcataagggaacagagatgagttggattttcccaacttatcctgggtctaataattagctctctacatgaaaacagagtaatagatggaaggagaaaatgggaattacactctgcagtgacaaaacaaacgaaataactattttccaactagaccaaaaacacaccagaataaaaataatacatttaccatttattaagcacctatttcaggtgaacatggcctcattttacctccccaarccctagaagacacgtggcactggtaatatgtgtcagacacaggtttaaattcaggattcttcaaatcaataatgctgctagaatgtagaacactaaatttgcattcccttaaaaattgggatgaattgtcctctaaacacatcctattcaaactcctatcttcatcagctgtcttctttacaacattcttaatgaagacattgccagttgtatgaaaagtatgtagagtattctccttgataagaggcaaaactaattattatgaatttcctctttaaattttcctaaatctgtctccaa

SEQ ID NO: 73105 - DNA, 601 bp, Human
gctactatgtttcttaggacggcccccgcgggacttggcagctctcctggagccctgctcggtctgaatcaccggcctcgtccagacctgcccctctccccacacccacccccatggtgtgccctgggtggggacgtcagcagatccaccctggtggacttcagggttctggggtagccctcaggagaggtcttgttccccctctttgtgaggtagcccaggactgggggatgtgggtgtgttgcccagcccagtcagatgcgcttgaactggggtggcccatggttctcttgtctttgtktaaaacctgtaagtggagtggaatgcagctcttaaatccccagggaggtttggccaaggccaaatgcagaaacaacttttgcataaagcaagtattatctctatagcactttgtaaactgcattggaggctagtcccacatatgtaaatacatgtgattgtatacgaatgcccacgggtctgagaggagtgtcccgtgacttccagggctctgagatctgttggcatcagctcagttgtgatcttgagaactccagcgtgcaccaaggcgtcctccctccaggcttggatcctgatccat

SEQ ID NO: 73106 - DNA, 601 bp, Human
atgcatcctgtaactcctgctgacttactgaatttgtgagtcagcataatggtcaagaagtacctttttgactggcaaggtctagctttcctttctgttcatcgtcactaaaattcaagagcctgtgtgttctgagggatcctgggtaccgggctgagtcctaagatggtgcttgggacttggcattacatcagaagttgccatgatcagtggagcaaaggagggggtattagtactggtcaggccagtgcaggtttgtaagcaacaggtaaaagacagccttttaaagcaccaaactttsttttttgagacagggtctcactgtcacccaggctggagtgcaatggtgcaatcacgtctcattgaagccttgaactcctgggctcaagcaatcctgtctcagcctcctgagtagctgggactaggggcatgtgctactgcgcccagctaatttttaaaaatatttttgcacaaacggggtctctctatgttgcccaagctggtctcgaattcctggcctcaagcaatgcccccttggcctcccaaagtgctgggattacaggtgtaagccagggtacctggccttttttttttttttttt

SEQ ID NO: 73107 - DNA, 601 bp, Human
ctggcaaggtctagctttcctttctgttcatcgtcactaaaattcaagagcctgtgtgttctgagggatcctgggtaccgggctgagtcctaagatggtgcttgggacttggcattacatcagaagttgccatgatcagtggagcaaaggagggggtattagtactggtcaggccagtgcaggtttgtaagcaacaggtaaaagacagccttttaaagcaccaaactttgttttttgagacagggtctcactgtcacccaggctggagtgcaatggtgcaatcacgtctcattgaagcctygaactcctgggctcaagcaatcctgtctcagcctcctgagtagctgggactaggggcatgtgctactgcgcccagctaatttttaaaaatatttttgcacaaacggggtctctctatgttgcccaagctggtctcgaattcctggcctcaagcaatgcccccttggcctcccaaagtgctgggattacaggtgtaagccagggtacctggccttttttttttttttttttttttgcctcttaaaaacagtggaatgagacaaactgccagcttgtctttgctcaggatttagacaccatg

SEQ ID NO: 73108 - DNA, 601 bp, Human
tgttctgagggatcctgggtaccgggctgagtcctaagatggtgcttgggacttggcattacatcagaagttgccatgatcagtggagcaaaggagggggtattagtactggtcaggccagtgcaggtttgtaagcaacaggtaaaagacagccttttaaagcaccaaactttgttttttgagacagggtctcactgtcacccaggctggagtgcaatggtgcaatcacgtctcattgaagccttgaactcctgggctcaagcaatcctgtctcagcctcctgagtagctgggactagggrcatgtgctactgcgcccagctaatttttaaaaatatttttgcacaaacggggtctctctatgttgcccaagctggtctcgaattcctggcctcaagcaatgcccccttggcctcccaaagtgctgggattacaggtgtaagccagggtacctggccttttttttttttttttttttttgcctcttaaaaacagtggaatgagacaaactgccagcttgtctttgctcaggatttagacaccatgggaaattgagtctgaagaaaggttgatgtggcactcaaatacggatagaaagactt

SEQ ID NO: 73109 - DNA, 601 bp, Human
ggcttagcccaaaggcactactcagccacattgaccctgtatcccccaagtagcctctgtctcacgggtacccagtgcatgtacctggtgcatgtgcccagtgagcgagcgtgtcatgaacgtagcaaccttgcagaattgaagttccgtgcctgggacttggtgactttctgggaggacttacccacgtggccatggttgtaaccatgacaacactttgagctcgagtcccccagattcaattcgggtgtttagtctgttacccagggtctttacacagttgttccttcccctgtaaccyggtgacatctgtgttcccccaggcatgtttcagttgacctctaaagtccacatctaaacacatttaagtttcacaactttcaaaaactttaggtgtgtgaaaaagaagttaaaatattgaacatttacataaaatgaaatgagacacaaatactctttggaaaatcttgtgttaaactcaataattttttttttgtttttttgagacagagttttgctctgtttcccaggctggagtgcattggtacaatctcggctcactgcaacctctgcctcccaggttcaagcgattctcctacct

SEQ ID NO: 73110 - DNA, 601 bp, Human
cacgtggccatggttgtaaccatgacaacactttgagctcgagtcccccagattcaattcgggtgtttagtctgttacccagggtctttacacagttgttccttcccctgtaacccggtgacatctgtgttcccccaggcatgtttcagttgacctctaaagtccacatctaaacacatttaagtttcacaactttcaaaaactttaggtgtgtgaaaaagaagttaaaatattgaacatttacataaaatgaaatgagacacaaatactctttggaaaatcttgtgttaaactcaataattttttttttgtttttttgagacagagttttgctctgtttcccaggctggagtgcattggtacaatctcggctcactgcaacctctgcctcccaggttcaagcgattctcctacctcagcagatgggattacaggtgcctgctaccacgcctggctaatttttgtatttttagtatagacggggttttgccatgttgaccaggctggtttcgaactcctgacctcaggtggtctgccctcctctgctgcccaaagtgctgggagaccatgcccagccaatacttaccttttcttttttttt

SEQ ID NO: 73111 - DNA, 601 bp, Human
gaactgtttgttctaggtcactggacatcaagagcatggcagcccagggcttttagcgtctcctcatctgctgatagcctgtctgtctccttactctgcctgctgagaaggccactaatggtctccaaatagcatggaggggacaaaggcccggcatgccatgcctgcttccctgcccccacctccaggcctagcggcagatcctggacattgacttcagtttggagccctgctgggggctccggcttacagaggggcttctttcctgagctgcggcccgtctgaggggtggtggctcccrcagcataagcctgctcagctcggacatcagggcctctgtccagtctgacatctgcctggttctgtgtgcggctttcagaggttttcctgcaggccatgtgggctgtgtctgggaatgatgaggacagccaggctaaccacgtggcagtgagtgctgggccgtgccgcccaggcgggagctggcgggtatcatctggccctggagcttgcatgtcggcaggatgcgggagttgcctgagactcccagggccaggcgacagccggggagatactgggccctcggctcccagaacagggggct

SEQ ID NO: 73112 - DNA, 601 bp, Human; identical to SEQ ID NO: 30609

SEQ ID NO: 73113 - DNA, 601 bp, Human; identical to SEQ ID NO: 30610

SEQ ID NO: 73114 - DNA, 601 bp, Human; identical to SEQ ID NO: 30611

SEQ ID NO: 73115 - DNA, 601 bp, Human; identical to SEQ ID NO: 30612

SEQ ID NO: 73116 - DNA, 601 bp, Human; identical to SEQ ID NO: 30613

SEQ ID NO: 73117 - DNA, 601 bp, Human; identical to SEQ ID NO: 30614

SEQ ID NO: 73118 - DNA, 601 bp, Human; identical to SEQ ID NO: 30615

SEQ ID NO: 73119 - DNA, 601 bp, Human; identical to SEQ ID NO: 30616

SEQ ID NO: 73120 - DNA, 601 bp, Human; identical to SEQ ID NO: 30617

SEQ ID NO: 73121 - DNA, 601 bp, Human; identical to SEQ ID NO: 30618

SEQ ID NO: 73122 - DNA, 601 bp, Human; identical to SEQ ID NO: 30619

SEQ ID NO: 73123 - DNA, 601 bp, Human; identical to SEQ ID NO: 30620

SEQ ID NO: 73124 - DNA, 601 bp, Human; identical to SEQ ID NO: 30621

SEQ ID NO: 73125 - DNA, 601 bp, Human; identical to SEQ ID NO: 30622

SEQ ID NO: 73126 - DNA, 601 bp, Human; identical to SEQ ID NO: 30623

SEQ ID NO: 73127 - DNA, 601 bp, Human; identical to SEQ ID NO: 30624

SEQ ID NO: 73128 - DNA, 601 bp, Human; identical to SEQ ID NO: 30625

SEQ ID NO: 73129 - DNA, 601 bp, Human; identical to SEQ ID NO: 30626

SEQ ID NO: 73130 - DNA, 601 bp, Human; identical to SEQ ID NO: 30627

SEQ ID NO: 73131 - DNA, 601 bp, Human; identical to SEQ ID NO: 30628

SEQ ID NO: 73132 - DNA, 601 bp, Human; identical to SEQ ID NO: 30629

SEQ ID NO: 73133 - DNA, 601 bp, Human; identical to SEQ ID NO: 30630

SEQ ID NO: 73134 - DNA, 601 bp, Human; identical to SEQ ID NO: 30631

SEQ ID NO: 73135 - DNA, 601 bp, Human; identical to SEQ ID NO: 30632

SEQ ID NO: 73136 - DNA, 601 bp, Human; identical to SEQ ID NO: 30633

SEQ ID NO: 73137 - DNA, 601 bp, Human; identical to SEQ ID NO: 30634

SEQ ID NO: 73138 - DNA, 601 bp, Human; identical to SEQ ID NO: 30635

SEQ ID NO: 73139 - DNA, 601 bp, Human; identical to SEQ ID NO: 30636

SEQ ID NO: 73140 - DNA, 601 bp, Human; identical to SEQ ID NO: 30637

SEQ ID NO: 73141 - DNA, 601 bp, Human; identical to SEQ ID NO: 30638

SEQ ID NO: 73142 - DNA, 601 bp, Human; identical to SEQ ID NO: 30639

SEQ ID NO: 73143 - DNA, 601 bp, Human; identical to SEQ ID NO: 30640

SEQ ID NO: 73144 - DNA, 601 bp, Human; identical to SEQ ID NO: 30641

SEQ ID NO: 73145 - DNA, 601 bp, Human; identical to SEQ ID NO: 30642

SEQ ID NO: 73146 - DNA, 601 bp, Human; identical to SEQ ID NO: 30643

SEQ ID NO: 73147 - DNA, 601 bp, Human; identical to SEQ ID NO: 30644

SEQ ID NO: 73148 - DNA, 601 bp, Human; identical to SEQ ID NO: 30645

SEQ ID NO: 73149 - DNA, 601 bp, Human; identical to SEQ ID NO: 30646

SEQ ID NO: 73150 - DNA, 601 bp, Human; identical to SEQ ID NO: 30647

SEQ ID NO: 73151 - DNA, 601 bp, Human; identical to SEQ ID NO: 30648

SEQ ID NO: 73152 - DNA, 601 bp, Human; identical to SEQ ID NO: 30649

SEQ ID NO: 73153 - DNA, 601 bp, Human; identical to SEQ ID NO: 30650

SEQ ID NO: 73154 - DNA, 601 bp, Human; identical to SEQ ID NO: 30651

SEQ ID NO: 73155 - DNA, 601 bp, Human; identical to SEQ ID NO: 30652

SEQ ID NO: 73156 - DNA, 601 bp, Human; identical to SEQ ID NO: 30653

SEQ ID NO: 73157 - DNA, 601 bp, Human; identical to SEQ ID NO: 30654

SEQ ID NO: 73158 - DNA, 601 bp, Human; identical to SEQ ID NO: 30655

SEQ ID NO: 73159 - DNA, 601 bp, Human; identical to SEQ ID NO: 30656

SEQ ID NO: 73160 - DNA, 601 bp, Human; identical to SEQ ID NO: 30657

SEQ ID NO: 73161 - DNA, 601 bp, Human; identical to SEQ ID NO: 30658

SEQ ID NO: 73162 - DNA, 601 bp, Human; identical to SEQ ID NO: 30659

SEQ ID NO: 73163 - DNA, 601 bp, Human; identical to SEQ ID NO: 30660

SEQ ID NO: 73164 - DNA, 601 bp, Human; identical to SEQ ID NO: 30661

SEQ ID NO: 73165 - DNA, 601 bp, Human; identical to SEQ ID NO: 30662

SEQ ID NO: 73166 - DNA, 601 bp, Human
tctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaarcccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactga

SEQ ID NO: 73167 - DNA, 601 bp, Human
tctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcartgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttct

SEQ ID NO: 73168 - DNA, 601 bp, Human
tatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttrcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataatt

SEQ ID NO: 73169 - DNA, 601 bp, Human
accagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggwtgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatgg

SEQ ID NO: 73170 - DNA, 601 bp, Human
agacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaamcatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataa

SEQ ID NO: 73171 - DNA, 601 bp, Human
ctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagagraggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttatttttta

SEQ ID NO: 73172 - DNA, 601 bp, Human
attttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcakgttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttt

SEQ ID NO: 73173 - DNA, 601 bp, Human
attaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacrgtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggtt

SEQ ID NO: 73174 - DNA, 601 bp, Human
ctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaac

SEQ ID NO: 73175 - DNA, 601 bp, Human
actaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccytcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaa

SEQ ID NO: 73176 - DNA, 601 bp, Human
gttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtrattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttattt

SEQ ID NO: 73177 - DNA, 601 bp, Human
aaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaaytcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaa

SEQ ID NO: 73178 - DNA, 601 bp, Human
agacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaamaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactac

SEQ ID NO: 73179 - DNA, 601 bp, Human
aactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatatamcaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgt

SEQ ID NO: 73180 - DNA, 601 bp, Human
ttgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattatarttgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaacc

SEQ ID NO: 73181 - DNA, 601 bp, Human
taaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcc

SEQ ID NO: 73182 - DNA, 601 bp, Human
gcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacrtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaa

SEQ ID NO: 73183 - DNA, 601 bp, Human
gaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctascaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgt

SEQ ID NO: 73184 - DNA, 601 bp, Human
tgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagytgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaag

SEQ ID NO: 73185 - DNA, 601 bp, Human
aattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatayattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatc

SEQ ID NO: 73186 - DNA, 601 bp, Human
tctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatrtatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtc

SEQ ID NO: 73187 - DNA, 601 bp, Human
actgtagattcttatcaaatttattacagactatatcttctgaatctctaacatatctaatattctactgattcacatcagttagcaaatacttgcagctgaaaaaataattagaagtacagattatacaagtaatgagcattattataacctttacaagagtagcatgtttactttttaaaattcaccaattaacttccatctagaaagaaataggaaaaagttattagagcctggttctgaaaaggtggaatttagtgttatgaaaatttgtattatccttgaatatttatattcttcycaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaag

SEQ ID NO: 73188 - DNA, 601 bp, Human
gttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctrcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggta

SEQ ID NO: 73189 - DNA, 601 bp, Human
cataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacayaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaatta

SEQ ID NO: 73190 - DNA, 601 bp, Human
gtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcraccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcagg

SEQ ID NO: 73191 - DNA, 601 bp, Human
tagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaataygtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcaga

SEQ ID NO: 73192 - DNA, 601 bp, Human
tctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagygacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccaggg

SEQ ID NO: 73193 - DNA, 601 bp, Human
tttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttrgaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagt

SEQ ID NO: 73194 - DNA, 601 bp, Human
tgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaartatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctt

SEQ ID NO: 73195 - DNA, 601 bp, Human
gttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcayggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgc

SEQ ID NO: 73196 - DNA, 601 bp, Human
tccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagktccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaa

SEQ ID NO: 73197 - DNA, 601 bp, Human
cagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagayaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcct

SEQ ID NO: 73198 - DNA, 601 bp, Human
gatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgmaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatac

SEQ ID NO: 73199 - DNA, 601 bp, Human
aattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatytccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaa

SEQ ID NO: 73200 - DNA, 601 bp, Human
ttgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgt

SEQ ID NO: 73201 - DNA, 601 bp, Human
gaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacacmctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaat

SEQ ID NO: 73202 - DNA, 601 bp, Human
ttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtg

SEQ ID NO: 73203 - DNA, 601 bp, Human
tttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccrtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttac

SEQ ID NO: 73204 - DNA, 601 bp, Human
tcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagygtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttt

SEQ ID NO: 73205 - DNA, 601 bp, Human
tattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatayatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgat

SEQ ID NO: 73206 - DNA, 601 bp, Human
aagacatgataaccaattcctttcctccaagtcgtcctcaaatttccaatttagaagctatacagagttaccatggtccccaaatgccataattttttaaataatattatttaaattttagagttctattaagaatacagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaat

SEQ ID NO: 73207 - DNA, 601 bp, Human
tattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaacwctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaacttttt

SEQ ID NO: 73208 - DNA, 601 bp, Human
tttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatatttttwaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgca

SEQ ID NO: 73209 - DNA, 384 bp, Human
taccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccartagggttaaatgtataattgttctctttcctctattcttcatcttttccaataccttctatatcccatactatccctccctcc

SEQ ID NO: 73210 - DNA, 580 bp, Human
aggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatkaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctcc

SEQ ID NO: 73211 - DNA, 601 bp, Human
attgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagaytggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagt

SEQ ID NO: 73212 - DNA, 601 bp, Human
attcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaattwatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggc

SEQ ID NO: 73213 - DNA, 601 bp, Human
actggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctaytgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttga

SEQ ID NO: 73214 - DNA, 601 bp, Human
ggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaaytatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaag

SEQ ID NO: 73215 - DNA, 601 bp, Human
agagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgyaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagt

SEQ ID NO: 73216 - DNA, 601 bp, Human
gcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctrtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagattta

SEQ ID NO: 73217 - DNA, 601 bp, Human
catctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagcctycagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactaccta

SEQ ID NO: 73218 - DNA, 601 bp, Human
aaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcrtgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagagg

SEQ ID NO: 73219 - DNA, 601 bp, Human
ttttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttga

SEQ ID NO: 73220 - DNA, 601 bp, Human
agctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgmaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggagg

SEQ ID NO: 73221 - DNA, 601 bp, Human
cttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactckggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttat

SEQ ID NO: 73222 - DNA, 601 bp, Human
tcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcakatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaa

SEQ ID NO: 73223 - DNA, 601 bp, Human
gaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctakccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttat

SEQ ID NO: 73224 - DNA, 601 bp, Human
cttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatktattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagttt

SEQ ID NO: 73225 - DNA, 601 bp, Human
gcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatataytcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcag

SEQ ID NO: 73226 - DNA, 601 bp, Human
atatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctg

SEQ ID NO: 73227 - DNA, 601 bp, Human
cttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaamcaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttga

SEQ ID NO: 73228 - DNA, 601 bp, Human
tttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgawtatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaa

SEQ ID NO: 73229 - DNA, 601 bp, Human
ggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttawattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaatgagaactgtaaaccctagtaagaacagaataattttttcaaaagatatataaaaacttgaaatctcctattagtaccacagctttttctatcctacttttgtaatttgagtgaactaac

SEQ ID NO: 73230 - DNA, 601 bp, Human
ctaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaaytcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcac

SEQ ID NO: 73231 - DNA, 601 bp, Human
tccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcraaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaat

SEQ ID NO: 73232 - DNA, 601 bp, Human
tagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcrtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagat

SEQ ID NO: 73233 - DNA, 601 bp, Human
ttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatataytgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaa

SEQ ID NO: 73234 - DNA, 601 bp, Human
aaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaagtatttgtctgggagaaatgagaattaactttcaagggaaataaactgagtccattagtcaggctgggttttgatcatttatatatttttagtctggaaatcaactgcsaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaacta

SEQ ID NO: 73235 - DNA, 601 bp, Human
caacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaagtatttgtctgggagaaatgagaattaactttcaagggaaataaactgagtccattagtcaggctgggttttgatcatttatatatttttagwctggaaatcaactgccaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtaca

SEQ ID NO: 73236 - DNA, 601 bp, Human
tggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaartatttgtctgggagaaatgagaattaactttcaagggaaataaactgagtccattagtcaggctgggttttgatcatttatatatttttagtctggaaatcaactgccaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattat

SEQ ID NO: 73237 - DNA, 601 bp, Human
agtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccrtaacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgt

SEQ ID NO: 73238 - DNA, 601 bp, Human
tcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaagaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataat

SEQ ID NO: 73239 - DNA, 601 bp, Human
ttcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaayaaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccagggga

SEQ ID NO: 73240 - DNA, 601 bp, Human
aaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgawcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaa

SEQ ID NO: 73241 - DNA, 601 bp, Human
tgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagargaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacatta

SEQ ID NO: 73242 - DNA, 601 bp, Human
ttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccrgtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaagaaatcagtaagtatagtcctaaagctgg

SEQ ID NO: 73243 - DNA, 601 bp, Human
gataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagatttttttttaaaaaatgcaattgactacatttggtaatagtacatggacrtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatt

SEQ ID NO: 73244 - DNA, 601 bp, Human
ttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaasagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaag

SEQ ID NO: 73245 - DNA, 601 bp, Human
tcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaaractgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaaga

SEQ ID NO: 73246 - DNA, 601 bp, Human
atattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatataktacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttag

SEQ ID NO: 73247 - DNA, 601 bp, Human
agatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacracattgatacacatatagcttttgaagaacccacttgctccctggatgtagtagaggcattgagaaaatatggaagttaaataattcaacaaaaattcatgagagtattgttttaaaaatatagtacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacac

SEQ ID NO: 73248 - DNA, 601 bp, Human
ggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttrgtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctcgcaatagaaatgtgtaaagtccattc

SEQ ID NO: 73249 - DNA, 601 bp, Human
ggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttkccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgat

SEQ ID NO: 73250 - DNA, 601 bp, Human
ggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcmcctgcttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttattttttctattaagattctaagtcctctcccaggcagaattaactctct

SEQ ID NO: 73251 - DNA, 601 bp, Human
gagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagcgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataat

SEQ ID NO: 73252 - DNA, 601 bp, Human
aataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcrcatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttc

SEQ ID NO: 73253 - DNA, 601 bp, Human
caactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgkgtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaac

SEQ ID NO: 73254 - DNA, 601 bp, Human
ttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacagatcagatgggagggatggctaggttttacaccaggactgtgtgctacatgatggtaactccagatgtgcttttccttttgagagaartaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagt

SEQ ID NO: 73255 - DNA, 601 bp, Human
tctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtyaaagtcagtttctgctgcctcctaccctgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctct

SEQ ID NO: 73256 - DNA, 601 bp, Human
accaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttyttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaa

SEQ ID NO: 73257 - DNA, 601 bp, Human
ccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttkaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatt

SEQ ID NO: 73258 - DNA, 601 bp, Human
tgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgagttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattgg

SEQ ID NO: 73259 - DNA, 601 bp, Human
ctttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattmtatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgaga

SEQ ID NO: 73260 - DNA, 601 bp, Human
aatgctataaacaatatattttttatgtttcaaatgttcatttttgtttgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatytaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactg

SEQ ID NO: 73261 - DNA, 601 bp, Human
tccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaggtaccttgtctttttctcctcagaacttcagttaataaacacgaaatacctggctgaggaacccaagyccaaacctcagtgtgcaaaataacttgtataatctaaacaaactgtagtgttcttgaagacatgatagaataactttgttaaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagaga

SEQ ID NO: 73262 - DNA, 601 bp, Human
aaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccargtaccttgtctttttctcctcagaacttcagttaataaacacgaaatacctggctgaggaacccaagtccaaacctcagtgtgcaaaataacttgtataatctaaacaaactgtagtgttcttgaagacatgatagaataactttgttaaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagt

SEQ ID NO: 73263 - DNA, 601 bp, Human
taaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttarcatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagtt

SEQ ID NO: 73264 - DNA, 601 bp, Human
atcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcstcactttaaaaagaaacaccaactagagaaattaaacatgtttccagataagattatctaaaaggataatgtggaactccagacattggaaacatacacaaaaatagttttaggtgctccatctaaatttgcaattctttagcatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacaga

SEQ ID NO: 73265 - DNA, 601 bp, Human
cttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaatygatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccattgtagtgcaatgcattattcacatgtttgtggtaatgctagtgtaaacaaacctattgcactgccagtcgtctaaaagtatagcacgtgcaactatgtgcagcccataacccttgataa

SEQ ID NO: 73266 - DNA, 601 bp, Human
acctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttrattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaatta

SEQ ID NO: 73267 - DNA, 601 bp, Human
tatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccwtgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttgattttttactcagaaaacaatggcacatgcactttgttgtgt

SEQ ID NO: 73268 - DNA, 601 bp, Human
ttcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggyattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatat

SEQ ID NO: 73269 - DNA, 601 bp, Human
tgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgawcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcac

SEQ ID NO: 73270 - DNA, 601 bp, Human
acttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggwatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttga

SEQ ID NO: 73271 - DNA, 601 bp, Human
aatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataartctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctt

SEQ ID NO: 73272 - DNA, 601 bp, Human
ttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgayaaaaatatctacatggagacatctttagtataagcagaatgtataattaataggttcacataaataaatctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatatta

SEQ ID NO: 73273 - DNA, 601 bp, Human
aacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatyttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacgga

SEQ ID NO: 73274 - DNA, 601 bp, Human
gtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatasttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataat

SEQ ID NO: 73275 - DNA, 601 bp, Human
cttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagaygtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttata

SEQ ID NO: 73276 - DNA, 601 bp, Human
gcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttytctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagatgtgtttttatttccgcttttatttttaatctca

SEQ ID NO: 73277 - DNA, 601 bp, Human
cgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatwctagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaatt

SEQ ID NO: 73278 - DNA, 601 bp, Human
tcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgattttttktttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtc

SEQ ID NO: 73279 - DNA, 601 bp, Human
attatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcraaatccctttcttgtttaattgtatgattttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccg

SEQ ID NO: 73280 - DNA, 601 bp, Human
ttccaaataacttaatatgcacatattatatagcgattcttatattcaatatagctttcaaattctgtgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacrttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggcca

SEQ ID NO: 73281 - DNA, 601 bp, Human
tttccaaataacttaatatgcacatattatatagcgattcttatattcaatatagctttcaaattctgtgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaayattttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggcc

SEQ ID NO: 73282 - DNA, 601 bp, Human
cttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctrtgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacattttgcagtcacgactcataaaaatgttttgtaaattactgtttagtatctctacctgctgaaatg

SEQ ID NO: 73283 - DNA, 601 bp, Human
agccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaacckcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgca

SEQ ID NO: 73284 - DNA, 601 bp, Human
agcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttratagaactataaacaacaacatcatggggaaaacttttcatgagatagggttaattcttttaattggggtcaaagtctgtataagcttgttgacacctctcagattatttcagtggaatctgaatgtgatcagcaaaacctcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaac

SEQ ID NO: 73285 - DNA, 601 bp, Human
taagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtrtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataat

SEQ ID NO: 73286 - DNA, 601 bp, Human
gaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagwctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcat

SEQ ID NO: 73287 - DNA, 601 bp, Human
taagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattsagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttc

SEQ ID NO: 73288 - DNA, 601 bp, Human
aggactttccgctcctccgacctggaggatcctccttgtcctcggactccaggcttccgctttcctctcccgctgggctgcagcccgcccccgcccgccctgggcacagctgcgttactcacgtccttcttcacttcagtgaggtcctcctcggtgagggacggtgcggtgggctccatggtggaggcgggagatggcgcttcttccgggtccgggagctcgggctgcgccgccccgccctggctgggggcttcggcctccgggtaatggggaagaaggagaggaggcggagcgggtcggsagaaagacggccgccccttcgggaacagagggactcgggggtcaaaccgtagcgcttccggccccgcctctgaggtcgacggcgacgcgaatctacgcgacgcgacgcggagctcggagcagcgttccttccctctcgtagaggctcaggcgcaggcaccgccccacggcgaggcgcgtcccttagcagagcccgccctgtctctgcggcagcctatcgacgccagcccgcgggccgatcctgttcccgcccccgaccggagcctttcgggtggctccgcccacagcgggcgtttcctca

SEQ ID NO: 73289 - DNA, 601 bp, Human
atctccaagaacccagttggggggaaagcatgaggagatgggtgaggagtgggcaagaatcaaaacaccacttggcaacaaagcccaagctctgcgtttagcgatgtaaaacctggattgacagatcactggaggatcactgccaccaaggtccctcggatgcagggctcgccacagtcctcctgtgctaggactttccgctcctccgacctggaggatcctccttgtcctcggactccaggcttccgctttcctctcccgctgggctgcagcccgcccccgcccgccctgggcacagctscgttactcacgtccttcttcacttcagtgaggtcctcctcggtgagggacggtgcggtgggctccatggtggaggcgggagatggcgcttcttccgggtccgggagctcgggctgcgccgccccgccctggctgggggcttcggcctccgggtaatggggaagaaggagaggaggcggagcgggtcgggagaaagacggccgccccttcgggaacagagggactcgggggtcaaaccgtagcgcttccggccccgcctctgaggtcgacggcgacgcgaatctacgcgacgcgacgcgga

SEQ ID NO: 73290 - DNA, 601 bp, Human
gtgtattcactcccccaaccccaatttaaatatgtgggcgtctgcttactaggggaattccaggttgtgctttcagctgttgagcttcctcaagcccccttatgcaaaagagcttcacatttttggtccactgcttgggatccttcacctggtacagccttcgctctaggctgagtgagcagcctaggcagcctgacttaaggatgaatctgagccgccagtccctaacgaagcatctccaagaacccagttggggggaaagcatgaggagatgggtgaggagtgggcaagaatcaaaacwccacttggcaacaaagcccaagctctgcgtttagcgatgtaaaacctggattgacagatcactggaggatcactgccaccaaggtccctcggatgcagggctcgccacagtcctcctgtgctaggactttccgctcctccgacctggaggatcctccttgtcctcggactccaggcttccgctttcctctcccgctgggctgcagcccgcccccgcccgccctgggcacagctgcgttactcacgtccttcttcacttcagtgaggtcctcctcggtgagggacggtgcggtgggctcca

SEQ ID NO: 73291 - DNA, 601 bp, Human
tacttggggggaaaaaaaccccagatactttactaaaaggctcttcatgaaaatggctctagcccaccttcctaacttcacttcagattaccctctgccttcctccgatttccccaagtcaccagggtcttgcctattttaggtccttgacaaattctattctgcccagaatgctcttccctcagttctgtcaaatctttcaggaatcagtttaaatataacctctcctgaccatcctatctcaagtcgatttcccctattattgtcttggcactgtttgattccttcatagtaattgcartaatgaaaacaaaatttatttatttgttttaaactaacgtctctgtttgaagcaggcagctacgaggtatgttttagccaacactgtatatcctgcacttactagggcaccaagtagttaatgtttcagttgaatgcaaaactcactgcacttattttgtgatttaaaacaatccccctcaagaaattgagctcttttcaagttaggattgtgttttcatttttaatttttgaactgttagaaccaaccacagtatcagcctcacagtagcatgtaatccatatttattaaactgtacta

SEQ ID NO: 73292 - DNA, 601 bp, Human
ctgttcttattcttgttctcctcagtccatgaaacaggcagagggatctttaaactatacaattcttcaacaagtccctactatacttggggggaaaaaaaccccagatactttactaaaaggctcttcatgaaaatggctctagcccaccttcctaacttcacttcagattaccctctgccttcctccgatttccccaagtcaccagggtcttgcctattttaggtccttgacaaattctattctgcccagaatgctcttccctcagttctgtcaaatctttcaggaatcagtttaaatrtaacctctcctgaccatcctatctcaagtcgatttcccctattattgtcttggcactgtttgattccttcatagtaattgcaataatgaaaacaaaatttatttatttgttttaaactaacgtctctgtttgaagcaggcagctacgaggtatgttttagccaacactgtatatcctgcacttactagggcaccaagtagttaatgtttcagttgaatgcaaaactcactgcacttattttgtgatttaaaacaatccccctcaagaaattgagctcttttcaagttaggattgtgtttt

SEQ ID NO: 73293 - DNA, 601 bp, Human
agattccaagagcctgctcactggcttccctgttcttattcttgttctcctcagtccatgaaacaggcagagggatctttaaactatacaattcttcaacaagtccctactatacttggggggaaaaaaaccccagatactttactaaaaggctcttcatgaaaatggctctagcccaccttcctaacttcacttcagattaccctctgccttcctccgatttccccaagtcaccagggtcttgcctattttaggtccttgacaaattctattctgcccagaatgctcttccctcagttcygtcaaatctttcaggaatcagtttaaatataacctctcctgaccatcctatctcaagtcgatttcccctattattgtcttggcactgtttgattccttcatagtaattgcaataatgaaaacaaaatttatttatttgttttaaactaacgtctctgtttgaagcaggcagctacgaggtatgttttagccaacactgtatatcctgcacttactagggcaccaagtagttaatgtttcagttgaatgcaaaactcactgcacttattttgtgatttaaaacaatccccctcaagaaatt

SEQ ID NO: 73294 - DNA, 601 bp, Human
acttctttcacctcatttcccaattcattcccagacatttccatcctgccccagtattcttctcgaagtcaccaatgacccccttattgccaaatattttcagtcttcatttcatttttcagctgcataaacacagttgactactccctccctgaaacaagaaaattgttacatgaataccacactctcctggttttcttcccatccctgtggatacaacttttcaatcattttcttgttgttgttgttaccctactttcaagctaacaattcactttttaaaattcttctctttaaaggrttttacaccatttttctcttctagctcacagctttctaggtaaaatcattcaattccacacttacatttctagctcagatctctcttctgatctttgactttgcagatgtaattgctgatctgacatttccatgtactaatctaattacatcctcttcctcaactcccatgttcaatccatcaccaggtcatatcatttctatttcaaaaactgcatctggaattctgctccattcatctccactgccttcaccctgatccaaatcaccatcctcattcatctctatagattccaagagc

SEQ ID NO: 73295 - DNA, 601 bp, Human
caggagaaaatggaaatctggagtattatatgaattttactaaattttttttaaggatctcactctgtcacctaggctggagtgcagtggcttgatcatagctcactgcagcctggaatccctagactcaagtgatccccatcttagcctcttgagtagctaggactacaggtgtgagccaccatgcccggctaatttttaattttttttttttttttttgtagagaagggatctttgctacattacctaggctggtcttgaactcctggccttaagtgatcctcccaccttatcctcctragttgttgggattataggtgtgggccactgtgcccagcaaattctaatattgaaattttgttaatttagaaaaaaaattaaaaacaatgttctgccctgtcttaaaggataaagttcctttacgtggcagaagagtagaaaagttaagggcatggctctaaagttggatcaacctcagtgcaaatcttgaatctagtactcacccttgtgagagctgggccaagttacttcaccactccaagcttcaggtatgttattgataaaataaggattaaaaacttaactcacaggacatcaagg

SEQ ID NO: 73296 - DNA, 601 bp, Human
atgattttctcacacaggtatacacgtaaattttctaaggcctaaaagacataaaatatggttcaatgttatttttaacatctaagaaaatcacatacgtgactattagttggcagtcttagctggtgtgagacaatgttctaaagtcaggaggctcaggccttctaaaatgcatgctaattaagatgaaagtccaagtagacacaagtaggtcctagacattcctcactgctttgatctcaccttcaaacctaaaaaccaagaccaggctgttgtgaagagggaccagctgaatctagarggcctgggtccttggaaacagggaggtctgttgagggccatcttcgggagtaaagatgagggcaaacactactgtacattttagctatcagttggcaaggaatgcagaattagtcaggaccaataacttagtgagaggtctcacagtctgtaactttctcatgtttgttattaattactccatttccttaaactgttaaagacaaaaaacaaaaccctaaactgaaagagcccataatgtatctgtctttggggtcagctggaaagactacactctaactcagtgaatcagtcttggtgg

SEQ ID NO: 73297 - DNA, 601 bp, Human
gctctgccctggactaatgccattatcacgggaatgggttagttattttgggagttcgactcctttttcttctctttcacactcttgccctcccttgctcttccatcttctgcccttccaccatgcatgacccttgccagatgctggcgccatggtcttggacttaaccagcctccagaactgtaagaaatgaatacatttcttttctttaaaagttacccagtctcaggtattgctacagcagaaaacaacttagataccatcaaagaattttatgatatccaaagggtatagttaaccrttatccagaggattgaaagaataaacacaaacacaatttacccttctgttaggcttagcaaatattcaacctacaggcacagaaaccctgagttgacaatttttaggcaaaacctgcatagtctataaagggcacttacatgtcacttcttccactagtttttcaacctcacagtacagtcagcatgtctattccatgctatacaaactactttcttagatatggctcaaaagggaaaacttgtaatgtgtcccagcaaggggacacttatagactatgagttccttaagggcagagccc

SEQ ID NO: 73298 - DNA, 601 bp, Human
aaaaaacaagcggggggggggggcgcgggggaggagaggagggagggtgggaagaagagaaaataaagggagattgaaatattgggaaaagatacgagggcaaggactggggacacagtagcccaccaggacccacatagggtgatatctacataagactccagggcaataacgtcaacagctcggtaacccctgcgacaccctgacagtcctgccgtctggaagtgcctttgtcccggcccgtcggccagtcccgccgcttctctcccatacccctaggcgctcagccctacgaggctgyccggaggccgcctaaaagccggcggcgctcgcgcccgcccctcagctcgccgggctcggcgggacatactaaccggctggtagacgccatcttcacggcgactgcggtgcccgcaacaagacacaacagacacaccgaaagcaggaagcgaatgtggcgaagagacgcgcagagatgagtttttatagacgactcacccacgcagtcgtagcagagcagggctacgggtcgggagaagggccaagaacagtgagatcccatacgtcacgtgctttgcgatttcttacgttcttactccgt

SEQ ID NO: 73299 - DNA, 601 bp, Human
gcggagcttacatttgaactcagaacatttgtactcctctgtgaggacaccagccagtttcatggcctagtgacaatacaccttcctgagggaaaaacatgcaaaaggtagaaatattatatttaggctgggcgcagtggctcatgcctgttaccacagcactttggtaggccaaagccggaggactgcttggacccaggagttcaggaccagcctgggcaatgtaactaggccttgtctccacaaaaataaaaattaataaaatttaaaaataaaaaaattagccaggcacgtggtgtgyacctatggtcccagctactcagaaggctgaggtgggaggatcacttgaactggggaggtcatggctgcagtgagccatgatcgtgccacctacacttcagcccaggcctgttccataaaataaaaaatactgcatttaactttctttgttgtcactgatagaaaaacttgagcaataactgctatgatacataaattgcacatatctagaaaaaaatttcagacttaaaaagccatgatagaattaaaaaaaaaaaaaaagccatggtagaattttaagtcgtatttgagtgatctgggg

SEQ ID NO: 73300 - DNA, 601 bp, Human
aagtggcggagcttacatttgaactcagaacatttgtactcctctgtgaggacaccagccagtttcatggcctagtgacaatacaccttcctgagggaaaaacatgcaaaaggtagaaatattatatttaggctgggcgcagtggctcatgcctgttaccacagcactttggtaggccaaagccggaggactgcttggacccaggagttcaggaccagcctgggcaatgtaactaggccttgtctccacaaaaataaaaattaataaaatttaaaaataaaaaaattagccaggcacgtgstgtgtacctatggtcccagctactcagaaggctgaggtgggaggatcacttgaactggggaggtcatggctgcagtgagccatgatcgtgccacctacacttcagcccaggcctgttccataaaataaaaaatactgcatttaactttctttgttgtcactgatagaaaaacttgagcaataactgctatgatacataaattgcacatatctagaaaaaaatttcagacttaaaaagccatgatagaattaaaaaaaaaaaaaaagccatggtagaattttaagtcgtatttgagtgatc

SEQ ID NO: 73301 - DNA, 601 bp, Human
tagtaacagatttaaatagtacactgaacccagtaagtatagaaatgagggatggtagaagttgctctgctgaacttaagacttgatgatttcctttagtccagaattgagttattgaatttatcattcaagaaattgtttcaaaagctacttgttatctgtgatattaataattagctcaatttattttgaacaacaaagcagtttgcagaagacacattcatctttttttgacacattaatcttaaatgatctgacagaatcagctgtaaaagcaacaaagatttgatcattatttcarggggtatgacctcacaatcataaattcttggtatcactgcaaataaggcccttttaaaaaccatctgaaatacaataaatggttaggttatggacatcagatacacgtaaaagacaaaatcaactgttcttatagtatgtaaatagtatttgtggtttggggtaaagtttctcatgctagcaaatacaattcagaatgttaactctcaactcagaaggtgatatctacgggaaaactgataaaataatccatattcccccctaaacttatctagtcagcttaactagaatatgtcttgaa

SEQ ID NO: 73302 - DNA, 601 bp, Human
catcttcccaaccaacatgtatcaaattaatcttctgggatgggggatggggaagacaaagattgtgaacgttttttcatacatacaactgtaacacatataagctagattttcaaagtaaacatcccagttaggttattttaaattccagctagtaactggcaagtagtttccactggaattcttattttattgtggaaggctttcaaaacataaatagaaaataattgtttcttctctcaatatgtatgccagtaagacttttagaaatgttgattagtatagtaatgactagttaccrtaataacctgcagcatttacattaccatccagtttgtgctctttgccacttatttctctagtcagagaacaatttctctctgtatttttctacttgttaactactttagtaacagatttaaatagtacactgaacccagtaagtatagaaatgagggatggtagaagttgctctgctgaacttaagacttgatgatttcctttagtccagaattgagttattgaatttatcattcaagaaattgtttcaaaagctacttgttatctgtgatattaataattagctcaatttattttgaac

SEQ ID NO: 73303 - DNA, 601 bp, Human
aatatgcatgagtgtcagcccatctctccagtcctctaccaaatatttcagactaaggacttatgaaattactggggccttttcgtttcttctggattagctcccaccccacattataaaaatatacatttggatatacaataaaatatatctctgaataagtttactcgtttctgtttcctaattgtttttttgcaataaattatttgttggggaagaaagtcaaaaatgtgttcattaaatgatagtttggaaactatgcaaaagtgaaggaccctaaacattattattattattattwtttttttgagacggagtcttgctctgttgctcgggctagagtgcagtggcacgatctcggctcactgcaacctccgcctcctgggttcaagccattctcctacctcagcctcctgggcagttgggattacaggtgcccaccactacgcccggctagtttttgtattttcagtagagatggggtttcttcatgttggtcaggctggtctcgaactcctgacctcaggtgatcctcccaccttggcctcccgaagtgctggaattacaggcgtgagccaccatgcttggcctcctgaacagt

SEQ ID NO: 73304 - DNA, 601 bp, Human
acaattactggttaaataacacaaggtagattaaagtcttctctaacaaagtactgctgatgaataatgtaataggctttttaaacaccttacgttttcaatcttggcaaatctgtcccactaagtcttctgctccacatatttttacccttatcagttataataaatcttagcagattccacctcaggttatactgaattaacacttttgcaactgctttgaagctattttctcctatagctgttccatgtagactactcactggagctagttcttctgtcaagctcagcactgactttgtttttttttttttttttgagacagagtctcactctgtcacttaggctggagtgcagtggtgcaatctcggctcactgcaaactccgcctcccaggttcaaacaattctctgcctcagcctcccgagtaagctgggattacagatgcccaccaccacgcccggctaatttttgtatttttagtagagatggagtttcaccatcttggccaggctggttttgaactcctgaactcatgatccatccgcctcagcctccgaaagtgctgggattacaggcgtaagccgctgcacctcgcccaa

SEQ ID NO: 73305 - DNA, 601 bp, Human
tgagccgagatagcaccactgcactccagactgggcaacagagtgagattccatcttaaaaaaaaaaaaaaaagtaatagtaatgggctctcttagttgctaacacagatgagagggtgacatatggctctgattatgcaagttgggccgtatctatgcttaagtttgctattaagaggaattagtgacaatgggttgtcctaattttcaagcacaaattaaacgttaattaaatataagactgtccagctgggcgcagtgcctcacacctgtaatcccagcactttgggaggtcgaggcrggtggatcacctgaggtcaggagtttgagaccagcctgggcaacatggtgaaaccccgtctctactaaaaatacaaaaaaattagccgggcggggtggcatgtgcctgtaaatccctgctactccggaggctgaagcaggagaattgcctgaacccgggaggtggaggttgtagtgagcagagattgtgccactgcactccagcctgggcgacagagcaagactcctccatctcaaaaaaataaaaaagaaaaagaaaaagaaaagaaaaatgggactgtccaaaaacaattctgaaaat

SEQ ID NO: 73306 - DNA, 601 bp, Human
agtatctcaaggatcactgatgaaatgggcagctaataccaaatcataacacttcatatgtttcaaataaaaatcttgtaattcaaataaaagagaaccaattaaacaactatcacatgttgaatagcattaactatagctacaaaaattggaaacaagttttaagagacactaaataatacatagctatttaaatactggggaaaagcattatcaaaggacagtaaatgtgtgacaatttgtattttccaaagatggcaacaatatctcccatccacatgttcttctgcaatgtgacctygtcagtatcaagtttaggtacagcctatttccccattcccttcaactcaggtgggtcctatcatggctctgacgaatacaatactgaagtgatcctgtgccagttctaggcataacccttacctacccatgtctagcttccactttctcagaacacttgctcttgaggtatttctcttagaagccaactaccacgtagtataaaatatgactactgtaagacaactatggagaagccctggaggatgacagatccatgtgcggaggtcaaggagcacggaggaaccagaaatgcaagtga

SEQ ID NO: 73307 - DNA, 601 bp, Human
caaaaataaaaaaataaaaaattggttgttttagagtcactaccagtatctcaaggatcactgatgaaatgggcagctaataccaaatcataacacttcatatgtttcaaataaaaatcttgtaattcaaataaaagagaaccaattaaacaactatcacatgttgaatagcattaactatagctacaaaaattggaaacaagttttaagagacactaaataatacatagctatttaaatactggggaaaagcattatcaaaggacagtaaatgtgtgacaatttgtattttccaaagatrgcaacaatatctcccatccacatgttcttctgcaatgtgacctcgtcagtatcaagtttaggtacagcctatttccccattcccttcaactcaggtgggtcctatcatggctctgacgaatacaatactgaagtgatcctgtgccagttctaggcataacccttacctacccatgtctagcttccactttctcagaacacttgctcttgaggtatttctcttagaagccaactaccacgtagtataaaatatgactactgtaagacaactatggagaagccctggaggatgacagatcca

SEQ ID NO: 73308 - DNA, 601 bp, Human
acaatcaaataatttagatttaaatggtacacaaaaaagtggctttaactagaaatactactactagtttcaaacaactcctcattgtgaaataatttataaagtcatgatagaccaattttatgttttaatagcaattatggcaggttactaagctaatactttactgattataaaaatcaatttatgggcaatgtacaaggtcaaattcatgaactgattatctaaatacaataatactgccacctagtgttcaacttttaaaacgacataatcatacaattggaatttgggaaaaaamccccacaaaagagtgctgttagaacaaacagtttcggccggacacagtggctcatgcctgtaatcccagcattctgggaagccgaggcacgtgtatcacttgaggtaaggagtttgagaacagcctggcctatatggcgaaaccctatctctactaaaaatacaaaaattagttgggcatggtggtggtcacctgtaatcccactactcagaaggctgaggaaggagaatcactggaacccgggaggcagaggttgcagtgagccaagataaagccactgcactcctgcctgggcgacag

SEQ ID NO: 73309 - DNA, 601 bp, Human
taaatttggccactcactcactactactgtttaggcttctatcctatggcataggtttctttttctctttacttggaatcattttctctccataaatccttactcattcttaaaaactatgcttcactcgaaattcaacagtactatcttcaggatgtcaccatactcggaagatctgtaatgtagcttttaccgcggatactgtattaagttaccctactctctttcatacactatccaaagagttgctccagggtttgcttacagcattctcatctttctatcactctcagtgaccaaycagcacagtgcttaactgagacatatggtaaaaaaaggtttttaagtcccatagacctggatttatgtggctctgtcactcagaagatgggaatcttgagctagttacctaagcactctgagtctcagtttccccttctgtaaaatggaaacaaaccagctcaaagggcagtctgctactcaagcagttaatgagtaattttttgatgtttaagagaaaaactgcacccaaattaaaagctgtaaattaggcaagaaggctgtgtctaacggcttacaagggatgccaaagaaataactt

SEQ ID NO: 73310 - DNA, 601 bp, Human
cgcctgtaatcctagcactttgggaggccaaggtgggcggatcacctgaggtcaagagtttgagacaagcctgaccaacatagtgaaacccggtctctactaaaaatacgaaattagatgggcgtggtgctgcatgcctgcaaccccaggtacttgggaggctgaggaggagaactgcttgaacctgggaggtgcagattgcagtaagccgagatcatgccattgtactccagcctgggcaacaagagtgaaactccatctcaataaaaaaaaaaaaaaaaaaaaaaaaaaaagaaagtamcctttttactggttggttgcaagtctctattaatataattttttaaatattaaaaggatgcaatccccagtgctatgcacaattcttgatttgtagccctgagctcttctgctaggaatgtaaagttttattctcttttatcttattcacctggatcttcaagtagtaccacaatgggtaccttgtcttactaacttaacagatatcttgtcttcttgcacactgtgggtgtatctcaggtttgttctctgctttactgatttagttttttagagtgttaagtctgctaattaccaccta

SEQ ID NO: 73311 - DNA, 601 bp, Human
ctcacgcctgtaatcctagcactttgggaggccaaggtgggcggatcacctgaggtcaagagtttgagacaagcctgaccaacatagtgaaacccggtctctactaaaaatacgaaattagatgggcgtggtgctgcatgcctgcaaccccaggtacttgggaggctgaggaggagaactgcttgaacctgggaggtgcagattgcagtaagccgagatcatgccattgtactccagcctgggcaacaagagtgaaactccatctcaataaaaaaaaaaaaaaaaaaaaaaaaaaaagaargtaacctttttactggttggttgcaagtctctattaatataattttttaaatattaaaaggatgcaatccccagtgctatgcacaattcttgatttgtagccctgagctcttctgctaggaatgtaaagttttattctcttttatcttattcacctggatcttcaagtagtaccacaatgggtaccttgtcttactaacttaacagatatcttgtcttcttgcacactgtgggtgtatctcaggtttgttctctgctttactgatttagttttttagagtgttaagtctgctaattacca

SEQ ID NO: 73312 - DNA, 601 bp, Human
gtggctcacgcctgtaatcctagcactttgggaggccaaggtgggcggatcacctgaggtcaagagtttgagacaagcctgaccaacatagtgaaacccggtctctactaaaaatacgaaattagatgggcgtggtgctgcatgcctgcaaccccaggtacttgggaggctgaggaggagaactgcttgaacctgggaggtgcagattgcagtaagccgagatcatgccattgtactccagcctgggcaacaagagtgaaactccatctcaataaaaaaaaaaaaaaaaaaaaaaaaaaargaaagtaacctttttactggttggttgcaagtctctattaatataattttttaaatattaaaaggatgcaatccccagtgctatgcacaattcttgatttgtagccctgagctcttctgctaggaatgtaaagttttattctcttttatcttattcacctggatcttcaagtagtaccacaatgggtaccttgtcttactaacttaacagatatcttgtcttcttgcacactgtgggtgtatctcaggtttgttctctgctttactgatttagttttttagagtgttaagtctgctaatt

SEQ ID NO: 73313 - DNA, 601 bp, Human
gagtaattgtcaaaagtcacttgcaccagtttcaagtggtttagtcactttggcacctatcttacaatctggcaattccactcttaagtacagttggcctgctgtatctgtgtattcttttttttttttgagacggagtctcgctctgtcgcccaggctagagtgcagtggctcaatctcggctcactgcaagctccgcctcctgggttcatgccattctactgcctcagcctcccgagtagctgggactacaggcgcccaccacaatgcctgactaatttttttgtactttttttagtgsagacagggtttcagcgtgttaaccaggatggtctcgatctcctgacctcgtgatccgcccacctctgcctcccaaagtgctgggattacaggcgtgagccaccgcgcccggcctgtatctgtgtattctgcatccgcggattcaaccaaccagattgaaaacatttggagaaaaaatacgcctgtactgaacatgtacagacatttttttcttgctattattccctgagcacaatataaacaactatttacacagcatttacactacgtaagtaatctaaagatgatgatttaaagtata

SEQ ID NO: 73314 - DNA, 601 bp, Human
ctaaagagtattaactgaaacatcttaccatattctgaagagaatacgaattccatctctatttttcaagaagaaaccgagagtaattgtcaaaagtcacttgcaccagtttcaagtggtttagtcactttggcacctatcttacaatctggcaattccactcttaagtacagttggcctgctgtatctgtgtattcttttttttttttgagacggagtctcgctctgtcgcccaggctagagtgcagtggctcaatctcggctcactgcaagctccgcctcctgggttcatgccattctmctgcctcagcctcccgagtagctgggactacaggcgcccaccacaatgcctgactaatttttttgtactttttttagtgcagacagggtttcagcgtgttaaccaggatggtctcgatctcctgacctcgtgatccgcccacctctgcctcccaaagtgctgggattacaggcgtgagccaccgcgcccggcctgtatctgtgtattctgcatccgcggattcaaccaaccagattgaaaacatttggagaaaaaatacgcctgtactgaacatgtacagacatttttttcttgctatta

SEQ ID NO: 73315 - DNA, 601 bp, Human
tattcactatttactgctatgaaaattagaaagatagcaaatattctgagtttctccttttttgtggggatgataagggagacgcatcagtttaaaacattaatctccagccgggtgtggtggctcaggcctgtaatcccagcactttgggaggccgaggcaggcggatcacctgaggtcaggagtttgagaccagcctgaccaagatggagaaaccccgtctctactaaaaatacaaaattagttggtcatggtggcacatgcctgtaatcccagcactttgcgaggtccaggcgggctrtcacctggttgggaatttgagatcagcctgaccaacatggagaaaccctgtctctactaaaaatacaaaatagctgggcgtggtggcacatgcctgtaatcccagctactcaggaggctaaggcaggagaactgcttgaacctgggaggtggaggctgtggtgaactgagatcgcaacaagagggtaacaagagtgaaactccatctcaaaaaaaaaacaaaacaaaacaaacaaacaaacaaaaattaatctccatagaagactttaaaagcttccaagtgctccgctaagtatttgat

SEQ ID NO: 73316 - DNA, 601 bp, Human
tatactaaatgaacatgtaattctaacaactgttcaagaacatagaaaataggaagcttaaagtgtataaatagaaatatgatacaaacacctgacaaaacaatggaaaaagaaacagtctaatttcacttagaaatatgataaaaaatattaaatactagaaaacagaatccaacagcatattaaaaggtagtatatcatgaccaactagagattgttccacaagatattagagaatcaaataatgtaaaacattatattaatagatgtaagaagaaaaatcatgatcatctccaaagaygctaaaaaggcaaatgaacaaaatcaaaattcgtctttgataaaaactcataggacgctacaaatgagtacttctttacattagaaaaccactctcctctgcccaaagaaagtactatgattaatggagaaacattaccagcattatcaccaaaatcacaagacaaaggtacctcctactgctaccattttgtaacactgattggaaaaactagccaatagtattaagcaagagaaaaaccggaagtacaaaattggaaaggatgtgataaactatttgcagatagtacctttatacacc

SEQ ID NO: 73317 - DNA, 601 bp, Human
ccagctactcaggaggctgaggcaggagtatagcttgaacctgggaggcagaggttgcagtgagtcaagattgcgccactgcactctggcctgggcgacaaagtgagaccctatctcaaacaaacaaacaaacaaacacaaaaaaacaaagctaaaaacttacctttaaatgtcctaggaaccccttcttgtctacaggcaatatagagacaagcagaagctatagcatcattagctcttcccttcaggctcttctgttcatatacttgcttgaataaattatttgttcgatccttcaaarcagagaaactaagtttaactctacgtcatttaattagctgcaatatcaaaatttcatgtgttcattaaattatgcaaagtcaatgccagaatggcttaaaggaggtagacaagaacttacaactatatttcgaggtagattgattctgtctgccatggtagtgatttctttgaatgcattcatcattgcccgatcagaactgctcattgttctccgattctggtacttagaattgccaaattcgtcaaaacttgcagctcctgtgccctataaaacagttttataactatgaaaaaattt

SEQ ID NO: 73318 - DNA, 601 bp, Human
tgatctcagctcactgcaacctccacctcctaggctcaagtgattctcctgcctcagcctcccgagtagctgggactacaggcgtgcaccaccacacctggctaacttttgtatttttagtagagatggggtttcaccatgttggccaggcctgtctagaactcctgacctcaggtgatcctcctacctcggcctcccaaagtgctgagattacaggcatgagccactgcgcctggcctaatgttcttcactctttcaatttagagtttttttgttttttgagatgaaatttcactctgtygtccagactggagtgcagtgacaccatcttggctcactgcaacctctgccccctgggttcaagcgattctcctgccacccgagtagttgggattacaggcgcctgccaccacacccggctaattttttgtatttttagtagagatggggtttcaccatcttggccaggctggtcttgaactcctgacctcgtgatctacctgcctcggcctcacaaagtgctgagattaccggtgtgagccatcgtgcctggctaaatttaggtcttaatctttcaaaatattaactgctctaaggatta

SEQ ID NO: 73319 - DNA, 601 bp, Human
atggcacaatctcagctcgctgtaacctccacctcccaggttcaagcaattctcctgcctcagcctcctgaatagctgggattacaagccccaccaccacacccagctaatttttgtatttttagtagagatggggtttcaccatgttgatcaggctggtctcgaactcctgaccttaggtgatcctcccgcctcggccttccaaagtgctgagattataggtgtgagcccccgcgcctggtcaaatgtgggtttcttgctatttacccggttcagacttaaaatggaaaaacaatcacaygctgcaaatttcagtttactgccacacttcctgatgacgaaccctacctttttgggtcctcttttcagctgatgcctgtgaggccatgtaaatagctgccgctgccacagagatggggctcctcccaggaaccaagtccaattccacagctttacgggctatatgtgtagctgccatctgtacttgtttaggaagacaaaggttggaacagaacctggacatgaagtccccagttgtaatcaaatccacactggtttctagcgctttcaaaataagtttaaaacaccgaccaatttcttt

SEQ ID NO: 73320 - DNA, 601 bp, Human
gagtcttgctctgttgcccaggctggagtgcaatggcacaatctcagctcgctgtaacctccacctcccaggttcaagcaattctcctgcctcagcctcctgaatagctgggattacaagccccaccaccacacccagctaatttttgtatttttagtagagatggggtttcaccatgttgatcaggctggtctcgaactcctgaccttaggtgatcctcccgcctcggccttccaaagtgctgagattataggtgtgagcccccgcgcctggtcaaatgtgggtttcttgctatttaccyggttcagacttaaaatggaaaaacaatcacatgctgcaaatttcagtttactgccacacttcctgatgacgaaccctacctttttgggtcctcttttcagctgatgcctgtgaggccatgtaaatagctgccgctgccacagagatggggctcctcccaggaaccaagtccaattccacagctttacgggctatatgtgtagctgccatctgtacttgtttaggaagacaaaggttggaacagaacctggacatgaagtccccagttgtaatcaaatccacactggtttctagcgctttc

SEQ ID NO: 73321 - DNA, 601 bp, Human
gaggaatgatgtcttaaacgtgggttttttttttttttttgagatggagtcttgctctgttgcccaggctggagtgcaatggcacaatctcagctcgctgtaacctccacctcccaggttcaagcaattctcctgcctcagcctcctgaatagctgggattacaagccccaccaccacacccagctaatttttgtatttttagtagagatggggtttcaccatgttgatcaggctggtctcgaactcctgaccttaggtgatcctcccgcctcggccttccaaagtgctgagattataggygtgagcccccgcgcctggtcaaatgtgggtttcttgctatttacccggttcagacttaaaatggaaaaacaatcacatgctgcaaatttcagtttactgccacacttcctgatgacgaaccctacctttttgggtcctcttttcagctgatgcctgtgaggccatgtaaatagctgccgctgccacagagatggggctcctcccaggaaccaagtccaattccacagctttacgggctatatgtgtagctgccatctgtacttgtttaggaagacaaaggttggaacagaacctggacat

SEQ ID NO: 73322 - DNA, 601 bp, Human
ttttgagctcaaacgaacattgtacagaatcctaacagatccacttttaccctttaaagtcgctgtcccttttttcctttcaaagtcattaaaagaaatactaaaggactgccactacaatgtttggttaagtattatgaatgctttattaaaatggatttttaagcatcatttatttatttatttagagatggaatcttgctctgtcacccaggctggagtgcaatggcaagatctcggctcactacaacctctgcctccccggttcaagcaattctcctgcctcagcctcctgagtagmtgaggcacctgccaccatgcccagctaatttttgtatttttagcagaggcagggtttcaccatgctgcccaggctggtctcaaactcctcacctaaggtgatccacctgcctcagcctcccaaaatgctgggattacagtcatgagccaccacgcctggcctaaacaccttttaatacaaattcattttactaccttttcagttgattcaaatcagtgaggttttagtgattttcactgtgaatgcctgccatcattgtacaattagctaattttaaatttccgtatctcacactgcatt

SEQ ID NO: 73323 - DNA, 601 bp, Human
agcagggagaggccggtcacacttagatcatgtccatctggagtgggccctgatggttgtggactgtttatccctgagtgaggaaagatacagagtcatagagaacccagagttggagatgttcaagaaggcatcgtagaaggccaggaagggtagcagatatgctaggaagttctctcggaggtctgaagtaaggaagccggcaatgctgaaagacagctcctggtccaggaggtggaggaggaggagttgaagggttggcagttgatgttcaatgggagaagttggcagatatggaaastgtgttcaagcgagaccatacttggaacctagaatcagtagataaattatgtgctttggatcatcgctctcgtaatgtgttagttaatcaaagttacaatcccaaatcatagcactctgagaaagcgtgttctataatgaacactttacatttttctaaacttaaatggttaggtactgtcattctgattttatggaagtgaaaaccgagtgatagattaaaatcacttggcatttgagattagaaggtaggaacagcacctcagtcctaaccaaatgtcttgttgatcacattttactg

SEQ ID NO: 73324 - DNA, 601 bp, Human
agggtagcagatatgctaggaagttctctcggaggtctgaagtaaggaagccggcaatgctgaaagacagctcctggtccaggaggtggaggaggaggagttgaagggttggcagttgatgttcaatgggagaagttggcagatatggaaagtgtgttcaagcgagaccatacttggaacctagaatcagtagataaattatgtgctttggatcatcgctctcgtaatgtgttagttaatcaaagttacaatcccaaatcatagcactctgagaaagcgtgttctataatgaacactttamatttttctaaacttaaatggttaggtactgtcattctgattttatggaagtgaaaaccgagtgatagattaaaatcacttggcatttgagattagaaggtaggaacagcacctcagtcctaaccaaatgtcttgttgatcacattttactggtctcttttggcaacttctcagctcaaagagaaatagaaaagggaagtggcttttgttgactatcactacgtaccaaaggaaaaaacttccttttttcttgcagtatgttgggaggtcatggcataactgctgtgcaactgcatcgcaa

SEQ ID NO: 73325 - DNA, 601 bp, Human
cttttgttgactatcactacgtaccaaaggaaaaaacttccttttttcttgcagtatgttgggaggtcatggcataactgctgtgcaactgcatcgcaacagtactgcaagccagagctttctggatggatcagaaattgtattcatggcttctttgggaagagttattaccttaagtttcacaagagcagcttttgtgtgggttagatgctcttgctgtttcagcctcgtcttggtcaggctgcagtgagggttacactggggctggcccgactgatcttcgaataggatgatgagttgwttctttccatcttaaaggctttacttcagccttcaggaagtcgttagtaaaatcttagtttgtctcaatctctctctagttcagtacaatggaaaagtttcttgagaatcagaccagactgctggggaatgaacaggaagaaggaaacaggaacagaagcataaagacaccaaagactaactttacttatttcagaattggcccgaaggtagccctaaatccagaagtttcttctgtgccatggtagagtgagggtaggccctggggaagaggacttagtactggtacttatcatgacca

SEQ ID NO: 73326 - DNA, 601 bp, Human
acctgtctctttatagtagtcttccagctttgtctgcatttactaagttcatgaattgctgctattttgttgcctttttagcttttggggaaaaaatccttcccaaactactatagtttaatgggaactgcatcctagtcaagtaaagaaataacgcaaacatcagggagggggaggagcagaggaaacaaggccttactcagaattgctatcaattttaatacctccctactaaacattctgtgtaggggatgccttagtaatctgaattttttagaaaggggtgttttttagagagggwtatttatgaaagctagtattaacatgtttaaagtctgcccccccgccccaaatgctaaacgttcccagtgatgcaccagacaccaagtgttacggaacaggtaatccaccacttttcacagaaagctttttagctcctaactaggccactgtacctgatattgggaaacgtttttgaaggatatcaaggagatggaggagttccaagggagagcagcatgaatcgcaaaggtccgggaaggtgagcccacatggaaaggtctaggaggttaacttaaaagacctcagagcattgagtcat

SEQ ID NO: 73327 - DNA, 601 bp, Human
cattatcttgttaaaatgtgtcctcacaataatcctgtgagattatactacttatggtgcccattttacagagaagaaaactgaaacttagcaaagtaacacatctaagtatgtggcagcatggaatgaatgaatgaatgagtttatttatttatttatttaaagaccaagtcttgctttgttgcccaggctggagtgcaatgacgcgatctcggctcactgcaagttctgcctcccaggttcaagcgattctcctgcctcagcttccctaataactgggactacaggtggctgccagtawgccctgctaatttttgtgtttttagtagaggtggggttttgccatgttggccaggctggtctcaaactcctgacctcaagtgatcagcccgccttggcctcccaaagtgctgggattacaggggtaagccaacattcctggcccagacatggaatttaaacctaaatattttgttggtagcatccccacttttaaccatgacattgtccttgttcggttccagggtttctgtagcgtggagctgggcacatctctctgcctgctgtgcttgtcaaactgacgttacctctctcatttcgg

SEQ ID NO: 73328 - DNA, 601 bp, Human
acataattgatatgcggcaaacttcacgtacttaaagtataaaatttgatacatcttaacatatgtatacacctgtgaaaccatcacaacaatcaaaataacaaacacatctctcacccctgaaagcttcctcatgcaccttggcagtcccttctgtcctggctgccccatgcctcaattactgacctactttctgttgtatgtggttaccatttcctagaatgttacataactgcagccatacagcatgtgctttcttggatctggcttcctttgctcagcctgattcatccccgtcacwcattgattccttttgattgctgagtaacgtttcatagaatggaggtaccacagctcatcacctctcctcttgatgagcctttgggttgttgtcatttgctgaatattttaaacaaaaagctgctgggaacatccatgtacaagtatttgtaaagacaagtgcttttgtcgctcagctagacaccttaagagtggaatggctgtatcatatagtaggtttatatcgaacttcttaagaaaccgcctgtttgctaaagggattgtaccattttacattcctaccagcaatacctgagagttt

SEQ ID NO: 73329 - DNA, 601 bp, Human
gaatggatattagattttttttaatgtttttttctgagtctgttgagatgatcatatcgggttttttgtctgtttgtaaatatgacaaatcacattgtttttgtgtgttttttttaagacaggatcttgctctgttgcccatgctacagtgaactgacgcagtcacagctcactgcagcctcgaactcctgggctcaagtgatcctcttgtcttagcctcccaaagtgctggaattacaggtgcacgtcaccacacccagctatattgactgatttggatattgagccaaccttgaattgytgggataagtcttacttggtcatgatgatccccccgctgcacccactgcccccaagatggagtttcactcttgtcacccaggctagagttcaatggcacgatctcggctccccgcaacctccgcctcctggattcaagtgattctcctgcctcagcctctagagtagctgggattacagccacgcgccaacatgcttggctaattttgtatttttagtagagagggggtttctccatgttggtcaagctggtctcgaactcctgacctcaggtgatgcgcccgcctcagcctcccaaagt

SEQ ID NO: 73330 - DNA, 601 bp, Human
tgagccaaccttgaattgctgggataagtcttacttggtcatgatgatccccccgctgcacccactgcccccaagatggagtttcactcttgtcacccaggctagagttcaatggcacgatctcggctccccgcaacctccgcctcctggattcaagtgattctcctgcctcagcctctagagtagctgggattacagccacgcgccaacatgcttggctaattttgtatttttagtagagagggggtttctccatgttggtcaagctggtctcgaactcctgacctcaggtgatgcgccygcctcagcctcccaaagtactgggattacaagcatgagccaccacgcctggctggtcataatgattttattggattccatttgctcaaattttgtttagaatttttacatctgtgttcgggaagaatatttttctgtagtttgtttataacttctttggctggttttggtataatggcaatcctgatctcatagaatgaattgggaagtgttctctcctcttcagtttcctggaaaattgtgtataaagttgtattatttctttagttgtttggtagaattcatcacataagttacccag

SEQ ID NO: 73331 - DNA, 601 bp, Human
gatccccccgctgcacccactgcccccaagatggagtttcactcttgtcacccaggctagagttcaatggcacgatctcggctccccgcaacctccgcctcctggattcaagtgattctcctgcctcagcctctagagtagctgggattacagccacgcgccaacatgcttggctaattttgtatttttagtagagagggggtttctccatgttggtcaagctggtctcgaactcctgacctcaggtgatgcgcccgcctcagcctcccaaagtactgggattacaagcatgagccaccaygcctggctggtcataatgattttattggattccatttgctcaaattttgtttagaatttttacatctgtgttcgggaagaatatttttctgtagtttgtttataacttctttggctggttttggtataatggcaatcctgatctcatagaatgaattgggaagtgttctctcctcttcagtttcctggaaaattgtgtataaagttgtattatttctttagttgtttggtagaattcatcacataagttacccagacttcaagttaactatgtaagaaggtttttaactacaaattgaat

SEQ ID NO: 73332 - DNA, 601 bp, Human
ttctttgacctgtgggttattcagaatgtgtcatttagtttctaaatacagattgcgcatccctaatccaaaaatccaaactttgaaatgctctaaaacctgaaatttttttcagtactgacatgatgttcaaaggaaatgttcattggagcattttggatcaggaaagggatgctcaaccagtaagtataatgcaaatattcaaaaatctgaaagcaaaaatccaatacatttacgggcccaggcattttggataaaggatctcaacctgtatttgagaggggtatgggagttttttctrttactgatctctaattaaatgtccttttggtcaagaaatataccttgtatggcttaagaactcttaaattcattgagacttgtttgatgccccataatatgacttatcttggtaaacagtccatgtgcatctcaaaagaacaggtatcctgttgttcttggactgagtgttctacaaaagtgagtttgattgagttgtgttctgcaaatcttcagtatctttactgattttctggatattaatacttgttctatcagttattgagaaaggctattgaaatctcgtgtatttgtgtatttc

SEQ ID NO: 73333 - DNA, 601 bp, Human
cattttggatcaggaaagggatgctcaaccagtaagtataatgcaaatattcaaaaatctgaaagcaaaaatccaatacatttacgggcccaggcattttggataaaggatctcaacctgtatttgagaggggtatgggagttttttctgttactgatctctaattaaatgtccttttggtcaagaaatataccttgtatggcttaagaactcttaaattcattgagacttgtttgatgccccataatatgacttatcttggtaaacagtccatgtgcatctcaaaagaacaggtatcctrttgttcttggactgagtgttctacaaaagtgagtttgattgagttgtgttctgcaaatcttcagtatctttactgattttctggatattaatacttgttctatcagttattgagaaaggctattgaaatctcgtgtatttgtgtatttctcctttgagttctatttttgccttatgtattttgaagttctgtttttttgatgaatagatatttagaatttttgtgttctctttgtgaattgactccttggtggttttgaaatgacctttatttctgggattatcctttgatttgaaatta

SEQ ID NO: 73334 - DNA, 601 bp, Human
tggtaaggacaggcactattccaagcctttcatctttttggagggctctttgtctggtagtttcttcactcatgtgcattgatcatcactggatactcaagagggacctctgcagatctctttgactcctgttaaataatatatatttttacattctctctcttcacatatatgtatctttctatttaaagtgcatttattgtacacagcaggtagttggatcttaattttttttgaatccactccgacaagctctaccttttaattggagtgtttagataattaacatataatgtaatcrttgataaaatttggtttaggtctctaatctcactgagggtttttttcccctcacctgttcttcccttttgcctcttcttactactctctctctgcagctcattcctctttgctactctttacggtgaattctaatggccctcgcactctcagctcagggagtatactgggtcctgcctggtgtccagctccctgtgctgtggcctggaaactctttcaggccatgagctgttttcaggcaagaggactgtccatctaggccagaggcagaagtctgcaactcttaattatatttcctgtc

SEQ ID NO: 73335 - DNA, 601 bp, Human
atttttaacacatttgcaagttgtaaattatcttctttctgcaaactcctgtaaagatttatgtgcacctctttgattcaagccttcactttctaccttgtgttaacttatttatgcacatgtcttatctcctccaaccacttataaatcccttgaggacaggattcacgtctcatttacatgctcttagaaatttacagtgcgtacacagtaggcaatccatacatgcccattcagtacacatttactggcagtcttgggaatgaacatcaaattaggtattgatgaaattttggcccgatgataaagaatatcttaggctaaaagtaatgggaaaattaaattgtttgcaggatgtttcagcactactccctacttagctagatttatctcctctttcttctctgtgtgtcagtttgcaaacaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttcttttaaaaaaaaaa

SEQ ID NO: 73336 - DNA, 601 bp, Human
ttttggcccgatgataaagaatatcttaggctaaaagtaatgggaaaattaaattgtttgcaggatgtttcagcactactccctacttagctagatttatctcctctttcttctctgtgtgtcagtttgcaaacaagaactgcccttttctctttgaaaaaaaatgaacactaaaggcagagattttcatttggctgtctttgtattcccacaaccaagcatggtacgtggttcaagaaatggctgtttaatcacagcagtaactcccagtaggaaagattctcaaaggaattgttctttwaaaaaaaaaaaaattcacaaagtaggctgtaccctcaaagtgctaaggagagcttctgtcctcgaaaatctccctgaaatactgaaagcatacaaaaaaggagaaagctcaaaactaaattttgactctcagtggctgggttttgtatctcttttctttaaaaaaaaaaaaaaaaaaaaaaaaaaagccattgaaatgattccacttctgagttacctggagcagtcaaattcagaaagacagaaaataggttggtggttggccaggggctggagcaggagggaacagggagtaagagtg

SEQ ID NO: 73337 - DNA, 601 bp, Human
atgacaataacaagccagccttgctattttggaaagcagtgagggacgtggagatccgatctggacagtattcatctcctgtgtgacctgggtgagttgcccaccctcacagagttcttttcaccgagttcacatgggactcaaatgggatgccatggttttaacccctggcgtgcgttagaatcacctagaggaattgaaacagagaaataccagtgtcccaaccccaccctcaggaatttggatttaattcccctgctgggtcccaggtggcacctgaaggtattgaggtgattctaaygtgcagccgaggttgagaaggaccaagctggacgttgcgagagtgctctggtaaatttcgtttggtgttactctcattacattctccactgactttggcagtgtctgtgaattttcacatttttcatgtaaagatcttcatgactttttttcttaacattgtttccaacaactactgcaggtcatttagcaagaattagtcatggtagttcacagccctgaacccaaacacccccagatcttcagcctcgcgtggggcttccagtgacttcgtggaatgtcatcatagtccttcctttgg

SEQ ID NO: 73338 - DNA, 601 bp, Human
acaagccagccttgctattttggaaagcagtgagggacgtggagatccgatctggacagtattcatctcctgtgtgacctgggtgagttgcccaccctcacagagttcttttcaccgagttcacatgggactcaaatgggatgccatggttttaacccctggcgtgcgttagaatcacctagaggaattgaaacagagaaataccagtgtcccaaccccaccctcaggaatttggatttaattcccctgctgggtcccaggtggcacctgaaggtattgaggtgattctaatgtgcagccraggttgagaaggaccaagctggacgttgcgagagtgctctggtaaatttcgtttggtgttactctcattacattctccactgactttggcagtgtctgtgaattttcacatttttcatgtaaagatcttcatgactttttttcttaacattgtttccaacaactactgcaggtcatttagcaagaattagtcatggtagttcacagccctgaacccaaacacccccagatcttcagcctcgcgtggggcttccagtgacttcgtggaatgtcatcatagtccttcctttggagagctgga

SEQ ID NO: 73339 - DNA, 601 bp, Human
caagctggacgttgcgagagtgctctggtaaatttcgtttggtgttactctcattacattctccactgactttggcagtgtctgtgaattttcacatttttcatgtaaagatcttcatgactttttttcttaacattgtttccaacaactactgcaggtcatttagcaagaattagtcatggtagttcacagccctgaacccaaacacccccagatcttcagcctcgcgtggggcttccagtgacttcgtggaatgtcatcatagtccttcctttggagagctggattttctcaggcaccrtgaggatctgggccaagcttctccagggctgtcattgcttcctggttggaaaacccctaggtgccaaatgcaagaggagaaagagtgaaattaaccagctcacccatcaatagcagtctcaaaatcatagaactgggagcctgtaagaaatcacacatttctgtgaatgtgtagagaataactccaaagtttcaccgtgacaagtgcagaaattacatttaaatgagtacagaagaaaatttcgccacaaactgtgttagccaaagaaggttctgtacaatgagacgtaactgaattatg

SEQ ID NO: 73340 - DNA, 601 bp, Human
atctcgatctcttgacctcgtgatccacctgcctcggcttcccaaagtgctgggattacaggtgtgagccaccacacccagcctatttttactttttaaattgagttttcattttgaaatgaaaaatgagaaaattcaaaatttttaaatgaaaacattggtctttgcccagtaacgaacatgtgtacacctttgcattcatacagtcccctagaaccagtaagtcctttccctgcaaagctgtcctgaacattcagggtccacacattgaccactgaagggtaggaggaaaggcaaagcragctgcacaaagggaagatggcccgtagccttgaaatgcactcttgctagccctccccattttggttattatcagcaaagatcagtgacatgttaatatattcggctattttactgtgaatataatggtaaattttaatagaaattgagttagatagcagtttctgaatctgaaagaaagtgacattgcttgcgaatgctcacagtagcacttaacattgtgaagttcaactcaatttttatttgctgtttcacagaaagcaataatccctcatattttatagtaccatctgggttacaa

SEQ ID NO: 73341 - DNA, 601 bp, Human
gcttgcgaatgctcacagtagcacttaacattgtgaagttcaactcaatttttatttgctgtttcacagaaagcaataatccctcatattttatagtaccatctgggttacaaaaatcccgatgcgtctttgttggacaagccaggatctcaggaaggagtggaggggagcttcatctcagtggcttctgccctgaatttgaatttttaacaggcagcttttaagcatcctgtggcactcatcccatctcagtgtagcagagacagtaatgtctttccctctatggttgagaaggagcttytgaatgcccttttggaagctgtagaaatctatgatactcatcgtcagcattcgaccatgaacttaaactcctatcacacctctaggtgtgataatatttctccttctgttacaacagagtaatgtcacacttggcacttttactgtcctcttgcgagactatcctccaagtgctgtctgagagtgttaactgctatttggctcatttttctgcaccaaggagaacagaaacacagcaggcaccaagaggaggtttagtgtgcagtgggttgttctgaaaggcagtgagtaaaatgaggta

SEQ ID NO: 73342 - DNA, 601 bp, Human
ctgagagtgttaactgctatttggctcatttttctgcaccaaggagaacagaaacacagcaggcaccaagaggaggtttagtgtgcagtgggttgttctgaaaggcagtgagtaaaatgaggtattccctgacttctgcttttgctacatgaagtcatgaggtccttgaagccagacttaggtaccgtttctttcatcccttgctagttcctaatcgtagacacaaaccttccacatccatccaggcggatggcagtgcttcttgtagaaagcaatgtcactaaggcagtgtcactaaggraaacaggacaaggcaacagttgtgttcagagttttgactggcgtctgattggaattagaaggaagattattttgccataacctaggtaccgtgacccaagctcttttggcagaccttgacgtcacaaaccgtacgcttgctggagaagggaaaaggagagttgcagccactaagagagtcaaggctgtggcctgcctggtggtgttttataggaactggctcagggaggctgcatgtcctttgttttctgaggccttgttccacgtggcctcccacttgaggccaggaatattgcagcaa

SEQ ID NO: 73343 - DNA, 601 bp, Human
acgtcacaaaccgtacgcttgctggagaagggaaaaggagagttgcagccactaagagagtcaaggctgtggcctgcctggtggtgttttataggaactggctcagggaggctgcatgtcctttgttttctgaggccttgttccacgtggcctcccacttgaggccaggaatattgcagcaatgccgaagagtgggtggacaaatagccttattattaacctaagttggaaacatggctttttgagtgtcttcattcacagatgcagtcacaaaatattaatactctttttttgaacatgrcaaaacaaagtattcatttaaacctcctttgtccacgtccatggtaaaagagcacctcaggcaggggagaaaaaaaaaaaaaactggtcccttgagaattactttatcctttgcatttgcatatagtttgaattcataattaggctatttttattggctagcagctgtattatcatataaatccctgaatatgtaatttggagtcatttagaccagtcgtcccacagtaaccctgggaagcacgtgagcagcgtcagcgtctttctcgaggaagaaaatgaagatggggagtaacttgct

SEQ ID NO: 73344 - DNA, 601 bp, Human
cacaaaatattaatactctttttttgaacatgacaaaacaaagtattcatttaaacctcctttgtccacgtccatggtaaaagagcacctcaggcaggggagaaaaaaaaaaaaaactggtcccttgagaattactttatcctttgcatttgcatatagtttgaattcataattaggctatttttattggctagcagctgtattatcatataaatccctgaatatgtaatttggagtcatttagaccagtcgtcccacagtaaccctgggaagcacgtgagcagcgtcagcgtctttctcraggaagaaaatgaagatggggagtaacttgctgcaggcagcttagctcctgctgtggtggattgggtttttacgctaaagaacatagatacctgttcagtaataacttacattggcatagaattcatctattaacaggatgttttgaggccagacgtggtgactcacacctgtaatcccagcactttgggagaccaaggctggaggatcacttaagcccaggagttggcaagaccagcctgggcaatacagcgagacccccagctctgcaaaaaaaataacaaaattagccaggcatgat

SEQ ID NO: 73345 - DNA, 601 bp, Human
ttctgctgagaatcctgtgttgtaaggaatggtggtggactcggtggtgaaacgttaactcctggcacccatgcttaactctcttcagtcttaaaatttggcctcactgcatagacaagatcatgactgtaccatgtaacactaagacatctgttcctacctgaatttttcttggagtagcagattgtttcattgagttgaccaagtttacgactcattttgacagatggtgattctatggtttatatcaactacttggaatttatcatctaatgacagctgtttaacacataggtcagcrtataagattgactagtaatgaaatcttcggggcatttttttcacctcctgtcataatgttgaatctttgggaaacctaccaccttggaaatgaaaagcttataaatatattgggtgaacagcagttgaattatttatgtgacaaaaaattctttgtcatcccaaaaagaaaggatggaaaagttgtccccgatggtttcggaagctgcagtgagatggacacagtatgtggagtatctgtggggtgagcttttcgtagcaaatttggatcctagactgccctctctgagctacccagtag

SEQ ID NO: 73346 - DNA, 601 bp, Human
gaattatttatgtgacaaaaaattctttgtcatcccaaaaagaaaggatggaaaagttgtccccgatggtttcggaagctgcagtgagatggacacagtatgtggagtatctgtggggtgagcttttcgtagcaaatttggatcctagactgccctctctgagctacccagtagtcagtcaaatgggtcaagtccttttccacagtttggaatgtgctcagggaatcaaaccgactttaatattagcctgtgacagttatattcagggagctaagacttgctctcactaacatcgaaagcrttccagcacatgttggaaaggtgtttggggtagccactgtttagacttgccttagctattgatcttcttgttatcgaatataatttagaactaacagtgagacccttagtggtgggagaatattattatcatttgttatctgcacaattaggaagcaggagagtacagcagaggctttatcctataaaccatctcgttgcctagagcattttagctccttgcagagtggtctaccacatgcctgccttcccacccccatcctcatctctctctctctctctctctctctctctctctctc

SEQ ID NO: 73347 - DNA, 601 bp, Human
agaagaggaggggcgcagagggtttgcccacatcagccccgttttcttcttttgtcccagaatcatcgttaacattatcccctccgctttcaaaagggtcctcacttggagaatgaattatttgatcaccctggatatcaagaaacccttcatactgcccctaaaattgtacagtggaaggaagaaaagaagctaacctcttttcggtattttctttgtgccagattctgggcttggcactgtgtatacattattttactaaatggatcaaacagaatctatttcacctagccattaaacmgcatctctcttaggctagaagtaactataccagagtcatttcacaggaaatgggttgagagtgttgcgtggaccatttttacccctaggaacctgaatcagaaaggctcatggaactccaagttgaaaagaaaaccatattgctataggggaagggggtgtgaaaatgctccggtgagagtcaaccccctgagtatacagtaggaacctccggtgcctggcaccacgccatgccttgtcgggggccggtggggggacccaggaagcgtaagaggtagcagccacccgcagagagctgcat

SEQ ID NO: 73348 - DNA, 601 bp, Human
ttaacattatcccctccgctttcaaaagggtcctcacttggagaatgaattatttgatcaccctggatatcaagaaacccttcatactgcccctaaaattgtacagtggaaggaagaaaagaagctaacctcttttcggtattttctttgtgccagattctgggcttggcactgtgtatacattattttactaaatggatcaaacagaatctatttcacctagccattaaacagcatctctcttaggctagaagtaactataccagagtcatttcacaggaaatgggttgagagtgttgcrtggaccatttttacccctaggaacctgaatcagaaaggctcatggaactccaagttgaaaagaaaaccatattgctataggggaagggggtgtgaaaatgctccggtgagagtcaaccccctgagtatacagtaggaacctccggtgcctggcaccacgccatgccttgtcgggggccggtggggggacccaggaagcgtaagaggtagcagccacccgcagagagctgcattccttaggagaacaggagcacggcagcggaaccacagtcagacggcagtgatctcctgcgcttgatcc

SEQ ID NO: 73349 - DNA, 601 bp, Human
ggagtactgcttcccgactcccaacgtttgctacttgtaaaattttgtgattccacaggaaaggcaaaggcatggaagtcatgagaaggcaacgctaccttaacttcttctcattttattttttatagtgttcagtttaaaggcgtaaaaggctggaggagcagtacaacacagatatgtctgatcttcttggaggttctccctttagctaacttttgctgtgatgggtacttttttcatgcccctggttcctgtatctctcagttgatgtcattatagccatctgcgttcagcatcaaayacaggggagccacgataataaaattacaggcaggaatacgtgagagagctgagaggcaaggggactgggctttagacggagcttgtgaaatcggtggcctcatttgttcacttgtatctagcactcctagaaagcaagcactgcgtggaggtccagccacaggaattcacaccaacgggcccagagtcggtcatagtgccctgatgtgaccatttcctagcagtgccagttcttcttggtggttggattttgggctaaaaaaagggctacatgggtgaccctccaggatctcatatcatg

SEQ ID NO: 73350 - DNA, 601 bp, Human
ctgtatctctcagttgatgtcattatagccatctgcgttcagcatcaaatacaggggagccacgataataaaattacaggcaggaatacgtgagagagctgagaggcaaggggactgggctttagacggagcttgtgaaatcggtggcctcatttgttcacttgtatctagcactcctagaaagcaagcactgcgtggaggtccagccacaggaattcacaccaacgggcccagagtcggtcatagtgccctgatgtgaccatttcctagcagtgccagttcttcttggtggttggatttkgggctaaaaaaagggctacatgggtgaccctccaggatctcatatcatgtcctgaggcctccttgtactttctaagaatgtcattttgtcattgccttttgcctcaagatgctaggggtataaatcaccttctaccacggaaaaaggactactcttttttttttttttttaaggttaatgctaagttttcttgaaaattttaattcaggggatttttgatgggtttttttttaacctttaactgccttgtagaaagtgaaagtagggggtcctggcagggccaaagccagtgactgagag

SEQ ID NO: 73351 - DNA, 601 bp, Human
ggaaggggcaggagaaccacttgagccaaggagttcaaggctgcagtgagctgtgatcacaccactgcattccagccaggacaacagagtgacatcctgtctcaaaaataaataaattttttaatgatgaaactaactaaggtactgaggaggtaagatatttccccacggtaagtcattcagaaactaaatgtgaaaaaccaaaagaagcctctggggttagtattcccagtctccttgtctgcccaggaccccacatttgtgtaagttgctaattgcacaagggtatcctactgaggcygtgaatagagtagaaatccaggctgggatgggcttatcaagccatggactgtggcaaggagctacgcccacctggagatgggatcccctcttggaatcggcacaaaggctccaggcttccctgccaaacgcggcgcctgtggagctgtgctggggctcagctcttgggtcggacagatgaacggtaaggcacattagcagtgttacctacggtatcctcctgcgtgtcacactggaactagagcttctcttggcatgatgttaaagaatacctgtttagatgagtgtacacttttaactg

SEQ ID NO: 73352 - DNA, 601 bp, Human
attgctgaacaaatagccaatatctttatctacaagttgaagaaggtgcaagccctcctccaggatgcagaaggaatagtctaggatttccataccgttttctttggtggaggaggttggctggaaaaaggatatatgctggcctgcgcggaagggccggggactcccacaggctctttggaaaggaggaatcaaaatgttgccagtttgtatgccacagccatatatgtaatgcatgggccagagtccactaacatctgtttgggcatgtacccatctgtattgtagcttaatttctaarccagttaaaatacagtcttccatattggcaaatgagtattgagggtcatatgtacagaactttacatcatgtaatgtggtggagataaagaagaatgcactatcccagcttttaagaagcttataatccagttgtctgaagctttgagtttagaaagtctttcaaaaacctgacgttctggagatacactttaagaaaattataattaatgtaagcttgtgctgttgttattgtgattaaatgcttctcttcacgtaggtgctataacacaggtcccattcacatctcacccattcctcc

SEQ ID NO: 73353 - DNA, 601 bp, Human
tctttatctacaagttgaagaaggtgcaagccctcctccaggatgcagaaggaatagtctaggatttccataccgttttctttggtggaggaggttggctggaaaaaggatatatgctggcctgcgcggaagggccggggactcccacaggctctttggaaaggaggaatcaaaatgttgccagtttgtatgccacagccatatatgtaatgcatgggccagagtccactaacatctgtttgggcatgtacccatctgtattgtagcttaatttctaagccagttaaaatacagtcttccrtattggcaaatgagtattgagggtcatatgtacagaactttacatcatgtaatgtggtggagataaagaagaatgcactatcccagcttttaagaagcttataatccagttgtctgaagctttgagtttagaaagtctttcaaaaacctgacgttctggagatacactttaagaaaattataattaatgtaagcttgtgctgttgttattgtgattaaatgcttctcttcacgtaggtgctataacacaggtcccattcacatctcacccattcctccaccacctcccaccctcattctt

SEQ ID NO: 73354 - DNA, 601 bp, Human
tgctggcctgcgcggaagggccggggactcccacaggctctttggaaaggaggaatcaaaatgttgccagtttgtatgccacagccatatatgtaatgcatgggccagagtccactaacatctgtttgggcatgtacccatctgtattgtagcttaatttctaagccagttaaaatacagtcttccatattggcaaatgagtattgagggtcatatgtacagaactttacatcatgtaatgtggtggagataaagaagaatgcactatcccagcttttaagaagcttataatccagttgtytgaagctttgagtttagaaagtctttcaaaaacctgacgttctggagatacactttaagaaaattataattaatgtaagcttgtgctgttgttattgtgattaaatgcttctcttcacgtaggtgctataacacaggtcccattcacatctcacccattcctccaccacctcccaccctcattcttgaatagctgtattccagagaggtgaggcacagagtcaggaattgatctccaacgtgggtaaagctaataaatatgatttaggatgaaaaggtactgtgtaaatgcttgagatgt

SEQ ID NO: 73355 - DNA, 601 bp, Human
accactttgtatttcttcttttaaaaacaaatgctttctagtaatgagcatgccgaatcccttctaggtgtgttttttaaaattacttgagacagtgaactgttgttaatttagcatttaaggtatagtgtagtttgatgccaagtcacatcatattttaagtgaatgcagagcttggtgaatatgtatttatccctctactagaaacacagctcccagcatgcgatcttcatagtcgagggtgcgctcaagaaacccagagtgaatatgatgaatggggcatgttgaaatgcatgaaagygacttatgagtatgcttctgtttgggattcttacactgactcttagaaaacaacatgttttatattttttaaatattgtacgtgtgttacttcttttcttcctaaaaatcctgcatgtagaattcaggggaggtgatgttacagacccactgtcaaggacaataatttgggagctggaaaagttggtcggtggattatttttggttttctccttatctagtttcatatgcccaattacttgaggcaggttgaaggaatttgaaaagtcagatctgatttgtaaggctgatagcctttcca

SEQ ID NO: 73356 - DNA, 601 bp, Human
gctaatctagctggaagggtggacagtagacaggtagttaatacttacatggttcgtgctttcacgcttttctgctgcagaatacccattccaccacacacacacatccttgagatgcctagtaagtagagcctttgtagcctgaagataacactgtgagtgtatctgcacaggctgggctacctgagaagctgttggatttggtgccttgttaggctgacttttcctactgctgggccatttatggttttggactaattttggttgcacctgctttgatgatatgtcaatttggggttamagatagcatcccttcttgagggttttatctaggcacaacctaactggtagtttgttcagtagaaatgtcattatctaccattgtgtttcccagagggacatctttgtcaaggcaacttgcaagattttcattttgttttttattgagctaatttagctcaattaaaaaataaagtaaaatagagacttacctgaggcccagaaaaactaccaagatcttttcaataatcagatgtcagggccaaatatcccttgtgccggtgtcagcaccgtgctgggtgtcattctctttccaaggtct

SEQ ID NO: 73357 - DNA, 601 bp, Human
cagccccaagtcgggctcagccaggtgcaacaggatggctcccagctgagcggtatagatccaggagaggatatcggaggatggaaggaaatcctgggcccagtgagttccattctgcaggcccaggccccagggcaatgggaaagtatattttaatgcttaataaaaggccattacaaattgtctatttcacccgccataaagttttacacactacctgaatagcaggttgttttggttttggctggcagtctgttgattcagtaatgttgatgggcagttatttacgtacggctttgaytaaaataaaaaactagttatttttaaagcatggcctactcggtataaggaattgtacgagagaaaatgtatgaggattcttcagtggtgcaaagttgaaaatgccagcacaggattacagtagggaatagccacaccacttttggcctcagaacccagtggaaggcaatgtttagttttgcaaacaacgtagtctcagctatatccctaattaataggactgttgccagggcttgtgtgagaaagtatgttaacgcgctggtactggtgcctgatcagatttgcaaaagtgccttgtgtc

SEQ ID NO: 73358 - DNA, 601 bp, Human
ttctgcaggcccaggccccagggcaatgggaaagtatattttaatgcttaataaaaggccattacaaattgtctatttcacccgccataaagttttacacactacctgaatagcaggttgttttggttttggctggcagtctgttgattcagtaatgttgatgggcagttatttacgtacggctttgattaaaataaaaaactagttatttttaaagcatggcctactcggtataaggaattgtacgagagaaaatgtatgaggattcttcagtggtgcaaagttgaaaatgccagcacargattacagtagggaatagccacaccacttttggcctcagaacccagtggaaggcaatgtttagttttgcaaacaacgtagtctcagctatatccctaattaataggactgttgccagggcttgtgtgagaaagtatgttaacgcgctggtactggtgcctgatcagatttgcaaaagtgccttgtgtcattgcttgagggatactggtatctcattagtatcttgtgaggggatggtaggatggtacaatggcaaaatgaagccatagttagatttcagagataatcatttctctacgac

SEQ ID NO: 73359 - DNA, 601 bp, Human
ataggactgttgccagggcttgtgtgagaaagtatgttaacgcgctggtactggtgcctgatcagatttgcaaaagtgccttgtgtcattgcttgagggatactggtatctcattagtatcttgtgaggggatggtaggatggtacaatggcaaaatgaagccatagttagatttcagagataatcatttctctacgacagcccaagattaaactgggaatatgcagttcacttacgtcgaccttagttcccaaaaggttgataggatttcaaaagaagattgtgggggaggcgggggatycatgaatttgattaaaggtctgcatggaattacagaggaaggaggtgagctatgataatcaaatgatgaaaggagaagtttgatatacacctagaaaattgtccaaattctgtcattagcgtatagggtttccatgagaactcatctctgagaatatcatatctggctggacagatctttaatctttgacatcagctgagcgtaactcaggagatgatgtccaggtgaagtgcgctcgtgagttcggagcctggagctttaggccacacaaaaagcatacagcatgggtagatgtggaga

SEQ ID NO: 73360 - DNA, 601 bp, Human
accataaatggtcatagcatacaggtgcctgggaagtctcattagtagtatgacataagctgttgaagttggtttgataatgaaggaatatttcaggcccgtaccctcaccactctcactgcccaccagccgcagagatgaaagaataaacagtaaacagtgcgtgtggagatcgcagaaagggacactgtgacaaaggctctctttcatggtcctcattgtccctgcctgtcattacttcccattaacactcaaaacacacatttgtgctgccatcccctcctcctccagccttaaaaaygcttgcaatgccctctgtacttgatctgcaaaacaaaaatggttggactgagtggctctttccaatcttgcaaaactcttctttgctgtccatgcattgtctgtggtcatgtcctatttaacgaaaatctctacactgtgacttaacttggttctgtgatgggttagtcattttagagtacttcacgtagacaaacgtggattattcaagctttgactataccctttgagattgtctgggcatctgctttcctctctggttgagaaccaacagggagcttagtactcataatttttccac

SEQ ID NO: 73361 - DNA, 601 bp, Human
aagtgatagatcaaagacagtcatcactgtaagaggtactgctttgcgaaagtgattataaatgcaccatctttcttcagcagcatcatcgcattgacattcatgttattagggtgcatttctttatctgcatccacaggctttcagtcccaatccacaatctgcattttaatgcccagctccgtccaactgtcctcgccattgctctgcttccgtgttccacagacaggggaagggcaagtatggaggctcaccctggaagagtgagcaggactctgttacctgcaaccccaagctttargcagcaggacaagaggccgaggttgtgaaacaaacggaaacctcaacctgcctgccatcatcacaccctcctgccctgaaaactcctggaggcctttagaaaggaactgttctaccctgttgttttactaatgaggaagtgatggtccaagcagtcaagtctgcataaccatctaagcttctgaatctgctgctgccgacaagggaccagactcaccaccacaaaccagggcactgagaggtagaaccaggcagcccacgccacagatggcacagcaggatgaacacggccccatgagac

SEQ ID NO: 73362 - DNA, 601 bp, Human
tctgcaaggttatgccaagcatgtcaccttaaagaatcagaaatccagaatccaaatttccagtctgtgtgtagcatttcattccatgacttgaggctgttgaacttggtgttttctttttctcatttccattctctgggaaagacccagaaacctaataagattcttcctggccatctacccaaaatgatatgtgcagtagatgaacttataaagaaccgatgaagacaaaggaaagcggtcctttgtacttcagtccatttgcatataaaaccggggcagtgattctcagcctcagctrcacaggaatagaatccctcgggagcttttaaaactgtgtatgcccaggccacaccacagccaaataagactcacttgggatgagagtctggcatcagtattttttttttttttttgagacagtctcgctctgttggctggagtgcagtggcgcaatcttggctcactgcaacctccacctcccaggttcacatgattctcctgcctcagcctcccaagtagctgggattataggcatgtgccaccacatccagctaagttttatatttttagcagagacagggttttgccatgttagcca

SEQ ID NO: 73363 - DNA, 601 bp, Human
ctgcaacctccacctcccaggttcacatgattctcctgcctcagcctcccaagtagctgggattataggcatgtgccaccacatccagctaagttttatatttttagcagagacagggttttgccatgttagccaggctagtcttgaactcctaacctcaagtgatccacccacctcagcctctcaaagagctgggattgcaggcctgagccaccatgcccagcctagtatttttacagcttcccaaatgattccagtgtgcaggcaagttttagaacttctgttaagagaatgaaccatygttgaccccaagggctaggtggtggtgacataacttgttttcatcttccgctttcatctggatgtacaggcactgactctgacctgctcatcatcttcccacaggtacactggagtcttggtactcaagcagcagtcacgtcatctgagaaagtgttagaagtgcagccttgcaggccctcccccaggacctgcatttgaactagatccctgggtcttacacgttcacacagaaataatcatgtgaggtgacagatacgttaactagcttgattgtgatcatcatttcacagtgcgtctg

SEQ ID NO: 73364 - DNA, 601 bp, Human
taggcatgtgccaccacatccagctaagttttatatttttagcagagacagggttttgccatgttagccaggctagtcttgaactcctaacctcaagtgatccacccacctcagcctctcaaagagctgggattgcaggcctgagccaccatgcccagcctagtatttttacagcttcccaaatgattccagtgtgcaggcaagttttagaacttctgttaagagaatgaaccattgttgaccccaagggctaggtggtggtgacataacttgttttcatcttccgctttcatctggatgyacaggcactgactctgacctgctcatcatcttcccacaggtacactggagtcttggtactcaagcagcagtcacgtcatctgagaaagtgttagaagtgcagccttgcaggccctcccccaggacctgcatttgaactagatccctgggtcttacacgttcacacagaaataatcatgtgaggtgacagatacgttaactagcttgattgtgatcatcatttcacagtgcgtctgtgtgtcagaacatcactctgaaaaaattaattttttttttaattgaaaatactgaatcctgggtg

SEQ ID NO: 73365 - DNA, 601 bp, Human
tttctgttgtttcagtatctgattagagctgaattaatgtagtcggggctaaaaaatagcttctatctctcagtgacacatttttggagactcataagcctcattgttttctcatcagtgacaactttgtctctgagtcagatgactcgagtctccttcacccgtgatcttggggggaaaaaatagaagtgagtaactcacacagccacaggaccaagtgatcacaatcacagcatccactcattagtggaaatgagctctggactcagtccagttgacgaatggtaaaatctatggctcrgaaagaagggaaagagcagtgctgaagatgtttgagttcttggggtgacctttgtagctcctcctgagatgtgccttgatgatgttgccttgatgatgttgcatggtactgatttcaaggacacaccacgctatatttttacataatctgcttcagaggagttagcccacattcatggataggagatggcccacattcatggataggagatagcccacattcatggatgggagaagaaaaatggcagagcatgctgcatatgtggcgggactgtcatgaggctgtcagagtcaattgtgc

SEQ ID NO: 73366 - DNA, 601 bp, Human
taaaaaatagcttctatctctcagtgacacatttttggagactcataagcctcattgttttctcatcagtgacaactttgtctctgagtcagatgactcgagtctccttcacccgtgatcttggggggaaaaaatagaagtgagtaactcacacagccacaggaccaagtgatcacaatcacagcatccactcattagtggaaatgagctctggactcagtccagttgacgaatggtaaaatctatggctcggaaagaagggaaagagcagtgctgaagatgtttgagttcttggggtgayctttgtagctcctcctgagatgtgccttgatgatgttgccttgatgatgttgcatggtactgatttcaaggacacaccacgctatatttttacataatctgcttcagaggagttagcccacattcatggataggagatggcccacattcatggataggagatagcccacattcatggatgggagaagaaaaatggcagagcatgctgcatatgtggcgggactgtcatgaggctgtcagagtcaattgtgccaggttcccaattcccagagcagcatcccggagtcttgtttagtcatga

SEQ ID NO: 73367 - DNA, 601 bp, Human
gcagtgtaagagatcagggtggacagagtcgagccctgcaaagaggctcagaagatccaggtgaggagacttgttcccaatttgaggccagcacatgtaccaggtcgtcaaggggagcccaggtgcaagggctgcttcagccccactagcatctccacactgggtgagggttacaagggaggctgggggtcagccactcactggcttttggggctttgttcatcccagttcccaagatgtcgagaactgagtcacagtgagccccacctgacaacagctggcactggggagggcaccgaacgctgagggagcactgaggccccaggcagcgtcacggccagagacaaatgtcacaaggatgatttgttgttaaaccacaactcgtttctcttaaaatatgagagaatactgtttgtcggtatatgttattgaaagtaatggtaaaaaccacaatcactttcgtacaaacctaatagaatctaggattggaaatgtaaatgagccaccaggtaattaaaccacgcctttagtcgcctttaatggccaggtcaggcattatcatttcagtgtgtattttgcattgctcagttgggcagcttgt

SEQ ID NO: 73368 - DNA, 601 bp, Human
tataccctctagtttcttgctattaaaacatagatctaagcaaaggattccagacaaacctaggtataaacttttaaataaaaactagttttgctttgtatttatttgggagctcaactgactggattcattgcttcttatatcacaaaggtgcattgacataaagggaagaactaaagtattatcaaataaatttcctgttcacaataacattgctaaacacagtgacaataccttctactgagatgatagctagttgggtgccacatctaatgggaaggttaaaaaacggcatcagttkattcatctttatcactaatatagtaaaaatatttctaagaaaaattgaactaagaaaagattgccatttttttgagtagcagtgcttctgaaagcggcacactcacactttgatcatagctgttatttttcattcatggtccgtgcctcctattttaagcctattcatttttcttctaattttaacattaaataaagcaaaatgaaagcttgtgttattatttagtatgaaaacacagaacctaatcacagctaacgagtgtgataaatgctaggctgtaccttctcttgtttggtgtgt

SEQ ID NO: 73369 - DNA, 601 bp, Human
ttatatacaggaggtaacataggctgaggaactaggatgccaagttacagatggggttgtggaatgctgtctgacagccgattagagtaatctgtcagaaatgatgacttaatcaccataacagactccaaattccctcatagaattccacccagagtaatctagttttcctgcaatattttattttattttattttttgccaggactaaatggctttgttgcttgttttttcccctttggtgtacgacgtgattttaatggaaatgtaaataggtggtatctttacagcacaaaggctgrtttggagcctgataagccaaaatcagatatataatcctgggttctgcagtttttctccatcactagattattagcctgtggagttgagcactgctggctgtatatatcccaggtgaccgagaaaggccattctctccaatgtgttctcttagctttcagatgggaccttgtctccttcccctcagggaagctcctatactttgcaaaataataatgaagaggatgatgatgacaactgtagcgggcacttactgtgccatcagtgttttaagtgtgtcacacacatcatggctatcagga

SEQ ID NO: 73370 - DNA, 601 bp, Human
agttacagatggggttgtggaatgctgtctgacagccgattagagtaatctgtcagaaatgatgacttaatcaccataacagactccaaattccctcatagaattccacccagagtaatctagttttcctgcaatattttattttattttattttttgccaggactaaatggctttgttgcttgttttttcccctttggtgtacgacgtgattttaatggaaatgtaaataggtggtatctttacagcacaaaggctgatttggagcctgataagccaaaatcagatatataatcctgggytctgcagtttttctccatcactagattattagcctgtggagttgagcactgctggctgtatatatcccaggtgaccgagaaaggccattctctccaatgtgttctcttagctttcagatgggaccttgtctccttcccctcagggaagctcctatactttgcaaaataataatgaagaggatgatgatgacaactgtagcgggcacttactgtgccatcagtgttttaagtgtgtcacacacatcatggctatcaggaaaaagttgtaatttatttccactgtagtttttttcccctggt

SEQ ID NO: 73371 - DNA, 601 bp, Human
tctgtcagaaatgatgacttaatcaccataacagactccaaattccctcatagaattccacccagagtaatctagttttcctgcaatattttattttattttattttttgccaggactaaatggctttgttgcttgttttttcccctttggtgtacgacgtgattttaatggaaatgtaaataggtggtatctttacagcacaaaggctgatttggagcctgataagccaaaatcagatatataatcctgggttctgcagtttttctccatcactagattattagcctgtggagttgagcrctgctggctgtatatatcccaggtgaccgagaaaggccattctctccaatgtgttctcttagctttcagatgggaccttgtctccttcccctcagggaagctcctatactttgcaaaataataatgaagaggatgatgatgacaactgtagcgggcacttactgtgccatcagtgttttaagtgtgtcacacacatcatggctatcaggaaaaagttgtaatttatttccactgtagtttttttcccctggttgggagaaggggatatgagataaggatcacttctgtttctttgttgtt

SEQ ID NO: 73372 - DNA, 601 bp, Human
tgtaatctcagcactttgggaggcctaggcaggtggatcatcttaggagtttgagaccaacctggccaacatggtgaaaccccgtctctacaaaaatacaaaaaattagccaggcctggtgcaggcgcctgtaatcccagctattcgggaggctaaggcaggagaatcgcttgaaccgagaggcagaggttgcagtgagctaacgtcatgccattgcattacagcctgggcaacaagagcaaaactccatctcaaaaaaagttttttgtgtgcctactatgttaatcgtgatatgtaaaaraacaacttgaaatagcgctgagacttggaggttaggtaaatgccatatattctgcctccatcatggaattggcatcttcagagggtaacagttttttcccgaatttccaaagcagtgttcagataaatagaccttgcataatccaggcagttaacataaagccacatagtagggccttttgacatgaatgattgttcacccaacaatgagtggtcttcactttgattcgttttatagattccagtgtacttttttgcactatcagtttgtgaatacaccacaaaatgtaagatcaattaa

SEQ ID NO: 73373 - DNA, 601 bp, Human
gcaggagaatcgcttgaaccgagaggcagaggttgcagtgagctaacgtcatgccattgcattacagcctgggcaacaagagcaaaactccatctcaaaaaaagttttttgtgtgcctactatgttaatcgtgatatgtaaaagaacaacttgaaatagcgctgagacttggaggttaggtaaatgccatatattctgcctccatcatggaattggcatcttcagagggtaacagttttttcccgaatttccaaagcagtgttcagataaatagaccttgcataatccaggcagttaacayaaagccacatagtagggccttttgacatgaatgattgttcacccaacaatgagtggtcttcactttgattcgttttatagattccagtgtacttttttgcactatcagtttgtgaatacaccacaaaatgtaagatcaattaacgtcagtgattcacaaccattgtttcctctcacacttctcagcgtctatgtagaacatttcagacagctggccctgtgaaagaaacctcagagtctaatccactgtgtgagttttgaacctctggatccaagcatagatttagctctgtccttgtta

SEQ ID NO: 73374 - DNA, 601 bp, Human
cgtcatgccattgcattacagcctgggcaacaagagcaaaactccatctcaaaaaaagttttttgtgtgcctactatgttaatcgtgatatgtaaaagaacaacttgaaatagcgctgagacttggaggttaggtaaatgccatatattctgcctccatcatggaattggcatcttcagagggtaacagttttttcccgaatttccaaagcagtgttcagataaatagaccttgcataatccaggcagttaacataaagccacatagtagggccttttgacatgaatgattgttcacccarcaatgagtggtcttcactttgattcgttttatagattccagtgtacttttttgcactatcagtttgtgaatacaccacaaaatgtaagatcaattaacgtcagtgattcacaaccattgtttcctctcacacttctcagcgtctatgtagaacatttcagacagctggccctgtgaaagaaacctcagagtctaatccactgtgtgagttttgaacctctggatccaagcatagatttagctctgtccttgttagtcgaatggcaaattagccggggctacacttccctggcctgactct

SEQ ID NO: 73375 - DNA, 601 bp, Human
tggtcttcactttgattcgttttatagattccagtgtacttttttgcactatcagtttgtgaatacaccacaaaatgtaagatcaattaacgtcagtgattcacaaccattgtttcctctcacacttctcagcgtctatgtagaacatttcagacagctggccctgtgaaagaaacctcagagtctaatccactgtgtgagttttgaacctctggatccaagcatagatttagctctgtccttgttagtcgaatggcaaattagccggggctacacttccctggcctgactctaaagctatttttttttcattacatgtttttatttctttcctgcccttttcataaaacccaaacagtaatttttgttcttgggctaattgttaaaacattgtatgtgtatatgcaaatacacaggtatactgcacacacatataaagtatgagttcctcattggaaagaagcctgtaggtggaggcaatctttatgtgtagcgtggaagagggaaattatggtaatgttacagattcttagaaaccccaaacttacttacaccacaactgtgtggatgcacatgacaggcggcgtggggtagaggcctc

SEQ ID NO: 73376 - DNA, 601 bp, Human
ctcactcctgaattaaaacttcccattctgtgtggctggagatgcagcctcagtttaattagcacacgtctcttcagagactccttgcaaaaattctggaagatcgtgtactcccttgtcatagacagaggaaggaggtggcccctgggaactagcctcagccctgaccctagccacacagtaggtagattgaattagcgaccaccacatcacctgggccctcccccgtctcctgctgtctactgggacctgcaggcatgtgcagggcacagcatgagatcctgcctccagccccatctarctctggcagcagggagggccagggtccctagtcatggggaagcagttgagaagcaacagttctgaccccactcatttcatcattagctcttgagaagggtgctcagggtgtggccactggctgccgcctgtcctggcacctagggaagatttcattcaggagtgagtagatgggcattgtttctttttacttgaaattgtccagcctatgaacatatccctcactgttagtcttgtgctttaggtgtcttgttttcggtgaatgttctttttaacaacttccattggccgggcgtggtgg

SEQ ID NO: 73377 - DNA, 601 bp, Human
aacaacttccattggccgggcgtggtggctcacgcctataatcccagcactttgggaggccgaggtgggtggatcccaaggtcaggagatcgagaccatcgtggctaacatggtgaaaccctgtctctgctaaaaatacaaagaaaattagttgggcgtggtggcgggcgcctgtagtcccagctactcaggaggctgaggcaggagaatggcatgaacccgggaggcagagctttcagtgagccgagatcatgccactgcactccatccagcctaggtgacagagcaagactccgtctcaaaaaaaaaaaaacagcataaaaacaacaacaacttccgttgcttcctctgttggttaggatatcgtatcattgttcttgatcaacagtagggcctattttctcttattctgtgcctccaaataaattgttcttttccctgaaatgtcctttccacatcttccggttaacatgaggattgctttgagaatgaatgcagacatagcttcatctgagacgccttccccagcgtgtccttcctccatctgtgtctggtgtctcttctctgagttcgcaccgtacagctcttaccacgtctctta

SEQ ID NO: 73378 - DNA, 601 bp, Human
gaaatgtcctttccacatcttccggttaacatgaggattgctttgagaatgaatgcagacatagcttcatctgagacgccttccccagcgtgtccttcctccatctgtgtctggtgtctcttctctgagttcgcaccgtacagctcttaccacgtctcttatcacgctgtgggaaatgcttgctgtatctgtctctcctaccacactgcaagctccatcacaatgagaaccccttctcatcctcctcttcccagcatctaacatatagtgtctggtaaaaacagaaacacgtgaataaacragcagtcatactgggtcaaatcattgaaaccatttctgttacagggaaagaattctttttccatccttatactttaaaactttgaactagaatgtctactcttttataataacttctcaagaaatctcccaaagttctgggagtcggaagattttgaggaagtgaaacagtattatgacaatgactcctcccacccatttttttgtcttccttgacatttacatcttgtatgtgatcagaaatctgtaactcaaatgaactgttcatggtaatgagccattattaatacagtcctgattg

SEQ ID NO: 73379 - DNA, 601 bp, Human
tgaggattgctttgagaatgaatgcagacatagcttcatctgagacgccttccccagcgtgtccttcctccatctgtgtctggtgtctcttctctgagttcgcaccgtacagctcttaccacgtctcttatcacgctgtgggaaatgcttgctgtatctgtctctcctaccacactgcaagctccatcacaatgagaaccccttctcatcctcctcttcccagcatctaacatatagtgtctggtaaaaacagaaacacgtgaataaacgagcagtcatactgggtcaaatcattgaaacsatttctgttacagggaaagaattctttttccatccttatactttaaaactttgaactagaatgtctactcttttataataacttctcaagaaatctcccaaagttctgggagtcggaagattttgaggaagtgaaacagtattatgacaatgactcctcccacccatttttttgtcttccttgacatttacatcttgtatgtgatcagaaatctgtaactcaaatgaactgttcatggtaatgagccattattaatacagtcctgattgaacacctttctctaagaaggtcacagtgctt

SEQ ID NO: 73380 - DNA, 601 bp, Human
agtgtgtgtctgccctcttcagtgagtgaagcatgccgttcttaaccgaaggctcatatggccaagtcccacattggacattttatggagaagcagtgtggtttaggggaggcatcaccagattaagagtggagatattagagttgtgtgatcccagctctgtcgttaatcacctgtgtctatgcagtcacttattcccttcatacctgtcagccgagagcactgactgcgtgatttccagggtcctttacagctttagagtataggggctctgtttttgctgctcccgaatttccacctsccatcatccacgcatttcacagatgcatctgaatgctcacagtgctctatttgtgctcttctgtttgtccctgttttttatgtggatgcgtatcgaccgccatgatagactgcacactccctgtgggcaggagccatgttcatttcatttttgtgtcccaggcataatgtaggtgcgctcacctcatctctcccatatcttgaacctgtgaatctcagtggactcttttcagcagatgaacctgtataagtctttcctgtcttgaaaggacagatgggtggcccccatcctccactgagc

SEQ ID NO: 73381 - DNA, 601 bp, Human
ctgaatgctcacagtgctctatttgtgctcttctgtttgtccctgttttttatgtggatgcgtatcgaccgccatgatagactgcacactccctgtgggcaggagccatgttcatttcatttttgtgtcccaggcataatgtaggtgcgctcacctcatctctcccatatcttgaacctgtgaatctcagtggactcttttcagcagatgaacctgtataagtctttcctgtcttgaaaggacagatgggtggcccccatcctccactgagcttcctgttgaactccctttgcaggtgacstcaaaatagaagaagccctcattcaccctatctactgttaccctcctcctttcccctctacttcccatgaccagttgttcactgcccctccacagaacctacttctgataaatcccgtgaagaattttttattgccagatccaaattctttggcctctcacagtgtttgctgtggcctgattctccctcattctggaaactcctctcctctcatggctcccatgggaccagttgctcctgcagctcctcctgcccctcactctgctctccttggactcctctttcctggtattctctgca

SEQ ID NO: 73382 - DNA, 601 bp, Human
tcttctgtttgtccctgttttttatgtggatgcgtatcgaccgccatgatagactgcacactccctgtgggcaggagccatgttcatttcatttttgtgtcccaggcataatgtaggtgcgctcacctcatctctcccatatcttgaacctgtgaatctcagtggactcttttcagcagatgaacctgtataagtctttcctgtcttgaaaggacagatgggtggcccccatcctccactgagcttcctgttgaactccctttgcaggtgacctcaaaatagaagaagccctcattcaccmtatctactgttaccctcctcctttcccctctacttcccatgaccagttgttcactgcccctccacagaacctacttctgataaatcccgtgaagaattttttattgccagatccaaattctttggcctctcacagtgtttgctgtggcctgattctccctcattctggaaactcctctcctctcatggctcccatgggaccagttgctcctgcagctcctcctgcccctcactctgctctccttggactcctctttcctggtattctctgcagttctgtcctcggctctcagctctttgc

SEQ ID NO: 73383 - DNA, 601 bp, Human
atcccacagtcacctggttgtacagacctggagttccccttctccaccatccccacaaccagccagtcgccatgaagttcagcctccaccagtgttccctggcctgcggcagcagcctcttaactgtcctccctgcctgtgtctctcgtctgtaatccaccctccacacggcagccaaaatggcttttctagaatttcgatcttgtttcctttgttacttcttctgtacctgaccacatactttcagacaaaatttcagttccttagcttgcaagaccctctgagagctgggtgttgcccwccttcaccgccccttcccgtggtcctccatgctcacactgggagctccctgtgagagggaactgtcacccttccacttcctgggtcactgcggggctgccccgtgagtttcacatgccggccccccttcagtgctcgcacgtccaaggactcggcccagatgcagccttggctttcctcgccaggcaggattaagtcccacacccctggacccctgtgggctctgtcctgcctctccccacatgcttgccagggtgcttaccggctgagggctcagtgtctctcctgcccctgccatccc

SEQ ID NO: 73384 - DNA, 601 bp, Human
tagataaaacccagagctgtggcttgcaagtgatggaagtccactggggaaatgaaaggtgccgagagaatgggacccattataatgaaagcatttgcgcagccagtgattccttccaccccgtggctcctgtgttcctcagggtgcaatgaaatgtgaagcaggaggacctttggaggtggtttgaggaattgattctaattggtaatggtggcagcattgtgtgcttggagcatgctctgcggaccaggcaccgggtgtgatgggcactttaggaagagccatgggtcccccgggtccrctgtagctcaggacctcggccccgctgtgtctagtcctttctactcctgtcatgtgctggacatgatcagaaggtgtctccctcccttccaccctcctcctctccatccttccttccatccttccttccattcttcagtggctctttgttcgtattctgtatttgtattagcatttaataaaaattatatactgataccaaagtcagtcaactgctagaccttcaaattactcatgaggcctaagaaaaacctatgtgacaaacataggatggccagaaaagtctgcatgatttaatttt

SEQ ID NO: 73385 - DNA, 601 bp, Human
aggtgccgagagaatgggacccattataatgaaagcatttgcgcagccagtgattccttccaccccgtggctcctgtgttcctcagggtgcaatgaaatgtgaagcaggaggacctttggaggtggtttgaggaattgattctaattggtaatggtggcagcattgtgtgcttggagcatgctctgcggaccaggcaccgggtgtgatgggcactttaggaagagccatgggtcccccgggtccgctgtagctcaggacctcggccccgctgtgtctagtcctttctactcctgtcatgtrctggacatgatcagaaggtgtctccctcccttccaccctcctcctctccatccttccttccatccttccttccattcttcagtggctctttgttcgtattctgtatttgtattagcatttaataaaaattatatactgataccaaagtcagtcaactgctagaccttcaaattactcatgaggcctaagaaaaacctatgtgacaaacataggatggccagaaaagtctgcatgatttaattttataataatttttataatgatacaataacaatagctaagttattttcaacgcatctt

SEQ ID NO: 73386 - DNA, 601 bp, Human; identical to SEQ ID NO: 34805

SEQ ID NO: 73387 - DNA, 601 bp, Human; identical to SEQ ID NO: 34806

SEQ ID NO: 73388 - DNA, 601 bp, Human; identical to SEQ ID NO: 34807

SEQ ID NO: 73389 - DNA, 601 bp, Human; identical to SEQ ID NO: 34808

SEQ ID NO: 73390 - DNA, 601 bp, Human; identical to SEQ ID NO: 34809

SEQ ID NO: 73391 - DNA, 601 bp, Human; identical to SEQ ID NO: 34810

SEQ ID NO: 73392 - DNA, 601 bp, Human; identical to SEQ ID NO: 34811

SEQ ID NO: 73393 - DNA, 601 bp, Human; identical to SEQ ID NO: 34812

SEQ ID NO: 73394 - DNA, 601 bp, Human; identical to SEQ ID NO: 34813

SEQ ID NO: 73395 - DNA, 601 bp, Human; identical to SEQ ID NO: 34814

SEQ ID NO: 73396 - DNA, 601 bp, Human; identical to SEQ ID NO: 34815

SEQ ID NO: 73397 - DNA, 601 bp, Human; identical to SEQ ID NO: 34816

SEQ ID NO: 73398 - DNA, 601 bp, Human; identical to SEQ ID NO: 34817

SEQ ID NO: 73399 - DNA, 601 bp, Human; identical to SEQ ID NO: 34818

SEQ ID NO: 73400 - DNA, 601 bp, Human; identical to SEQ ID NO: 34819

SEQ ID NO: 73401 - DNA, 601 bp, Human; identical to SEQ ID NO: 34820

SEQ ID NO: 73402 - DNA, 601 bp, Human; identical to SEQ ID NO: 34821

SEQ ID NO: 73403 - DNA, 601 bp, Human; identical to SEQ ID NO: 34822

SEQ ID NO: 73404 - DNA, 601 bp, Human; identical to SEQ ID NO: 34823

SEQ ID NO: 73405 - DNA, 601 bp, Human; identical to SEQ ID NO: 34824

SEQ ID NO: 73406 - DNA, 601 bp, Human; identical to SEQ ID NO: 34825

SEQ ID NO: 73407 - DNA, 601 bp, Human; identical to SEQ ID NO: 34826

SEQ ID NO: 73408 - DNA, 601 bp, Human; identical to SEQ ID NO: 34827

SEQ ID NO: 73409 - DNA, 601 bp, Human; identical to SEQ ID NO: 34828

SEQ ID NO: 73410 - DNA, 601 bp, Human; identical to SEQ ID NO: 34829

SEQ ID NO: 73411 - DNA, 601 bp, Human; identical to SEQ ID NO: 34830

SEQ ID NO: 73412 - DNA, 601 bp, Human; identical to SEQ ID NO: 34831

SEQ ID NO: 73413 - DNA, 601 bp, Human; identical to SEQ ID NO: 34832

SEQ ID NO: 73414 - DNA, 601 bp, Human; identical to SEQ ID NO: 34833

SEQ ID NO: 73415 - DNA, 601 bp, Human; identical to SEQ ID NO: 34834

SEQ ID NO: 73416 - DNA, 601 bp, Human; identical to SEQ ID NO: 34835

SEQ ID NO: 73417 - DNA, 601 bp, Human; identical to SEQ ID NO: 34836

SEQ ID NO: 73418 - DNA, 601 bp, Human; identical to SEQ ID NO: 34837

SEQ ID NO: 73419 - DNA, 601 bp, Human; identical to SEQ ID NO: 34838

SEQ ID NO: 73420 - DNA, 601 bp, Human
tgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacrttaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcacc

SEQ ID NO: 73421 - DNA, 601 bp, Human
atactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacartagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatag

SEQ ID NO: 73422 - DNA, 601 bp, Human
agatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagaggggrcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaagaaagagaaattttagacgactggatcctaagtagttgcat

SEQ ID NO: 73423 - DNA, 601 bp, Human
aattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatstctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaagaaagagaaattttagacgactggatcctaagtagttgcatgtataaaattgaatgagacgtcagctatacttcctttcccaaaaaatcttaccattttccc

SEQ ID NO: 73424 - DNA, 601 bp, Human
attgacggcttttatatctactttttgtgcctccttggagttggttggtttttattttccctcttaaaacttctaatgaaaacttgtccatttctctctcagcggtgatatttgttcagtgaatttcagaaatctcagaaacttggggtctgagtttgggctgagagctgggatttttcttgaaagagaaagggagtaagagaaagtgtcttctctgcctttaatttgtttataacaactatcaactcagaagatcatataacagaaaaacaaggggtagtgttttaccattttgtttttracaaagctccttttaaaaatcatgcagctgtcctcatagcaagctaaggacgtgactaccactttgttactacattacggttggaaaaagggaagatgaaaaggttcagtgagtaatgtgagaccacagcactagtcaatgacctaacaaggattagggtatagaattcccaaatatcacaacaacctgatgaagtagggactctaagttagcccaccgcatggccgggcaactgaggcttagagagatgagcagacttgtccaaaggcactaagctagtaggtggcaggaccaagcttc

SEQ ID NO: 73425 - DNA, 601 bp, Human
ctccttggagttggttggtttttattttccctcttaaaacttctaatgaaaacttgtccatttctctctcagcggtgatatttgttcagtgaatttcagaaatctcagaaacttggggtctgagtttgggctgagagctgggatttttcttgaaagagaaagggagtaagagaaagtgtcttctctgcctttaatttgtttataacaactatcaactcagaagatcatataacagaaaaacaaggggtagtgttttaccattttgtttttgacaaagctccttttaaaaatcatgcagctrtcctcatagcaagctaaggacgtgactaccactttgttactacattacggttggaaaaagggaagatgaaaaggttcagtgagtaatgtgagaccacagcactagtcaatgacctaacaaggattagggtatagaattcccaaatatcacaacaacctgatgaagtagggactctaagttagcccaccgcatggccgggcaactgaggcttagagagatgagcagacttgtccaaaggcactaagctagtaggtggcaggaccaagcttcaggtccggctcactgatgcaaacccaggct

SEQ ID NO: 73426 - DNA, 601 bp, Human
tttatcaacttgagatctgttctcttagaagactgtcttggtgtctagcacgagtggagaggagggagacatttgcaaaaacagtgtatcggaggtctgagaatgtcgaattggaggcgctcccggagtggtgaagtgtgcttggtacatccacaaagactcacgcagaacttggttcctccccaagctgagtctccagcagtccacactgcaggccttatgagaacgttctataaccacccatctgtcactttttaacagacctgattggcaagcacttgtaacaactgacatctgttcrtgcttattgatatgcagatttatggtaattgctatgaacaataagacacaaaattacctaaggtgaacattaaattaaattttcatgcccttctccttataaataattttttttaaatcttaagtttcaagtaggcatattgcgcatctgtttggtacataatttcttcgttttgagaaggatatttttccccaagtattgaatgaaagttgaatccctgtattctcaactttctttgccatcttcttagcccatcgttgagttcctaaaacttactgaaatgttttgcatgttcagtca

SEQ ID NO: 73427 - DNA, 601 bp, Human
tggctgcagtgagccataatttcactccagcccggtgacggagcaagaccctgtctcaaaaaatatatatgtatgttaattgccaaattgattgagagagcaaaacgtagtacatagttaagtagttagtggttaactggttaacctagttcttagttacaaatgaagacacgatcacaagttcattcccagacctctggcattcaggcgagttgcacaaaattcgtactggccccaatgttcttggaccctggggcagggagcggcacttcatggtgaagcagcgctagactggaatccrccccagctctcacatctgttcatactgttgtggtggggcgagcaaggccactcccagtggatatggggacctggggggtagagttaacttctgggcccctgtcacattgcctttcgaaaccctatgctggaccagccctttccttcctcttcctcccctccatccgtccctccctatccctccctccctatcccttctaaacttctctcagatgcaaagtttaaggaaggaaatggataccaatgcacaggaggagaaggaagaggtcagaacagctccagatggggaccgagagggcag

SEQ ID NO: 73428 - DNA, 601 bp, Human
ggcaatttgcatatttcctccattttcctaaagtaaaactgaaaaatgagaccagggcctctcaacacccacgttctcatgaatatggcactgtgtgacccttgacgagagaaaaccagagagtgctttcttttgattatgttcacttgatgaagcaaggttgccggaagtctgcccttttcttgcagaaattcacaggattacacaatacttctgtcccactttcaagcatccctgtgaaataagtaggttttgaaaagcaggtgcttggctttcaacctaagccaaaaggtctggatgwctcctggaagaagacagagtatcactttggacaaaatgcaaatccatttagcaaccaagacaggaggaacttttttctaagtggaaatgcaccctggttgaggaggccagggcagaagagtgctgtctagagcactcagcagccaggcactgagctgcgcccgtggctgggggcttacacatgtatgttgctagaacattctctcatccctccaccagcgcccctacacacacattacggaagcagctctcagggcactctccctaaagaagactgaatttgctccgtagatattgatta

SEQ ID NO: 73429 - DNA, 601 bp, Human
agaaaaccagagagtgctttcttttgattatgttcacttgatgaagcaaggttgccggaagtctgcccttttcttgcagaaattcacaggattacacaatacttctgtcccactttcaagcatccctgtgaaataagtaggttttgaaaagcaggtgcttggctttcaacctaagccaaaaggtctggatgactcctggaagaagacagagtatcactttggacaaaatgcaaatccatttagcaaccaagacaggaggaacttttttctaagtggaaatgcaccctggttgaggaggccrgggcagaagagtgctgtctagagcactcagcagccaggcactgagctgcgcccgtggctgggggcttacacatgtatgttgctagaacattctctcatccctccaccagcgcccctacacacacattacggaagcagctctcagggcactctccctaaagaagactgaatttgctccgtagatattgattaagtatctggacttaagaccagagaagaaggtaaaatgaagctgaagtccaccatctttctatcttcagttcctctgtgtagggagagaaccattgtttcatgcttctca

SEQ ID NO: 73430 - DNA, 601 bp, Human
ttaccactgtgaagagcctccgtctcttagtctttctttgtcctgcccttttccaaaaaataagacaatgtaagaattctgtttcaaaattcctagtcattcccatgtcacatttcacagcaactccatccatcacatttgattttaaaatccacggtccagtaaggaacatgtttgctcatttctggtcaggctctggggtgtgtcatttaaagtctttttttcttcacaaattttgttgccttgttgttcaaaagcagatgccagttgtcttttcatacaagccagatagaatgtggtygcttagataccgtgatttgaggttttgttttgtttttttttaatttaaaaaagtcgaacgtttcactggctttccatctctgagttttccagacctcaatagatggtctcacctccttttctgttacatgaaggagatggcctggacagtttccaagcttccttctaactttcaaaatcccatgaccccctatcagctgcgccccaaggattagctaagtgttggaaaaacgttaatgaaaaaatagcttcaggaaacacacatcgaaaactacagcccactccacgctggctgttttag

SEQ ID NO: 73431 - DNA, 601 bp, Human
tagggcgacggcctaggtgttagtcggaaaggaattttaaatgtatgtgactattttcaatttcttcctgagactgcagtggaggaaaatgtgttgtgggatgagccttcctccctgctggagtcaaaaccacaccagcgcagcgtccttgccttgactgctctgtaagaggcttcttgcccttcagaacacgccgctcgcttaggtgtcactgagagcgatttttctcttctctactgaggaatgctttgcataataactgaaagtattttattagaatcctaaagtgtagcagcagcartgattgaaatctacatttcaattatttttcttaagtgtaactaaaaaatctgatgtttaagtgaaagtaaattatttgtctaatttccatcagggactttttgaaagtcacagaaaatgtggttagtagaattcatgaatctccacttcatcaaggcagtttcctagaagataaaaggggttgaaagccattcccaaggccattgccattatttactttttaaataataataaactgggcatactatttggaccatgagccagttcacttgccctgtgagttgaagggaagcctcatccc

SEQ ID NO: 73432 - DNA, 601 bp, Human
actgaattcacaccatggtaaaaacaatttgaatagcctttaagtataaattgtaacttctacactcttaaaacgtcataaccaatattttgtatatcttacgttaaattttgtgaatgagaccaagagtgggagagggaagctctcttctctcctttcttcctctcctttgagctgtaccatctttctgtgtgtttggtgcagcagagagctgggagtagggccccccttaaggtagaactgcaagtggccaaaccagaaagcgagagggtttagcccttggccctgctgctcgggctgytctgtggcttctccacagaagcatgacacacaaaccaggtggtttgaaagttcttcggcatgtaagactgatactgttggggagaacagtagttggaaacagtgtgtctgcctagtaaatgtcctttatttggcattgatcatcctgcttctaaaggaggagagagcatgcaaacccctcccacccagaggggttttgagggccccttgtgtggagggagtttgggtgtgcaatgaacttctgcctagtgagtggatggatactccaggcagttggtgcaatgccccaacctggagcagg

SEQ ID NO: 73433 - DNA, 601 bp, Human
gccgggtatggtggtgcacacctgtggttcccagctactcgggaggctgaggcaggaaaatgacttgaacccaggaggcagaggttgcagtgagccgagatcacgtcactgcactccagcccaggtgacaagagcaaggctctatcttaaaaaacaaaagaacatgaaaaatctgtaaaagtactggggtcactaggggaagaagtttttatgtttttgttttaagatggagaaacaaaacatatttgtagaccaaagagaagagccagaacaaagggaaacaggaataggccaatgagasctgaaagctggactagagttggagggctggctggagggatgagctcagcctccagcgtgtccctctcctgtggcgagggggatgctgccttctgagggtcgggtcacatgtcatctccccctgggaggagcccccacagcagcaccctggccttgtggtgccatctcgacctggtactagcacacaagccaacaggcacaaatctgaatcagggctgagtcagcaggtggtgcagcctgagggagggaacactgacctctgtcaggattggggaggatgccaagaatttaggacagaagg

SEQ ID NO: 73434 - DNA, 601 bp, Human
cttgccccctgctaccattggggtcatgttgcccagaggaaaatctgcctcccagaaatgatgttctctccatctggacaagctgccccccaaccccccccaggaaggccagacttcagacaggctgtcagtgacatggtgacatgggcctgctttcctgagaagcccctgtccttgccctttctcttcagaggcccgagcccggtcccatcattaaatgctacagctgctgttatgtatccaactgcctcttttgtgatccacgtgaggaaaacagaggcctgcaagggtcagtggtttscccgggatgttagtgacaggtgaaatgacagcgccaccgcaccacgagacagtccatattctaagcaggaactcctgggatcccagaaccgtatttctgggtttcgccaattacacattgtcccccttgtaaggagatcatcaacatttttttttttcggtccttctccgggccatctgtaaaaacaaacatctggggccagctaaaggggaagtatatacttttgtttcagtaaatcataagcaaaatatcattggcagggaaaagaggtttgatttttccctctcatttgccccgctc

SEQ ID NO: 73435 - DNA, 601 bp, Human
aattaggccgggtagggaggcaccctggtttattgacaacccatgaagtagatttcttagatccactagacagagcttccacaagcctttgggaatgaacattaaaggagtggaaacaggacagctgctttggacgtgaggagcaggtgctggcccctcacttccccgccttccacatgtgtgccaccgtacaataaagcctcagcagtcgttctgagtccagacccggccctctagactgaattttcctcttcccagtcttcctgagaaccagtagtgatgactcttgcccagcactgcrccaagccaggtggcatcagcttccttgggaagcagaactggcagcagaagagaggggcaccaatgtctctggggaaggtaccctcttccaggctgggagtgtgaggtcacacctcaccactgcagcgcccagtgtcactttccaaccctacctcctcttcctcagtcaccccgcccctccctgcccaaactatcttcgagggactaaattaaaatgaaaggtgtggttattgtggaataattaggcctcacggggggagaggtgtagtatattaatgccccagggttgtgattggctagt

SEQ ID NO: 73436 - DNA, 601 bp, Human
ctgagaaccagtagtgatgactcttgcccagcactgcaccaagccaggtggcatcagcttccttgggaagcagaactggcagcagaagagaggggcaccaatgtctctggggaaggtaccctcttccaggctgggagtgtgaggtcacacctcaccactgcagcgcccagtgtcactttccaaccctacctcctcttcctcagtcaccccgcccctccctgcccaaactatcttcgagggactaaattaaaatgaaaggtgtggttattgtggaataattaggcctcacggggggagaggygtagtatattaatgccccagggttgtgattggctagtaatgctagtgcctgtgtcatggcttaattatcctacttcctcacaatcttttcctgcgcagttggaattccgcatccaagctcgtttgaggcaaaacggcgaccgcgggctccagtgtcctgagtatgtttggtcaatgcaggcgattttctccgtgtttacaatgattttatttcctaaaccacaaagccactgtgttttcactatctaattgttctgtggaaagtgtttaacgagggcaccgaaggcaaattcttgctgtc

SEQ ID NO: 73437 - DNA, 601 bp, Human
cacggggggagaggtgtagtatattaatgccccagggttgtgattggctagtaatgctagtgcctgtgtcatggcttaattatcctacttcctcacaatcttttcctgcgcagttggaattccgcatccaagctcgtttgaggcaaaacggcgaccgcgggctccagtgtcctgagtatgtttggtcaatgcaggcgattttctccgtgtttacaatgattttatttcctaaaccacaaagccactgtgttttcactatctaattgttctgtggaaagtgtttaacgagggcaccgaaggmaaattcttgctgtcttctgttaatgttgttttgttgcagctttaaaaaaaagtattttgctatccaggaagagtggggagtagggttaatatgagaacattaatgcatttgttcctagaaagcaagccagtttctgggacagacttaacgctagacatgccctgcagatacactgagaccaagacaagggcgaaggggaaaattcatatgggaattatattttaaataaagaactggcaaatgtgagagatggataagcccctcattgctgtttttctccctttcgtcgtggatctggaa

SEQ ID NO: 73438 - DNA, 601 bp, Human
gcggaaacttcttccctagccggctctcctctgtatcgaactaaaatctgcctctgaacagcttccacccactgatcctaattttgatctcttgagctgcaaagaatatctttctcacgtcaagacctaagactgtttcttgccttagtcccttgcctctctaggctcaattttactcttatcagctcactctctttcaactcaactttcatgtctggtcacccttctcgggacgctctcaaaactatacacacagactgaccttcccaatgactggactaatgagaaaggctgcaaaatyagtcatccatccagtcgccactctggggaagaagatgttgaatcttcattgcaagtgctgtaaaatgaagtgtaaagatgcagttcctcttttgaggacagaatacccagattctcctccttcagatacagactgaacacacgtttattgatcacccgctgtgcatcagacatcagtgccgccttcttggattgccacgcccatccgcagaggcagtgtgtgttactcccgtttcgtgaataaacactaagcctcagctgaatggagcagatggcctaaggtcttacagactggaaggaa

SEQ ID NO: 73439 - DNA, 601 bp, Human
aaggcaagtcatctagttaacttttcttagtctcatgcttgattcttctccctccttttcttcaccgtctccccaactttctactgggaccgtctaagaacagcgtagtaagaagtgagaaattatgtccagttcactatagccagcctcccagtttttaaataggaagccagggtgtaaagagacctaatttgcatattgattcattgtcatcaataacaaaaggggcccagggagtttctaggccgcctccacctctcctatggccccctgagctaggctgccccatgctcataggctrtgcgcgtatctgtgcctaaggagttctctgtccaactcactgtttgccatcaccattgggagtcagccacatgagagcagtgtgtggcatcaacacacctgtttgcagacccaccttggagacttggaggatttgagaagtcttccctaagcacaagatcagccaggcctggtgtcctccagcgcctcttctcccttgccccagggcgaagcactctctagaagcgcgctctgacgggcactactctggaggcacctggatgggggcgcagcaggcagcatctctgggccagcagttcac

SEQ ID NO: 73440 - DNA, 601 bp, Human
aagtcatctagttaacttttcttagtctcatgcttgattcttctccctccttttcttcaccgtctccccaactttctactgggaccgtctaagaacagcgtagtaagaagtgagaaattatgtccagttcactatagccagcctcccagtttttaaataggaagccagggtgtaaagagacctaatttgcatattgattcattgtcatcaataacaaaaggggcccagggagtttctaggccgcctccacctctcctatggccccctgagctaggctgccccatgctcataggctatgcgygtatctgtgcctaaggagttctctgtccaactcactgtttgccatcaccattgggagtcagccacatgagagcagtgtgtggcatcaacacacctgtttgcagacccaccttggagacttggaggatttgagaagtcttccctaagcacaagatcagccaggcctggtgtcctccagcgcctcttctcccttgccccagggcgaagcactctctagaagcgcgctctgacgggcactactctggaggcacctggatgggggcgcagcaggcagcatctctgggccagcagttcacagtgt

SEQ ID NO: 73441 - DNA, 601 bp, Human
tcatctagttaacttttcttagtctcatgcttgattcttctccctccttttcttcaccgtctccccaactttctactgggaccgtctaagaacagcgtagtaagaagtgagaaattatgtccagttcactatagccagcctcccagtttttaaataggaagccagggtgtaaagagacctaatttgcatattgattcattgtcatcaataacaaaaggggcccagggagtttctaggccgcctccacctctcctatggccccctgagctaggctgccccatgctcataggctatgcgcgtrtctgtgcctaaggagttctctgtccaactcactgtttgccatcaccattgggagtcagccacatgagagcagtgtgtggcatcaacacacctgtttgcagacccaccttggagacttggaggatttgagaagtcttccctaagcacaagatcagccaggcctggtgtcctccagcgcctcttctcccttgccccagggcgaagcactctctagaagcgcgctctgacgggcactactctggaggcacctggatgggggcgcagcaggcagcatctctgggccagcagttcacagtgtgga

SEQ ID NO: 73442 - DNA, 601 bp, Human
cagggcgaagcactctctagaagcgcgctctgacgggcactactctggaggcacctggatgggggcgcagcaggcagcatctctgggccagcagttcacagtgtggacatcataggaagagaaaggttacagcctggcatacagggccctcctgtgatttcctgcaaggtgggagaaggtcctccagcagaagccagatcagtggctgtgcagtcatcaacagttggagatgtttagatgaaagtggggaaaagtgttacctgctttcattgtttcataaaatagatcctatatcattttstctgttctgttcagcctctacctaataactgatgatgatctaaaaatggtgccaaatacagtgccaaattcattacatagattatttaatctttacaataacccggtgaattcagtgcccttcttcttcctccgtttaaatacaatgaaacagaaggttggggagatgagggaacaaggcaggcttaatgaaaccccattttgcctccagttgttttgtgttttgtttttaagattccactgaaaagagctgatgaaactatagagttgtgttctttattaagagctatagtttcatttt

SEQ ID NO: 73443 - DNA, 601 bp, Human
tggcatacagggccctcctgtgatttcctgcaaggtgggagaaggtcctccagcagaagccagatcagtggctgtgcagtcatcaacagttggagatgtttagatgaaagtggggaaaagtgttacctgctttcattgtttcataaaatagatcctatatcattttgtctgttctgttcagcctctacctaataactgatgatgatctaaaaatggtgccaaatacagtgccaaattcattacatagattatttaatctttacaataacccggtgaattcagtgcccttcttcttcctccrtttaaatacaatgaaacagaaggttggggagatgagggaacaaggcaggcttaatgaaaccccattttgcctccagttgttttgtgttttgtttttaagattccactgaaaagagctgatgaaactatagagttgtgttctttattaagagctatagtttcatttttcagtagcaatggggctgggccaggaccctttttcctgcctttctcagtgatgccccatgccagccaacctccatgatccttcccctgctcaccacagaggcaggcaggtgaccatccccacttacagtgcaaa

SEQ ID NO: 73444 - DNA, 601 bp, Human
tcatcaacagttggagatgtttagatgaaagtggggaaaagtgttacctgctttcattgtttcataaaatagatcctatatcattttgtctgttctgttcagcctctacctaataactgatgatgatctaaaaatggtgccaaatacagtgccaaattcattacatagattatttaatctttacaataacccggtgaattcagtgcccttcttcttcctccgtttaaatacaatgaaacagaaggttggggagatgagggaacaaggcaggcttaatgaaaccccattttgcctccagttkttttgtgttttgtttttaagattccactgaaaagagctgatgaaactatagagttgtgttctttattaagagctatagtttcatttttcagtagcaatggggctgggccaggaccctttttcctgcctttctcagtgatgccccatgccagccaacctccatgatccttcccctgctcaccacagaggcaggcaggtgaccatccccacttacagtgcaaaaaggtggggagactggtgaggtctgtgctgtaagatgacgttctgcacagtgcaagctgcagagactaagagcaacagc

SEQ ID NO: 73445 - DNA, 601 bp, Human
cataaccctgtgtatttggagctgtgggaagaggtagccccatcttcttggccatacctgcccagggtagagcttcctttatgctgagcttcagaggaggggatttgtaccagggaagggagcaggttgtgggttgtgggtcacatgccacagattcttgctgctcttactgagatttgataaatcttcttgagaaaaatatttcttcatctatacacttaggacaatttccagagactttaagtggttggtttttattatttttatctgttgtagttgtttcactggaaggagggcccamggatatccttattttagaagtacttccctggtgtaccctaaaattgtgtgaaaatgttcaggccttttttgctggtttagaattcaaacatgtgcgagggatagtttttaacacgctacttactagcgcagcaatctggcaaggactattacatgtagactggcatcggatgcagtccctagaaaataccccaaataggagagacttctatttctggcagttaggcagactagattactggaaagaccctcccaccgggaaaaaccctaaaatgtatagtaagattttttaaaatatttt

SEQ ID NO: 73446 - DNA, 601 bp, Human
acgagcctgaaacctcaaaaggctaaactctcagtgtaaagatgaacaaaaaatactccccactagaaaactacaaggaaaactgactatctcaaaacatagtgctgggtagggccaggggaatttccctctgagaattcataacaataaaccatccctcacgtgagtttacaacccagtttgattgtatctgagtggccaaaaatcctaagccatgaagttaaagtatccccagcttgtagtttcctccagcaccttgtagaatcaaatgtaagtcatcttgaaagaacccatcttcaasccaggcctcaaattattcctagaaataaagttccaagatatttaagctcacaaccaaaaaaaaccccacaaaatatacaagtaaaccaagcaccaagagtgagaaatagcagggacattattagacaccaccattattagacctcagatattagcattattagcatacaacagaaaggaaatacagctaatatgtttacatattaaaagaatttgaaaagcgaaaaagccactgattatgaaaaatgaccaatcatgttgataacattctagaaatgaaaaaatataatcaaattgtaaa

SEQ ID NO: 73447 - DNA, 601 bp, Human
ttcaaggaaaaattagaaacaaaaaggttgccccaaaaaggtttatttcaccagaagataggataatttccaaatctatgcaagtagtaacctcttgcatagaaatataccttcaagatacatttccaaaaataagcatgtttacatggagttggaatgacagacgttcacatgcttcttccagtaactgacagatcaggcaggccaagaaatgtcttacatttaaatgttttccattttagaagtttattgaagatattatgaataactttataccaatatagagttgaaaacaaaatayagcaatttctagaaagcagcaacttagtaaaacggattcaagaacaaaaagaaaagttcagtcatcctatttatcagggaaatgtaatcactatttcagaatcttcccatgaagaaatacaaagtccagaacattttactggcaagtgctaccacacacttaaatgacaattaattttaatctgacacagtctattccagagaacagaaaaataggaacactctcccagtcactgtatgaggttagcaaaaccttggtagcaaaactaaagacagtacaagaaggaaaaataaaggccca

SEQ ID NO: 73448 - DNA, 601 bp, Human
gaagtttattgaagatattatgaataactttataccaatatagagttgaaaacaaaatacagcaatttctagaaagcagcaacttagtaaaacggattcaagaacaaaaagaaaagttcagtcatcctatttatcagggaaatgtaatcactatttcagaatcttcccatgaagaaatacaaagtccagaacattttactggcaagtgctaccacacacttaaatgacaattaattttaatctgacacagtctattccagagaacagaaaaataggaacactctcccagtcactgtatgargttagcaaaaccttggtagcaaaactaaagacagtacaagaaggaaaaataaaggcccatcttactcatgcccataggcttaaaaaaaaaaaaaaagaactaagcaagatattatccaataatgaagccaaagaatgattgtcaacttcattatgtctaaacctggcagggcaggcctcccattcgcagatttccccaccatccagcagtgagtgtgtttgcagtattggtaaaacagtgctgtgaagatttttttaatcaccaaatctgtcaaaattgccacaagtacaatcccacatg

SEQ ID NO: 73449 - DNA, 601 bp, Human
ttcaagaacaaaaagaaaagttcagtcatcctatttatcagggaaatgtaatcactatttcagaatcttcccatgaagaaatacaaagtccagaacattttactggcaagtgctaccacacacttaaatgacaattaattttaatctgacacagtctattccagagaacagaaaaataggaacactctcccagtcactgtatgaggttagcaaaaccttggtagcaaaactaaagacagtacaagaaggaaaaataaaggcccatcttactcatgcccataggcttaaaaaaaaaaaaaaagaactaagcaagatattatccaataatgaagccaaagaatgattgtcaacttcattatgtctaaacctggcagggcaggcctcccattcgcagatttccccaccatccagcagtgagtgtgtttgcagtattggtaaaacagtgctgtgaagatttttttaatcaccaaatctgtcaaaattgccacaagtacaatcccacatgtccttcacccaaagccacaagcacagctcctcagctccgtccactgagatgatgacagaaggatttccagtctcggctctcactcacctcgtgtct

SEQ ID NO: 73450 - DNA, 601 bp, Human; identical to SEQ ID NO: 34839

SEQ ID NO: 73451 - DNA, 601 bp, Human; identical to SEQ ID NO: 34840

SEQ ID NO: 73452 - DNA, 601 bp, Human; identical to SEQ ID NO: 34841

SEQ ID NO: 73453 - DNA, 601 bp, Human; identical to SEQ ID NO: 34842

SEQ ID NO: 73454 - DNA, 601 bp, Human; identical to SEQ ID NO: 34843

SEQ ID NO: 73455 - DNA, 601 bp, Human; identical to SEQ ID NO: 34844

SEQ ID NO: 73456 - DNA, 601 bp, Human; identical to SEQ ID NO: 34845

SEQ ID NO: 73457 - DNA, 601 bp, Human; identical to SEQ ID NO: 34846

SEQ ID NO: 73458 - DNA, 601 bp, Human; identical to SEQ ID NO: 34847

SEQ ID NO: 73459 - DNA, 601 bp, Human; identical to SEQ ID NO: 34848

SEQ ID NO: 73460 - DNA, 601 bp, Human; identical to SEQ ID NO: 34849

SEQ ID NO: 73461 - DNA, 601 bp, Human; identical to SEQ ID NO: 34850

SEQ ID NO: 73462 - DNA, 601 bp, Human; identical to SEQ ID NO: 34851

SEQ ID NO: 73463 - DNA, 601 bp, Human; identical to SEQ ID NO: 34852

SEQ ID NO: 73464 - DNA, 601 bp, Human; identical to SEQ ID NO: 34853

SEQ ID NO: 73465 - DNA, 601 bp, Human; identical to SEQ ID NO: 34854

SEQ ID NO: 73466 - DNA, 601 bp, Human; identical to SEQ ID NO: 34855

SEQ ID NO: 73467 - DNA, 601 bp, Human; identical to SEQ ID NO: 34856

SEQ ID NO: 73468 - DNA, 601 bp, Human; identical to SEQ ID NO: 34857

SEQ ID NO: 73469 - DNA, 601 bp, Human
tgccgaaccttacagttctagaccaaacacgtctcagagaaagagatttttcttttttgcctttttatgcaaactccttagagaagcaggcagagaagctcctcgtctagttctttacttcacagctatgccagcctgaaactactcttgccaaagtcaaaaatgaccttccagcagtcagacctgctgcacgctcttcaggcctcatctaacggatctctgaagcgtacttgtcagtgtcgctcactccctcttcccaactcctgtgacgttgtcctctcatggtctcctcatgctccaycaactcttctaatggctttttcatgggtaactcgtcattgatggtgtgcccaaagttcggtccacagcccgctgctcttcttaatctaggtatcatttactcttaggctattaactaacactgatcagtgaagaaaccccaaatataactatctatatcaatccctcaaattttagactcaaactcccaactgtcttgtggacacctccatctgtctgcttgtgtgttctcctctcagtacactgggagcatcctgtaggcaagggctgctgccactcctgtctatgaatccccaaggcc

SEQ ID NO: 73470 - DNA, 601 bp, Human
taaatacaaaagaactgattgcaatattcagattgccaaatacagactaggctcctgggtcagaatcacttatttcatggctgtaatagttcaaacatggttttatacctagaaatgcttctcaatagacaagagtcagagagactggatgctttcactggggaatgtcttcccacccaactatcacaagtgtggaaaaatcactggatccacatttgcaggcatatttcatgaaatttagctggcacctatattcattattttacaatttcagttttgtatacctttcagatttgtgaaygtagttttttcttaaaattcattttaacttgatggtatgttttcaattcccccaaattaatggactgtgtatgtgtgatcacaagggtgtgtttaaatgttaataatgtatttgtgcacttaaaattttacattggaatccataatgctaaaaagccaaatacagcatttgccagtttaaaaaaaagtacctcttgtttctagggccccgctcatgttgttttaagcaataagaaaagaaaatttaggtaattaatagatccattttggaatgcacaggtttccctatgtattttatacc

SEQ ID NO: 73471 - DNA, 601 bp, Human
caaaggttgcaaagttatttttgccattttattgtattaacattgacacttaaaacccaatttcattgcagaatgaatcaaaaattacaaagaactaagacagtagaaaaaaatgctcttttgatcaaggtgtgacagggaataatatctacatgcttacaccaaatgattttattcaatagcgcataaaactccggtctgtggtgacaagcaataaaaaccactagtaacaatgtctggagaaaatgttttacttaaactactcattgtactaaaaatcactgattttggtgaaatttawtaaggcttgacattaccctaatatccatttctatgcttcattatgttcatctgtgttgtctgttttaggaccacatcatggagtaaataaaattagtgtgataaaaagtatgagaatgagtaccaatctactttattttttaaaaagcggtgagcttagctatcttagtacgtatctcaatagcagtgttcatttcaaacagtatccttctctttaggtcctcgttttccccctttaaatttctttctaggcatttcaaagcacttgttctgtatttctcttatttaaaatacaagaaag

SEQ ID NO: 73472 - DNA, 601 bp, Human
ttattgtgtaatctattccaaaaccaagttgttctatatttgttaattactgtcactccacatataataacaggtaatttaagtttctaaaactgtaattagatataaactcaggcaacaaaggttgcaaagttatttttgccattttattgtattaacattgacacttaaaacccaatttcattgcagaatgaatcaaaaattacaaagaactaagacagtagaaaaaaatgctcttttgatcaaggtgtgacagggaataatatctacatgcttacaccaaatgattttattcaatagygcataaaactccggtctgtggtgacaagcaataaaaaccactagtaacaatgtctggagaaaatgttttacttaaactactcattgtactaaaaatcactgattttggtgaaatttattaaggcttgacattaccctaatatccatttctatgcttcattatgttcatctgtgttgtctgttttaggaccacatcatggagtaaataaaattagtgtgataaaaagtatgagaatgagtaccaatctactttattttttaaaaagcggtgagcttagctatcttagtacgtatctcaata

SEQ ID NO: 73473 - DNA, 601 bp, Human
ctttaactccatcatggcacacactggggagaatgcctcactgctgagtactaaacaaagaggttgctcatctggcagagctcagttggtttggcaacagctttcatatttattgtgtaatctattccaaaaccaagttgttctatatttgttaattactgtcactccacatataataacaggtaatttaagtttctaaaactgtaattagatataaactcaggcaacaaaggttgcaaagttatttttgccattttattgtattaacattgacacttaaaacccaatttcattgcagaaygaatcaaaaattacaaagaactaagacagtagaaaaaaatgctcttttgatcaaggtgtgacagggaataatatctacatgcttacaccaaatgattttattcaatagcgcataaaactccggtctgtggtgacaagcaataaaaaccactagtaacaatgtctggagaaaatgttttacttaaactactcattgtactaaaaatcactgattttggtgaaatttattaaggcttgacattaccctaatatccatttctatgcttcattatgttcatctgtgttgtctgttttaggacca

SEQ ID NO: 73474 - DNA, 601 bp, Human
acggtgcgatctccgctcaccgtaacctccatctcctgggttcaagcgattctcctgcctcagccttccaagtagctgggattataggagcgcgccaccacgcctggctaattttttgtatttttagtagagatggggtttcaccatgttggccaggctggtcttgaactcctcatctcgtgatccgcccgcctgggcctcccaaagtgctgggattacaggcgtaagccaccgcgcccggccaatgatactctttaaaaacaaacccacctttattctgcatatcatatacagtcattttatacagtcacagtaaactacagagagtctgcttttataaatatacacattttgataagtagctgaaaatctgaagcttggtattaattttatcttatttctggtatgacttccttctaattcttctattaataacttgtgacctaaatacattatctatcattatccaaataccaaacattctttgttaagtagactagcagtgactatttttgattaaaatgttaaagttctccaacttcttccttaaacaagctctgtttctctattctccagctttaactccatcatggcacacact

SEQ ID NO: 73475 - DNA, 601 bp, Human
ctatattgactaaattttatttttgtttttaaagtaaattttatctaagtttaaatttaagccagtcaaaatttataggattggtagaaagagttctcaagcctttgtaatcaaaattatatatataatatttttattatatataaaatatatattatatattattatattatatacatatatattatttatatatttttttttaaattttttttttagacagagtcttgctctgtcacccaggctggagtgcaacggtgcgatctccgctcaccgtaacctccatctcctgggttcaagygattctcctgcctcagccttccaagtagctgggattataggagcgcgccaccacgcctggctaattttttgtatttttagtagagatggggtttcaccatgttggccaggctggtcttgaactcctcatctcgtgatccgcccgcctgggcctcccaaagtgctgggattacaggcgtaagccaccgcgcccggccaatgatactctttaaaaacaaacccacctttattctgcatatcatatacagtcattttatacagtcacagtaaactacagagagtctgcttttataaatataca

SEQ ID NO: 73476 - DNA, 601 bp, Human
aatattctgagattcttgtattaactgtcagtaatataaaaaccacatgctatccataaacaaagttatgcactttgagtagctttctcagtagtactgttttggcaacactatgtttatattcttgccttagtttctcttgagatcaaataatatatcatcttgaagagcatggtagagcggtattcaccagtacggtattttcaaaggcactctttttctactctgaggagtccttaggtgaacaattactacagccacaaaactaacacaaaagaataaccgccaaaagagatcttaragtccaaatctctcatttcacagataatacaactaacattttcacttagtcgagagacttttagcactaattcagtgggttcaacttcatacagacaagatctcagatcatgcaggagtatatgaagaaaagggacggaggctgagaaaacgattctcaagaagaaacgaaactggttacaaataaaaaagtcttcagacctcatagatggatgatagagtaaatatgtggtccagctttcctatacagatgttctggcatgatttctccatatctaaaacttttcatggagaatctgct

SEQ ID NO: 73477 - DNA, 601 bp, Human
aaataaataaataaataaataagaatgcttcactgtcaaaatttcaagagattattttttaaatatacactaaaagatcaagttcatttctgacacagtatatttgtgatatcatctctaatataaaatattctgagattcttgtattaactgtcagtaatataaaaaccacatgctatccataaacaaagttatgcactttgagtagctttctcagtagtactgttttggcaacactatgtttatattcttgccttagtttctcttgagatcaaataatatatcatcttgaagagcatgrtagagcggtattcaccagtacggtattttcaaaggcactctttttctactctgaggagtccttaggtgaacaattactacagccacaaaactaacacaaaagaataaccgccaaaagagatcttagagtccaaatctctcatttcacagataatacaactaacattttcacttagtcgagagacttttagcactaattcagtgggttcaacttcatacagacaagatctcagatcatgcaggagtatatgaagaaaagggacggaggctgagaaaacgattctcaagaagaaacgaaact

SEQ ID NO: 73478 - DNA, 601 bp, Human
cacttaaaatcacaaaggtggtcaattttattcttctaataaaggcaattcaccagtaactgtaaatacatcaagagcaggacttacccgttccacagccacattatgatctgggagctcctcctcactgcagaggaaaaacagtattatatgaaattgttgaaatcaaaacaaacttttaaaagcttatatacttatagatacatatgacatacaatatttatttgtcatcacaagagttacataggcttccattcattgaattcaatatgaaatgatagctactctagaaccacagggycacctatcttcaaaatccagccctgcactgtcaccagtagccacaagccacatttattaataaaaagcatctaattaacattaaaatttaatttagtttaacactgagttagtctcactaggcacagttcaagtgcatgaatgtcacgtagctagaagccaccatattgaacggtacagatatagaacatttccatcactgcagaaaggtccactggacagcactgctccagactaggagtgagcaaacttcttctcgcaagataaatatttaaacggtaagtatttgagactttctggg

SEQ ID NO: 73479 - DNA, 601 bp, Human
tgtaacacttctctaagtacttaaaatactaaaatactgacccacagaaaacgattttggttgttgtaagaaatttactaaaatctcctggaacagtcacatttcaaagaactgctggtcttagaatggtgctttatttgccacagggtacatgagaatcacttgtgaagcctttaaaaattacctacccagagaggctgatttcacagactgaggtgggagctgggcagctgtgctctcaaagcctctctgttctgaagcacgcctagctcaggacctgccagtctagaatgaagtctgycaactacctatcagaatctcctaaaatctcctaatattatttcaccattaactattatcttacagtggcataatgaggtccaaaatctaacaatgactgtaccattcccatataatatggcacttaaaatcacaaaggtggtcaattttattcttctaataaaggcaattcaccagtaactgtaaatacatcaagagcaggacttacccgttccacagccacattatgatctgggagctcctcctcactgcagaggaaaaacagtattatatgaaattgttgaaatcaaaacaaactttt

SEQ ID NO: 73480 - DNA, 601 bp, Human
cactgtaacacttgaagggataatctctgccagtctttatgtcaatatatttagttttacaaagaatccattacattaattcagcccaaaagagagatcatagtcagagtgtgagaacaaatccttacattcccattcaaggtggactgccacaaacttcacaggggcatttaccaacttctcactattactcattatttccttctcagtcattcctcagctacaaagaatctgcctttcccctccacctgcactaccactgcatttcacatatactatggccccaccaagccaccagtcrtctcctacctgtagtcactggatgtgagcttctccaaggcagaaactatgtcttatttaatcctagcattctatgcagaactaggccagtgcttgatacatagttgctattcaattatgtagatattaaaacaaaggtattcatttgctgaaacctctaggttatgatactgagagagaaccagacagtcacaagagaattcaactgcaggtctgcctatagggttctctatatacataaaatggcaatttcatctacatcttaaggttttgctacagttttgattttcagaaaagtttg

SEQ ID NO: 73481 - DNA, 601 bp, Human
tctcttaaaaaactaataaaaaattttgaaaaacaatattcctcaagcatgcatcctcctgtgtctgatatttcttcttttcttcacctccccatttattgaatcatttaaatcaccggtctgaagactttcaaactttctggatcaggaaattacaaaagggggaggggaatgttggagagagaagtcaatactggactgccagatttttattttgccaaatgtggatatcttttgttaaagatatcttccaactctttctgatttctcaaataaaagacactgtaacacttgaagggayaatctctgccagtctttatgtcaatatatttagttttacaaagaatccattacattaattcagcccaaaagagagatcatagtcagagtgtgagaacaaatccttacattcccattcaaggtggactgccacaaacttcacaggggcatttaccaacttctcactattactcattatttccttctcagtcattcctcagctacaaagaatctgcctttcccctccacctgcactaccactgcatttcacatatactatggccccaccaagccaccagtcgtctcctacctgtagtcactg

SEQ ID NO: 73482 - DNA, 601 bp, Human
atctggtccaaggcccttcccactattaacatggctaataattcagatagtaaaggctagacacgtacacaatgcatggatggatattacatagccttctcttgtagaataagaaatcttgggatttgctcagattcaagtcttcagatgctttaatggctctatttgaacattactgcgtattgtgatataatgagaactatatgatctctgcccccagttccctcctggaggttgtgggaacctctaatttatagcccttcacaggtgataacctaagactttcaactggcttctgacrtgagaggcaatcttatggaagtgagctcttaacctgtgaggtctgcacctactctggttagtgtcagaattgagttaaattgtagagttaaatttggggtccacttggggaaaaaccgacacatatcttggtaaccggaagtattctgtgctgtgtcaagtatgagaggaggaaaaacagtttggtttttccctatcttaacagtttgtttttcgtttcagttaggactcatgagtgaggacaaagttgatgggagtcaggcatgcctagacctcaccagcagaggtcagaagaagacaa

SEQ ID NO: 73483 - DNA, 353 bp, Human
aggttagtatttgcccaatttttccattaatagagaaattcccttttgtaactaatgaataatccacgtgatatactttgagacagggcgcatatcatgttccttaacaactctacccaatggtctcatcatccgttgatgattcctacctgaatcaattatggggcgcatatcatgttccttaacaactctacccaatggtctcatcatccactgatgatccctacctgaatcaattatgactgtgatggtggtaaaatggtgtttgggtttttttttctatcattccttctatattatkaaatgacattattaactttggactttaaaaagtttttctttctagctcctcc

SEQ ID NO: 73484 - DNA, 601 bp, Human
gggggaactgatcattagacaatcacgacatgaatagttcatccctaaatatttcaagtacgtatcgcctaagaatgaaaacacattatcctacatgattacagtaccattatatccaagaaatttaaaactggttattacctcataagcagcctatataccaaattccccacttgccccaagactgttctttatagctggttttttctgtggtgtgggcaactcggaatccaatcatgcattcggcattgcctttgctggcaggtccccaaagtgccttggcctttgtctctgatgacamtgatgttttgaaaagtcaaggccacactatctggctttgtgtgattggctcctctggatttcagcaggattatcaccccattatgttgtctttcccagcacatcacatcagatgcacacgatgccaagctgtaccacttctagcgatgatgctacagtttcatcattcagtaaaggttagtatttgcccaatttttccattaatagagaaattcccttttgtaactaatgaataatccacgtgatatactttgagacagggcgcatatcatgttccttaacaactctacccaatggtctc

SEQ ID NO: 73485 - DNA, 601 bp, Human
tcagagttcctagatgaaaacagaagctccctgctgggatccttgtcttcactccagcctccacactgctaccacaacccttcacacatgtcccagtttataatccttcaatggctacccattttctagaagtaaagttcaaatttcttagcacagcacacatgagcagcctttcagaatgtggccccaattcaccttccagttctacctcctgctacttctgtgatctggccaccatgaactatttgtcattcccatacacaatgcattttcagcctttatgacaaatgtttcctatttstctgcctgtcatgttttctcaccatcatttggtaaaatcctatgcatcctctcaagacctaggtcaaatgtccaacgcctggaacctttcccagatcgctccatgttccaagcaaaaccaactgttcccttagcattccatggcatggattcaagacccagatgacctgggttcaaatctgagttctgtcccatactgtttcatttggggcaaactacctaatctttctgtaccttaattgtctcatctataaaacgagaattattttgatcattgttacagcacctaacacctgtgttc

SEQ ID NO: 73486 - DNA, 601 bp, Human
tcaacaataccaaacttgaatgcacatgaaagtctctttcccccaatcatgaatctataattcatagatgaaatatactttctcaccaaagatgccgaagctaactattccagcaactgttttgaagaagtaactgaaaacatattcatatgtgacaaatgtgaacttaagtgcccccaaaaaataagctagggaatgtcatcttgccatagactcaaccacaataagacaaaactggaatataatagtgtattagaaactccacttaaagttcaacagagactttaaagtcgacatatcygaaactattttcccaaacatgctgctagtacccttctgtccctgacatgaattaacagcatcactacccactaagccctccttctctctcacttcccagccccaaaccacactctgctgggtccatgttctgtctcctgcttccatcctgtcctcttccccagttcaggtaatcagagttcctagatgaaaacagaagctccctgctgggatccttgtcttcactccagcctccacactgctaccacaacccttcacacatgtcccagtttataatccttcaatggctacccattttcta

SEQ ID NO: 73487 - DNA, 601 bp, Human
cgctgcaagaacaaaacacacacatacacatacaaaaaaaattaaggatcattaagtatgcttttccctacagcaaaaaataaaataaaataatatatattatacacacacacacacacacacaccccttgggaagctataggatccgaaaattatgtatcagtattcaatcaagtttaagtgctaactccataatgctgtccattcaacaataccaaacttgaatgcacatgaaagtctctttcccccaatcatgaatctataattcatagatgaaatatactttctcaccaaagatgcygaagctaactattccagcaactgttttgaagaagtaactgaaaacatattcatatgtgacaaatgtgaacttaagtgcccccaaaaaataagctagggaatgtcatcttgccatagactcaaccacaataagacaaaactggaatataatagtgtattagaaactccacttaaagttcaacagagactttaaagtcgacatatccgaaactattttcccaaacatgctgctagtacccttctgtccctgacatgaattaacagcatcactacccactaagccctccttctctctcacttc

SEQ ID NO: 73488 - DNA, 601 bp, Human
agagattattagggtttgtttttttttaatcaaatgcaatgtgggaaagaatgttccaggcagccttgagaatgcatgtatttctgagacagcaggggccgacagcagctccaaagggtttacaaaaaagcatcaggacaccaggctgccaaagttgggagaagtctcttgcgtgcccactcaagtgaaattcaggggcaaggctgcggaatggggaaagtgagacggaaaatgctcgctcttcacttgtttggtttccaggagaaggaatattttttcctaagtacctgggcccatgagtagtaagtatatgaataaaaagcaatgaaaatacaagtctactcagaaaagaaaatcattctgaggatacattttatactcaaggatgcatgctcactgcaaccccacgaggtaggtatgattgtcaccattttacaatgaggaaacaggcacaaagggcttaagggacttgtcccaagtcacccctctcataagtggtagaagacggattcaaagccaggcaagcctggctccaggacgtacactctgagccaccacatctctggctcccatcctgtcctctgccctagttcaggcaatc

SEQ ID NO: 73489 - DNA, 601 bp, Human
ttaaatgcctttcccaaggtcatatggctaggaagtggcagagctggggtttgacccatgatagtctgcctctagaatctgcctcttcaccatcaggctatactactgcttctgtggaactagtagaacccaagaaactcatgctccctggaattctcatcagcaaatgttgacataagataatctgtatctatacaaaaagggaaaagaaaggattatactgaaaaaagtgtgaggaatggacaaaaatcccaacagttaactcagttgtgttttgctagtaggactaagttagatttcctttttttcctttaaaatgtttttattgttcagccttccttcaagaaattaataggggtagttaacatttactgaatgcttgttctatgtaaggtacaatgctaagtgctttacatgcattaaatcatgaaatcttcatccctttgaaatgggacactattatctccattctgcagatgaggaaactgaggcttagacatcagtggttctcaaaatatggcccatgaaaccaaaacgattttcataataaaactatttctttttacagtgctgacttttgcaccgatcataaaaaagctat

SEQ ID NO: 73490 - DNA, 601 bp, Human
agaattaaattataagaccctaaaataaaaattttctaattatgctgtttttcaaatacttgtactgttacatgacagactaacttattacagttacatatctttcttcacaaatttttaactatcatagaagttttacaaactctataaaacaaagtgggaattacctccaaacacaacagtttggatgaaatttgcttattccccagaacagtagtccagtttacagttgttgataatccttcaactggcaaagtggcatttcatcttttctacatcagccccataatgtaggttcagygggtggtttccacttaaaatgtaagtaaaacaagatacagaagaaaagtatctgccctaggtcaaaaagttctaccttcttattacaaattcggggactttctgccaaatcacactgtcttctaaaaattaccgctttattaaagtggcagaatttatcagtaaaaagtgatagctggttgtcctcaactcataaacgaacatcattcattcattctaaaatgataacttgtaatgaatgcccgctttgtggccaacgcttatgaggttctgtggctacaaacatgaaaaagatctgtgg

SEQ ID NO: 73491 - DNA, 601 bp, Human
taggaggtgacaaaacaaaacatgaacacaaaatcacatatagcagaaaaagaattaaattataagaccctaaaataaaaattttctaattatgctgtttttcaaatacttgtactgttacatgacagactaacttattacagttacatatctttcttcacaaatttttaactatcatagaagttttacaaactctataaaacaaagtgggaattacctccaaacacaacagtttggatgaaatttgcttattccccagaacagtagtccagtttacagttgttgataatccttcaactgrcaaagtggcatttcatcttttctacatcagccccataatgtaggttcagcgggtggtttccacttaaaatgtaagtaaaacaagatacagaagaaaagtatctgccctaggtcaaaaagttctaccttcttattacaaattcggggactttctgccaaatcacactgtcttctaaaaattaccgctttattaaagtggcagaatttatcagtaaaaagtgatagctggttgtcctcaactcataaacgaacatcattcattcattctaaaatgataacttgtaatgaatgcccgctttgt

SEQ ID NO: 73492 - DNA, 601 bp, Human
attacaccaaaaacttaaaaggaatataaaaacgatgtctttggaatccaagcagtaggaggtgacaaaacaaaacatgaacacaaaatcacatatagcagaaaaagaattaaattataagaccctaaaataaaaattttctaattatgctgtttttcaaatacttgtactgttacatgacagactaacttattacagttacatatctttcttcacaaatttttaactatcatagaagttttacaaactctataaaacaaagtgggaattacctccaaacacaacagtttggatgaaatttgcttattccccagaacagtagtccagtttacagttgttgataatccttcaactggcaaagtggcatttcatcttttctacatcagccccataatgtaggttcagcgggtggtttccacttaaaatgtaagtaaaacaagatacagaagaaaagtatctgccctaggtcaaaaagttctaccttcttattacaaattcggggactttctgccaaatcacactgtcttctaaaaattaccgctttattaaagtggcagaatttatcagtaaaaagtgatagctggttgtcctcaactcataa

SEQ ID NO: 73493 - DNA, 601 bp, Human
taaatctacatttagggaaaaaaactccatcaaatggctgtgattacattaaaaagtaggaaatctgggggtggaaataaaaaattaatggtccccatactagtacagagctaaaattaaaaatcaggtacatatgggaaagcttaagaaacattgatacagtgtcactatcatcatccatggcaacaattaatccaaattactgagcatttaccatgcacaagaaactattttaagcaactatttaacaactattagaaactacttagcaactatttaaataagaaactatttagttaawctgttttattttatcccttccctttaagctatttatggatatttacctcatttaattatactaacaattctataactttaattataccaacaactcaattttaccaacgtagaacgtgaatcacaaagaggttaaataacttgcccaaaagcaagcacaagatgttataaaagatgactgattttacagtttgtaaaaaacaatgaccacggcccatggttttgcccagctggacttactaaaatacatggaatagcgaacaggaaagtatcaagaaagcccaagagcagaaaacactaa

SEQ ID NO: 73494 - DNA, 601 bp, Human
aacgtgtaatatgactgacttcagtggacccgaacaagtaaaataatgacatttttaatgagtaacataagcgctctgacacttatttcttaagctatattacttgaaaagtcttcagatattattttgttgctgttgctcaattctgtactcaataattgtacataagttactgtacatcatttatcttaaagttaaatctacatttagggaaaaaaactccatcaaatggctgtgattacattaaaaagtaggaaatctgggggtggaaataaaaaattaatggtccccatactagtayagagctaaaattaaaaatcaggtacatatgggaaagcttaagaaacattgatacagtgtcactatcatcatccatggcaacaattaatccaaattactgagcatttaccatgcacaagaaactattttaagcaactatttaacaactattagaaactacttagcaactatttaaataagaaactatttagttaatctgttttattttatcccttccctttaagctatttatggatatttacctcatttaattatactaacaattctataactttaattataccaacaactcaattttacc

SEQ ID NO: 73495 - DNA, 601 bp, Human
ggcatgaaacattggtatcatcagctgggcgcagtggctcacgcctgtaatcccagcactttgggaggccgaggtgagcagatcacaaggtcaggagatggagaccatcctggctaacacagtgaaaccccgtctctactaaaactacaaaaaaattagccgggcatggtggtgggtgcctgtagtcccagctactcgggaggctgaggcaggagaatggcgtgaacccgggaggcagagcttgcagtgagccgagattgcgccactgcactccagcctgggcaacagagtgagactccawctcaaaaaaaaaaaaaaaagaaacatttgtgtcatcaactccctccatccttgaaagtgtactgctattgccctaagaatcttaagttcaatacacctctccgtcttcttgtaattaattttttcctcaagtctaattactcaaaataacataaaacctattacggtcatcacaatgttgtgcctaacactttgaaacttaaaaataaatgtccaaacagggaaataattaaataaattatagcagaagcccttcaggtaagaactagtactcttattatcatcgtaatatacttgaatg

SEQ ID NO: 73496 - DNA, 601 bp, Human
agcaaaaaggttgccttgtccccaaaatatcctcatggattgtagagtgctgactcctaatctctttcctgccaccttctcactggtctctcagaagataccaagcttctcctcatctatctgaaaactccagttaatcctactggccatcttcagtgttctctctttctcactctcatttcccctcccctgccctttctccttcttttctctcctcttttcagttcttgctatttcttcaggaaaacttttttctttttcttaaatgacattgatgctatctgataagacaaaaacaacrataaatcttcatcaagggaagacatcacttttgaatgaaattaggcatgaaacattggtatcatcagctgggcgcagtggctcacgcctgtaatcccagcactttgggaggccgaggtgagcagatcacaaggtcaggagatggagaccatcctggctaacacagtgaaaccccgtctctactaaaactacaaaaaaattagccgggcatggtggtgggtgcctgtagtcccagctactcgggaggctgaggcaggagaatggcgtgaacccgggaggcagagcttgcagtgagccgaga

SEQ ID NO: 73497 - DNA, 601 bp, Human
gcagtcagtgctctttttaaaggtgtgaacatctgatttacacattccctgatggtataattaacttcttacacactttctgccttttatcccacacacctaaaagatgctccaaacagcaaaaaggttgccttgtccccaaaatatcctcatggattgtagagtgctgactcctaatctctttcctgccaccttctcactggtctctcagaagataccaagcttctcctcatctatctgaaaactccagttaatcctactggccatcttcagtgttctctctttctcactctcatttccyctcccctgccctttctccttcttttctctcctcttttcagttcttgctatttcttcaggaaaacttttttctttttcttaaatgacattgatgctatctgataagacaaaaacaacgataaatcttcatcaagggaagacatcacttttgaatgaaattaggcatgaaacattggtatcatcagctgggcgcagtggctcacgcctgtaatcccagcactttgggaggccgaggtgagcagatcacaaggtcaggagatggagaccatcctggctaacacagtgaaaccccgtctctact

SEQ ID NO: 73498 - DNA, 601 bp, Human
catctctatttttaagattctaacagggagatacagacaaagaaggagagagtataacaagaaattgttaagaatgcccaatgcattagcatgttcaggccattacggaagtgtcccttaagtggcacaaaagcagtcagtgctctttttaaaggtgtgaacatctgatttacacattccctgatggtataattaacttcttacacactttctgccttttatcccacacacctaaaagatgctccaaacagcaaaaaggttgccttgtccccaaaatatcctcatggattgtagagtgctractcctaatctctttcctgccaccttctcactggtctctcagaagataccaagcttctcctcatctatctgaaaactccagttaatcctactggccatcttcagtgttctctctttctcactctcatttcccctcccctgccctttctccttcttttctctcctcttttcagttcttgctatttcttcaggaaaacttttttctttttcttaaatgacattgatgctatctgataagacaaaaacaacgataaatcttcatcaagggaagacatcacttttgaatgaaattaggcatgaa

SEQ ID NO: 73499 - DNA, 601 bp, Human
taggtgttagtccattttccatgcaaccacgtcctaacattgatcatctaattactttaattgatcatttatgtatttgaaaagcacttcatacttattgatacagacaataacatttttactgaagtatctatttaaaatttaagaagtatttttgcaatcaagaaaacaaatagacctccaaaacctccaatgcgatagaattttaatataattttaagtgatcatatgaatatcttatgtcaccttgaatgctaaaagaaatggattttactttttaatttcaaaataacaagttagytttagctactcacactatacaggtcccttgtttcttctttcattttagggatctcaagaaggagggcccagacttcacctctgagctggagtggtattcctttgtaaattcgcctatgaaacttattaaaagaaaaagaaactgaaggttacaaactgaaaaaaacttagattagtctctacagttaatcttgctaatatttgttagcattgtattttcaaagcatctatggcaattaattaatacatttcaacatggcacatggaggtactgtcatctctatttttaagattctaacag

SEQ ID NO: 73500 - DNA, 601 bp, Human
caaggagatacatttaaagcacctaatttaagaaaaaaattattactcagtcaaaagtttaactttttattaataaataataaaacctagagataccctaataatcttggggcaaagtcatcttttttttcatgctagaagaaaagaatcatacacagcaggtgttggttaaactgaattctgctgctgtttcccacgaactctcaaagtgataccacaaatctctccattaacaccatgtggcaaacaagcagctataattaggtgttagtccattttccatgcaaccacgtcctaacaytgatcatctaattactttaattgatcatttatgtatttgaaaagcacttcatacttattgatacagacaataacatttttactgaagtatctatttaaaatttaagaagtatttttgcaatcaagaaaacaaatagacctccaaaacctccaatgcgatagaattttaatataattttaagtgatcatatgaatatcttatgtcaccttgaatgctaaaagaaatggattttactttttaatttcaaaataacaagttagctttagctactcacactatacaggtcccttgtttcttctt

SEQ ID NO: 73501 - DNA, 601 bp, Human
ggttgtagttttagtcctactgaagttccagttcgtggaggatgtgtggagagagagagaaagagtggatgagaaaggaaaaaaaagttggctaaataatgatgctgggggaaactcaaatagtaaaaataatattgatgacagtgttgaaaatcataggcttgaaggtactggcaggcaagtcattcttttgttgtagttgctgtcagattttactaaatggttctcttgtattaactggccatctgataattttattctacatagaaaaagtctaaaatataactgaaaattagagtamtattagcaggcaagctgggatgaatagtgtccctccaaaactcatgtccaccaagaacctgtgactgtgacctcatctggaaatggggcctctgccggggtaatcaagttaggatgaggtcatcctggatgagggtggaccctacatgcaataactattgtccctatcaggaaagacagacacacattcacaggagggaggatagccaggtgataaggaagacagggatggagcgatgccaaaatgcactaaggatggtaggccaccaccagaggctggaggaggccaggaagatgcctc

SEQ ID NO: 73502 - DNA, 601 bp, Human
gctttgaaattcaccaatctttttccttcctgtaggaaacaaagtcccaccaagacacctcctactccatgaagtcttcctgaaccataaaggtgatttcttttcttaccctcttttcaactcctacttttagagtatttatcacagactattattaaatatttctatgcaaccatgtctcctccaacctagaagaaaagattcttgccactgtacctattcatcttcatacgttcttcaataccacccacagagctttatggggacaagaaaggacaaacaggccaccaggggaacttgraggactgaatgctgataatatgctgggtccaaataatttcacccatctgagaaaagtctcggcagattaagagaaggttgtagttttagtcctactgaagttccagttcgtggaggatgtgtggagagagagagaaagagtggatgagaaaggaaaaaaaagttggctaaataatgatgctgggggaaactcaaatagtaaaaataatattgatgacagtgttgaaaatcataggcttgaaggtactggcaggcaagtcattcttttgttgtagttgctgtcagattttactaaatggtt

SEQ ID NO: 73503 - DNA, 601 bp, Human
acccctgccacttgctaaccttggggtgaaaagtcacctagcctcgctaagctcagtttcctcatgtgtaagataaatataataaggacaaaacctgcatcttggcatggttgcaggaactaaatgaggtaattcccatagagcacttagacataaaagtattcaaacaatgtcagctctcctcatggtaaagtaggtactttattttaaaatacggcaatatgaagcttcaagttaaaactaatcagatccaaattggaggagatcagggaaggtctttgcaatgtgctttgaaattcascaatctttttccttcctgtaggaaacaaagtcccaccaagacacctcctactccatgaagtcttcctgaaccataaaggtgatttcttttcttaccctcttttcaactcctacttttagagtatttatcacagactattattaaatatttctatgcaaccatgtctcctccaacctagaagaaaagattcttgccactgtacctattcatcttcatacgttcttcaataccacccacagagctttatggggacaagaaaggacaaacaggccaccaggggaacttgaaggactgaatgct

SEQ ID NO: 73504 - DNA, 601 bp, Human
ggcatgtctagaataagtatgtgtatgttaagtgttttatgagtctgtgtatttttgtgtattgaaggtcagagaaggggcttctgcagctttttaaaacaggaagaacagccacagtatgtttcagaattctcaagacagaggaagacatttagagtattgtattagattcatatggccactaaaatattattgtatattatttctgaaaaaggtggttcagaagatattataaaaatttagcttgaaaaataaatctgtacatatttgttctcttccatctttttttttttttttttttaagataatgggcaaggccgggcacagtggctcacgcctgtaatcccagcgctttggaagggtgaggtggggggatcacaaggtcaggagatggagaccatcttggctaacacggtgaaaccccgtctctactaaaaatgtgaaaaaaaataaccgggcatggtggcgggcacctgtagtcccagctactcaggaggctgaggcaggagaatggtgtgaacccgggaggcggagcttgcagtgagccaagatcgcgccactgcactccagcctgggcaacaagagtgagactcagtctcaa

SEQ ID NO: 73505 - DNA, 601 bp, Human
aaagggagctaaatgagtatgttgaatctcccatgtttaaacagatgggagattaaaatttaaccatgtttaatataaataagaatttatatacatatgttatattgacctatttaccatgtactggtaatacggacttctgcttgaatcaattccaataaatatacataaaaacataactgttcccgacttcagctaaaagtggaaagaaggttatctggggatgtctattataaggctatctgggcatgtctagaataaggctatttgggcatgtctagaataagtatgtgtatgttargtgttttatgagtctgtgtatttttgtgtattgaaggtcagagaaggggcttctgcagctttttaaaacaggaagaacagccacagtatgtttcagaattctcaagacagaggaagacatttagagtattgtattagattcatatggccactaaaatattattgtatattatttctgaaaaaggtggttcagaagatattataaaaatttagcttgaaaaataaatctgtacatatttgttctcttccatctttttttttttttttttttaagataatgggcaaggccgggcacagtggc

SEQ ID NO: 73506 - DNA, 601 bp, Human
ttatattcataagctctgttgtttttgagtgttcctttttatagcattctatacttgttttatggatgcagtatctatttttctctgaagatattaaaaatagttttttagattctcttctttacactataatctgtttcttacaagctgctttcttcatttgcttccacttgtctttcacgttagctcccttcttcaaatgaacagcaaaacttcgttttctgcttttgtttaaaagtgggacacaaaaaagctgcatgcctgggtgaggcttcctgactgtgatcctgctcgtggaggsatgtggccaagcagttggactggggttccctgaagtcagtacctttgggtttattttcttatgctgatcacatcccccacagaacgctcttccaatctcctgtcaggaagacaagcacctggctgctagtgatctgggaggtgagttgaggaaaaaggctggactgtccaaaatttaaactactcaactcctctgctttcatgacagcagctcaccctcagcaaggtctgcgttttccctagtccagaggccctctgtttcatcctcgccaaataacaaacctccagtcttgggctagca

SEQ ID NO: 73507 - DNA, 601 bp, Human
tccaccagcttcatcttgctgtctgctgctcctgcctgtgcggccggacctctgggcctgttcctgcctgtgcggccggacctctgggcctgctcctgcctgtacggcctgatctctgggccttctcctgcctgtgcagcctgacctctgggcctgctcctgcctgtgcggcctgacctctgggcctgctgcacagctcaggtcttggagcctcccttctccacctgctggggtggttttctcccatgctgggccccctgtttcctggtctcctatcttttttctcaggttcttcccttgytctgcaggaacacaccctttagtagctcctgtgaaaggctatatggaagataaaatttttgaaactttgaatatctgatcattctaccctcttatttaactatttggctgttttagaattctaagttggaaaatatttttgctcaaaaggcacagcttcaccgtcttctggcttccagtgttgctattctgtttctttatgtgcaatctgcgttttctctctagaagcttgtaggagtttctctctccatgtattgaaacttcacatttcagtactgggtttggatctatttttatccac

SEQ ID NO: 73508 - DNA, 601 bp, Human
taatcagccccgacagctggagaagccaataccttgaaatgtcctaacatatatctcctattggtttctgtttcctgattagactctctgactgatacagagatcagcaaaactgtacttttcatttataagttgtcatagcaatgatgtatcaattcattaatttctcatttcatgtcccttttttaaaaaaagtttcatttatgcatgggggtcaaggttatagagatacattgatcactgacaaagtttttacacacactgtcattcttctatgacttctaataaaagtatctactayatttctaagaatccccagattataaaatgagtctttaccaattttatagcacgtgctatatcaaaggttaaaaaatttaagttaaattagatcttaagtttcacacaacatggacgcaaatgatctgcaaaagcttaaacctttaggacctaaatcgaaattacagtctataaaggcattctaattttaagttaataaagactatttataaatgcgattaacatttcataatattaaactttactcacttaacaccatatctgtctctaaacataatgtggtcccgaaatgtgcggttga

SEQ ID NO: 73509 - DNA, 601 bp, Human
ccacagtgtgtaagttacaggatactaaagcagaagtgtgatcatctcccaaagacttggcatcctcacgtggggaaagaattagcacatttcagctgtgagcagaataatggtatcatgttagatggaaggatgacttggttactatcttacttggaaattgtttaaggtggtgtgtgtgagtgccaagttgacaaggctggactgcagtggttggctttgggtgtcaacttggctaaacaacaatccccagatatacaaaacactgatctaggtgtcactgggaacgtattttgtagaytgataaaaatccataatctgttaactttaagtaggagagattatcctagaagacctgggcaggcctcattcaatctgttgaaaggccttaagggcagatttgaggtttccctgaagaagaaactctgcctgtggccagcagcttcagctcatccccgaggcccagactgtcctttcccatggcctgccctgtggattttggccttgcctaatcagccccgacagctggagaagccaataccttgaaatgtcctaacatatatctcctattggtttctgtttcctgattagactctctgac

SEQ ID NO: 73510 - DNA, 601 bp, Human
aaagatccacagagctaaagagaccatggagaccacctagctctgagatgcagaaatgtgcccacagggccctgctaagtagggagtacctcagaatacaactcaaagaccttgggcaggcaggccccaacttaccgtgttataaatagaataggcagcaagcacatggaataaggattgttgcctagagaaaaaaatttacattaaatacaatttagtaatttcacatattttaaaaattacaaacttaaaaaaataaaccaaagactgactgaaaacagataatccagataaaattactaatgtaataaattatcccaagttcaaattcaaacaacactctaaaaagtctaaattcaagactagataatattcattctgaaaggatttataccaagaaaacacaaaacacttcaaaattcctaaaatttgttgccttcttttgctgatctatctcactttgagacccttctgatagaagcagctggcttgacagaatggtggaatggccttttgaaggctcagtgacattgccagcaaggtacaataccctgcagggaaagggtgatgtccttgggatgctgaatatgctccatatcag

SEQ ID NO: 73511 - DNA, 601 bp, Human
aaagagagttataaaaagtcaagcaaaaattaaccaagccacccacttcctgtccttctaccctgtatatctgcttaaaaataaaaacaaaacaacacaaaacattacaaagcaaaacaatatggagggagagagaaaaggtgagactcactggcatactgtggtcatatttaggttcttccacttcagaatcagctctgttctaaggccctagggttatcacagggtttcagcttaaaaagatccacagagctaaagagaccatggagaccacctagctctgagatgcagaaatgtgccmacagggccctgctaagtagggagtacctcagaatacaactcaaagaccttgggcaggcaggccccaacttaccgtgttataaatagaataggcagcaagcacatggaataaggattgttgcctagagaaaaaaatttacattaaatacaatttagtaatttcacatattttaaaaattacaaacttaaaaaaataaaccaaagactgactgaaaacagataatccagataaaattactaatgtaataaattatcccaagttcaaattcaaacaacactctaaaaagtctaaattcaagac

SEQ ID NO: 73512 - DNA, 601 bp, Human
agtggaaccaattttatgtgaaaaaacaaaaactacacttgaaatataaaactacttaattattaccttttctttaaaaacctaagtgtcatttctcaattactgtttttttgacaagttgttatatatcacaatatccagtcaatggtaaacatttcactaaaatgataatttcatgaccatctaaaagttttgattaaaaggcatcttttatttctcccaataatatacctgttcttaaattcctccaaacctaaattagtttcttttgaccaagggcaagtaaggaagaattttaaartgccaacaatataccttggagtaaagacaaaggaaaataaatgtaaatgttttagaaaagttcaataatgaaaaatgaaagaagaaactagtaacaaatactaatgaactcaacgagccctgagacattaaatttgctgtatgtaactcttgcaagcatctttggttttgttttaatctacttttttccctaccttgattgtttagataaagcacagggttttcttaccatgcatggcatgtttagggcctgagaagagtttgaccagggcccagaaggcatcttcctcgttcatataca

SEQ ID NO: 73513 - DNA, 601 bp, Human
cacaatcccacgggaaagcaaaataaagactgacagggaagagcggctttcttcaagatgccttttggaatgatactgcctactggatggcaactcaatataataacatgtcttacttttagagcctatttactagatgcaaagcgcccagacccagttaccatgcagatgatatttgttaagtaattggcaagaaacactaagggagaaagacaaatgcaaacacatacatacccccctcactcttccacacacacacaatatcctcacatggtcagagtgtgagacttcacaaacaatrggctatagaaagtcataattttgaaaatattaaaacagtactttaaatatatagcaggttcctcaccacacaaagcttattcacaaactgaacttggaagatccattcttagaataactagtgttaaaattattttaaatttgatattaacacttagaataactagtgttaaaatcatttaaatttgatggcactgggaaaataattttgcattatatgaacaaatgccacttttatttccaagacaagttgtgatctaagggcgggggctgtggctcacacctgtaatcccagtatttt

SEQ ID NO: 73514 - DNA, 601 bp, Human
attaatattgttttatagattagtctagtgacaataattgctgaaggtaagctatcaaataggtttaaaagaaatgaccacttcctaaaattggacagtcttggacacaattacataccagttaaatttgcattctattgtacctcaagacagatcagcaacacaatcccacgggaaagcaaaataaagactgacagggaagagcggctttcttcaagatgccttttggaatgatactgcctactggatggcaactcaatataataacatgtcttacttttagagcctatttactagatgyaaagcgcccagacccagttaccatgcagatgatatttgttaagtaattggcaagaaacactaagggagaaagacaaatgcaaacacatacatacccccctcactcttccacacacacacaatatcctcacatggtcagagtgtgagacttcacaaacaatgggctatagaaagtcataattttgaaaatattaaaacagtactttaaatatatagcaggttcctcaccacacaaagcttattcacaaactgaacttggaagatccattcttagaataactagtgttaaaattattttaaa

SEQ ID NO: 73515 - DNA, 601 bp, Human
agtagttaggatagtagaattaatattgttttatagattagtctagtgacaataattgctgaaggtaagctatcaaataggtttaaaagaaatgaccacttcctaaaattggacagtcttggacacaattacataccagttaaatttgcattctattgtacctcaagacagatcagcaacacaatcccacgggaaagcaaaataaagactgacagggaagagcggctttcttcaagatgccttttggaatgatactgcctactggatggcaactcaatataataacatgtcttacttttasagcctatttactagatgcaaagcgcccagacccagttaccatgcagatgatatttgttaagtaattggcaagaaacactaagggagaaagacaaatgcaaacacatacatacccccctcactcttccacacacacacaatatcctcacatggtcagagtgtgagacttcacaaacaatgggctatagaaagtcataattttgaaaatattaaaacagtactttaaatatatagcaggttcctcaccacacaaagcttattcacaaactgaacttggaagatccattcttagaataactag

SEQ ID NO: 73516 - DNA, 601 bp, Human
ctgaggtagagaagtgggtctgtgtgctcccaaccacagttcagctgggtgctattctccctggatgaaggaaacagtaatagaaaacgttctctccagccttttgaactaaggggcctggtttctttggtcttccttctcttactgcaaacttgagattcagactgatgaaaaggacaagggatcccagtggaaacaaatacttaacgaaaaatattactagtgaaaccaactaactgcattctataaaagtgtgaaaatgacactaatataaacagaaaagaaccaaagacctttgcastgaagtaagcttctagtcatgagaaagaacttacaaaagtacattaccaattgatgataatttctccactgattttcaaaaaaaatttaaaccactattaaaagacaatgaagttgaagtgggtggggaatgagaaatcaaggttaaataagcctcaatttttaatgaaattttaagagtttaagcattttcttacttttgtgtaattttaagatggtgtaagacatagcagtaagaactcgttctccttcaaagatgtagatatcccatattctgaggtttagtgtaaagggagtctac

SEQ ID NO: 73517 - DNA, 601 bp, Human
cagggagagaggaagagagggagagagggggaggggggagggggagagggggggagaaggggagggagagggggagggggagagggggagggactgggggagaggggtagggagggagggagagaggtggggggtggggaggcaaaaggcagtgttggggggccggtgcggggaggaaggaaaagagatttcacgagatcagatgacagacttgaatcctggaagacacatagtcaattgttttgttctggtgcattagttggggaaagaagaactgagtataagggaagtgaaccacaamaattctgagtccttttcttgaaaaaactaaacataacaaaagtgcttttaaagggcattttcattcctatctaaagtatggataatctggcactcctgcagtccatgcttttcaagtaagcaaccaaccaatcttatagtaaagtccgtaacatgtacttagaacaatgccaagcacagcagagagaaaaactataaacaagaccctgtgcactcaattagtttataatttagttgggaagcgcaacagatcattcaagaataacctaagagagttgagtgcacaatgaacatgaaacta

SEQ ID NO: 73518 - DNA, 601 bp, Human
tcactaatgtatcactgatatctctcatttcaacaaatatgatgtgtactatatgtaagcattgtaatttacttaaacagtcttctattaatggtcatttaggtggtttttgattttttattatttaaaaccactgtgtgatgaacctccagtaacaacgtatttttaagacaatcagtaagaaaaaaaagaaaaaggaaaaaatttcttatgagctttagctaactattggttaatatgcccagaaagagtttttcttttttttaattggctaatgacaaattgtatatatctgtggtasacaatgttttgatatatgtatacactgtggaatgactaagtcaagctaattgacacatcattacctcacatacttatctgtccatagtgagaacatttaagatgtactctcagcaattttcaagtatactgtacattattataaattatagtcaccatgctgtatgacagctctccagagcttactcctactgtctaactgaaacttgaaccagcatctcctcccatcccgcagccacccttccatttcggaagctttatatggtggagacggaacttcacgtaagtctctaaccaagaa

SEQ ID NO: 73519 - DNA, 601 bp, Human
tcattttcttggaaaaagacattcaaattaaatatgaacacaaagcagaaagtaaaaatctgctcattacataataccctacataatacacctcattacataacaccctacaggtagatccaggtatttacaagtgtttatgtatatcaattgaagaatccaaattatacttttcaagttattcccctttttgcttttttccccattcactaatgtatcactgatatctctcatttcaacaaatatgatgtgtactatatgtaagcattgtaatttacttaaacagtcttctattaatggycatttaggtggtttttgattttttattatttaaaaccactgtgtgatgaacctccagtaacaacgtatttttaagacaatcagtaagaaaaaaaagaaaaaggaaaaaatttcttatgagctttagctaactattggttaatatgcccagaaagagtttttcttttttttaattggctaatgacaaattgtatatatctgtggtagacaatgttttgatatatgtatacactgtggaatgactaagtcaagctaattgacacatcattacctcacatacttatctgtccatagtgagaac

SEQ ID NO: 73520 - DNA, 601 bp, Human
tcttaattataacgtagatataaagtattggggtaattcttaccaggttctggaaggtctaactttgcccgctttagttctgtcatagaaatctgaagttgctctatcacaaaatcatcttcaaagaaaaaatcctttgccagggtctcctgaaaaaattctacaagttcttccatggacaatttcattagatgttctaagaaaggataagagaaatgaaaatgccaagtcaatagctactttaggtaggaagatattctattatattcaggtgtagtgtaaaagggcattaaaaagggcrcaagcagcatacaacttacatatggcattgaggacatcattaaaactcagtaagacaaaaatattgcctgatattaaagcagccacagagaaaagcaggaaagtttactgggagaaaggatgggaggagaatactgcctaatacttcctcattggaataaccacacctaggcattagtattaccccagagcaagagcttcttagagacagacacagaaagactacctcagccggcatgaggcctttctcttttattgatacggagctccaagaagccccattttaagtctgtatttctta

SEQ ID NO: 73521 - DNA, 601 bp, Human
actccccttcttctgctcctctcccatttaccctgcggctagctctagtaatgccccattcaccctctgttatcattctcgtatattctagctctccagtgcacaccctgagagcttctcatctttctcttcagttcttaaatccccagcaaagtagtacctagcagaaaacctattagtaggtgctgaaaaatgtcttacaataagtgaataaaatatattatctatactgtagcatactacaaagagccctgggctagtagtcagaaaaactggcctgcagtctcagtaatgctatttgtggttctgtggcttcatatttaagccacttaggcactaaagtatcaatttcctcatctataagatggggcttttactgtacttactattgctgtacttactattgtatacggtttcacaaaatgagatgaagaaagcaaaaaaaagcttattgttatgctcgtttaaagcaccatggctacttctgttgaacaacagtatttgccaaccaaacttctaaatgtaagcaggaatagtacagtcatctattaggagaggcagatttaattaatatgtttatttgcctttccctaaaataagg

SEQ ID NO: 73522 - DNA, 601 bp, Human
gctgattagacccttctcaattaagtaaataaaagcaaacatcttggtttttaccaaaaggaaaaatgtattttccatggaagtactgcttgtccttctgtacagacacagccaacatgacacactgatggggaaacgccaaattcacctctgcatgagggcatacataactgactttctttacttttcatctcttgcccatgaccttccacttccctagcctcttactacacccatccactgcaacaaaggtaagaaagaagaaaagcgaaagtaactttttctcaagacatacatggtsaagtactatctggtagaaactttgaaagttattcctcctgtgatctttcgacattttcattttcttccctcccttcctgcactccccttcttctgctcctctcccatttaccctgcggctagctctagtaatgccccattcaccctctgttatcattctcgtatattctagctctccagtgcacaccctgagagcttctcatctttctcttcagttcttaaatccccagcaaagtagtacctagcagaaaacctattagtaggtgctgaaaaatgtcttacaataagtgaataaaatata

SEQ ID NO: 73523 - DNA, 601 bp, Human
ctgctatcatttattcctccccttttctcccctgccccattctctgtccccattctatcatttcctggtaaaacgatcttacagactactgctactaggtttccctatctgcacaatgtagatgagcacttttatgagttatttttagagattaaatgagacagcacctgtggtacgtggcacacagtaaacacccaataaatattagctgctaattagatgctaagtcaccaccatcgcaatccatgacacaggttttgaattatctcacgtttaaatagttctatattttttcctctayatttgacttttactaaaatttgccttgacctctttttatagaaggaggcaaggtatttaaaaataaatgatagtagaataaaataaataaaaataaatgatagtagaaaacagaagtcattacactgaacaggagagggctgacctcacttaacaaaggcaacggctccacaaggccaaggcccacaccccattactgctgtgagggttgcttcctaggagcctggatgaccttgagcaaaccttggagcagtgctgattagacccttctcaattaagtaaataaaagcaaacatcttgg

SEQ ID NO: 73524 - DNA, 601 bp, Human
gtagagacagggtttcatcacgttggccagcctggtcttgagctcctaacctcaagtgatctgcccgccttggccttccaaagtgttgggattacaggcgtgagccactgtacccagccaagaattcgactttatggaaaaaagaagaaataaactaagaaaatcagaattaactaattcaagagctgattcttgatacaagccaattaataaagactaaattctggataattttatcaaagagcaggagaaggtacaaagaaagtgagaaatgaaaatgtaggattgttacagatataamaagaaccgtaagagattgctttgcaaaaccttacataaatatattaagaaactagaaatgaatagctttctaggaaaatataaatgaccaaatgacccacattgaccttagaagataaatcaaaacattaacccccaaaacaattatatcagacggaaatagtttcacaaatatattttcgagctgttaaggaataattttaatactatgtaaaagttccagaacacagagaaagaaggaaggcttccaaattatgaggacagtataacctgacaacacacagacgttttggttaactgc

SEQ ID NO: 73525 - DNA, 601 bp, Human
gcttctagtttgctgaaactacacagaacaccaggaaagaaaaaccagacaactcctgagtgtgcgacattccacagaatagtgggactgtgctcttcagcagctcagtgtcattcagaggaaaacaaaaggtggggtgaagaggggggaagaggaaaggtgtactgctccctgtcaagcgacttaagcccataacaaatacaaaatgtagccctgactaagtgctggtgagaaaaacagcttaacaggcagcctaagggacaactggaaatcttcccacatggagctggcctgagatgaygctgaggagtcacactgtagtcacactgttacacttgttagtgtagcaatggcattgtggttggctgggggaaggtccttgtttcttggctacagagacaagtatttgaggtgaagtatcctgatgtccttattttcactttaaaattgttcaaataagctgggcaatgggtacctgggaggaagtcattatacatttccttacttctgaatatgtttgaaaagtttcacaataaaaaagtttcaaaaaatgtttcaacagcaactacaaaacatacagaaataaaataaaggtacaaaa

SEQ ID NO: 73526 - DNA, 601 bp, Human
tttttttaattaaaaaaacttttattttaaaacaaaaagatatgattatcgtcagcaaactcagcatctccagtattaagaaaacagtagtcactgtgggactcctgtctaatctaaatcttattaaactgctacatctagcttctagtttgctgaaactacacagaacaccaggaaagaaaaaccagacaactcctgagtgtgcgacattccacagaatagtgggactgtgctcttcagcagctcagtgtcattcagaggaaaacaaaaggtggggtgaagaggggggaagaggaaaggwgtactgctccctgtcaagcgacttaagcccataacaaatacaaaatgtagccctgactaagtgctggtgagaaaaacagcttaacaggcagcctaagggacaactggaaatcttcccacatggagctggcctgagatgatgctgaggagtcacactgtagtcacactgttacacttgttagtgtagcaatggcattgtggttggctgggggaaggtccttgtttcttggctacagagacaagtatttgaggtgaagtatcctgatgtccttattttcactttaaaattgttcaaataagc

SEQ ID NO: 73527 - DNA, 601 bp, Human
ggacacattttatttaaattgaaatttgatacattgaaaggaaactggatattacatttataaaggcaattaaaaacgtttgtaggaatttatgtttataagtggaaccaaacattaaagttccattagacgagaatgttaaaatttgccagattttaaaatactatactaacttttgtaaactgaattaaatgtaaggaagaaatacgtttctaaatttgtgagtttaataaatactaatttttaaaatctaaataatcctgtgcatagaaaatttgtccttgaattaatgatttttttwaaaaaaaacttgcatcaacaaatgactactgcaaagggctgctggaaaaaattaagttaatatgtgaattcaaagcatttagcaaaaaatctatcatagaagactcagtttgctgttatcattactactatgtgactcaaaagcggccggggaggtgggatgtgaagtgtggaagctgcggacagaaaagtgctataccttacactaaggagtgtggatgttctcccgtaagcactgaagtaccccgaaggctatggccatttaccaagactaaaatggctctgtcaactattctgagaa

SEQ ID NO: 73528 - DNA, 601 bp, Human
aaggtgattaattctgtagttttttgcattaaggaatctgtttgtatttagaattttctgtgttttatatatttatatttcagagaatttggccaagttggccttcttatgccaatttaaaaatatgcaaatgagtcactgatttgaactttagattttaaacttataaagagtatactgaaacaaaagacttaaggttcaggatattcttaaggttgaattaattagatttgtaagttttttagaactaggacacattttatttaaattgaaatttgatacattgaaaggaaactggatattacatttataaaggcaattaaaaacgtttgtaggaatttatgtttataagtggaaccaaacattaaagttccattagacgagaatgttaaaatttgccagattttaaaatactatactaacttttgtaaactgaattaaatgtaaggaagaaatacgtttctaaatttgtgagtttaataaatactaatttttaaaatctaaataatcctgtgcatagaaaatttgtccttgaattaatgattttttttaaaaaaaacttgcatcaacaaatgactactgcaaagggctgctggaaaaa

SEQ ID NO: 73529 - DNA, 601 bp, Human
tgaaaataccacattttttatatttctcattggtgtttgcctaagtggtatttttacggcagtgctaacaattagaataatcgcttcaacaaaaaggaatgtaacttgatacattttagaaaaaagcaaaaatgtttattattttcttcttaagtaactttttttcttaaaaaagaagccaacaaaataatattctaacagtccctaaaaagcaaggaagagtccctctcaggcccttcaggcttgtccctgcttgatcttactctggtctctgtcaccccccagtggacgccacactcawctacaagcctcgcccatcaacggcctctgaggccttagcaggtttttgcacctgacaagaggcgcatcattgcagcaaagcgctctaagtgctcgctctgtgagcagcattctacctttacactttcaatagaagaatacacacactctgactgttctaacagttttcgggaagaatcggtggggggccactatcaggaaaataattctactattctaggaaagagttatccccttccagatcaaacagtaagtccaattgtatttttaaatattgctgacttcaaatatactatctgaa

SEQ ID NO: 73530 - DNA, 601 bp, Human
acagcattattaggagatatacctaatgtaaatgacgagttaatgggtgcagcacaccaacatggcacatgtatacatatgtaacaaacctgcacattgtgcacatgtaccctaaaacttaaaaaaaaaaaaaaagacttactgccctactccttaaagggtaaggaggcaccacaactcctcacagatacagtaggggatgcttttgtgaaaataccacattttttatatttctcattggtgtttgcctaagtggtatttttacggcagtgctaacaattagaataatcgcttcaacaawaaggaatgtaacttgatacattttagaaaaaagcaaaaatgtttattattttcttcttaagtaactttttttcttaaaaaagaagccaacaaaataatattctaacagtccctaaaaagcaaggaagagtccctctcaggcccttcaggcttgtccctgcttgatcttactctggtctctgtcaccccccagtggacgccacactcaactacaagcctcgcccatcaacggcctctgaggccttagcaggtttttgcacctgacaagaggcgcatcattgcagcaaagcgctctaagtgc

SEQ ID NO: 73531 - DNA, 601 bp, Human
ggaggcctggcgtggtggctcacgcctgtaatcccagcactttgggaggccgaggtgggcggatcacgaggtcaggagatggagaccatcccggccaacatggtgaaacccagtctctactaaaaacacaaaaaattagctgggcgtggtggcaggcacctgtagtcccagctacttgagaggctgaggcagaagaatggcgtgaacccaggaggcggagcttgcagtgagccgagaacgccactgcactccagcctgggcgacagagtgagactcttgtctcaaaaacaaacaaacaaamaaaaaaaacaccaccaacaacaaaaaacacccacataggaattggaataaagacttactgccaaccactatgagataccatctcacaccagttagaatggcaatcattcaaaagtcaggaaacaacaggtgctggagaggatgtggagaaataggaacacttttacactgttggtggggctgtaaactagttcaaccattgtggaagtcagtgtggcgattcctcaaggatctagaattagaaataccatttgacccagccatcccattactggatatatacccaaaggattataaatca

SEQ ID NO: 73532 - DNA, 601 bp, Human
caaggacgccatgccaggatctggcctctactatgatgaagaggaaaatctccttgacttcattacagaggcggttcctttctagagattaattattcaacctccactgaactgaaaacacatcatgcagaccctgtaagaaggacgaatgccatcaccagtaacatttttatatgccaattagtattctctacccttcttcacagaagtaggtccaaataaagcattcaacattttggtgtgatctattttcagagctatctcagcctgcttgaactaccacccctaaccccaccacacraacactgctctacttgtctttggtttaaatatctcctttcacccctaagcaactaactgtaactaaaacattcacacataattgatgtcaaaacagaaaactatatataggcaataagcattcctatttattatccacgcttgcattctgggcttcttttcaatagacagaatcatgtttttgctcactccactacagtctcatgcctaaaattttattttccctttcctctccctaaaaacacaggaattggaggcctggcgtggtggctcacgcctgtaatcccagcactttgggagg

SEQ ID NO: 73533 - DNA, 601 bp, Human
tttaacacgttccatttattgaatggacaagaggccaaaatgcacactggggaaaaacaatctgtggctgttctgcaatgtccaaaaagcagcatcttaaagttctttcatggcagcccctaatatcttttccctccccctagtaggctataacctacttacttcttttgtattccttcccatagtatctaaaagcataatacaatcacaaggaaggtgttgacaatgttcgttcactcaactattcatatgagttagagtaatgacacactgtccatatacacaggcagaaacctgaggkttataaatatccaagatccatattgctaagaaattagatgtagcagggttcgggggggaagaaatccagtacagacaaaatgacgctgcctctaatccattcctaaatgataacctctctttaggaactactgtttaagaggaatatggcaaatacctcaactgtagaaaaacatttagaggttatggcctctttgctctgcagagattttcaataaggatgcaaaaggcaggagacagggatataagaaagcctttcaaatacaggtgctgaaaaacccattcctccacattttaaaga

SEQ ID NO: 73534 - DNA, 601 bp, Human
ggaaaaatgcggaacacctttgaggaaaatgttgccatggcatggtctattcctatgttgtgatattcacagattttcattctggaatcctttagccacagaggaggcacatatcagtaaagactgagctggacacatagtaaaatgtagaattaccaatataaggcatgtgtttcttaggagaaagaaaaaaccaattgagaagtaatggaaggactgaggtggtaatttcaggcacaaaacaaaatgcaaaggtatgtgtcatacatacgtaggagatttaattttttaatataaggastaagaaaaatatttaccttataattaattctactttatattccagtaaacacagaaatgtctctctctaaggaagagggcctaatagtctacacatcacacatctatgcatcatattagaattaaaggaaaagtttaacacgttccatttattgaatggacaagaggccaaaatgcacactggggaaaaacaatctgtggctgttctgcaatgtccaaaaagcagcatcttaaagttctttcatggcagcccctaatatcttttccctccccctagtaggctataacctacttacttctt

SEQ ID NO: 73535 - DNA, 601 bp, Human
gataggcagacagtgcagggctctactattttcccacattttgatggaaaatggaggcagaaactaacctgcccaaaggctcaccactagcaagtcacaggtccagaattcaaaccctaagctgattccagagcctttgatcctcctcctccactataccaccgtggaggcagtgagaagaagttgcttcctgggtaattgttaaggcagtatctgcacacctgctcaatgtgttagatgtgaactgtgaaagagcaagcagcgcatagcataactcctggcctgagacagccacaggcaratcctattctggaacagctggcagaacccacgttgttcttataccttttggtaagaaatatattttataatatgtggaccaattatttcaattggcaacccaaactttaaaatgcttgtaattcagaaaagttttctttgttttatgaatgtgtatgtgaaataaccttgaaatgccaggaatggagaaagtagactttaaatactagcaagtcaagaatacttcaagtagttattcagcacatcaggttaaaaagtagcaataaaaataaaattaaaacctatccagattcctccaaaa

SEQ ID NO: 73536 - DNA, 601 bp, Human
aaagagaaaggctaagtaagataatacacgagtaaacagtagccagttgaagcaatccattagtaacaatggcatgcttttcatctgtgcacagatacacgctgacatacaacacactgtcatacaacacactgtttataccacttacacacactgtttataccacagaaagttggtagctgatgagaggtgttttttagagactgatactaaaacataccaacactcacaattaggccaaatgtacagagcaggagagtgccagcaaggaggcggtcctctgagcatgggccttgagtcrgggacaggcaggcacacatgcagccttgaagagtgcggcaaggaatctggattttattccaagttaactataaaatactagaggcttttcagcagaagaattacacgacctcatgtctatcttagaaaaataactttaatggtggccgggatttcgattgtggtactactgaatgatgtgacactaatggctggtactcactaggcagtcactgcgcgctggccactgctcagaaagctgtacctgtaaggcctgcgataggcagacagtgcagggctctactattttcccacattttga

SEQ ID NO: 73537 - DNA, 601 bp, Human
tgactcttggatggaaagcccgtcccgattcctgtagtggtaggctggaggcgggggccctgaatatggatatccagatggactggcatcttctgcggccggtgaagctttatatctcacgggactatctacagaaactgcagggaggccatggtcctgaaagggtgcgagttgaaaggctgagtattttggtaaattgccacggctagcatctcgggtccatgattgtccctgcgtctcaggtctgtatgtataactaacttctgaccatgttctgttatctggcaagtaatccactggyggaatgatcaattttccattctttggtgaccctgaattgcccgaatatcccccagcaccagtgtcaacagggaggacttctattcgactagacggcagtacaagggggcttgggcggctgtaagatttctccggagaagcactgacggaaagagtagaaccatgaggtctcctggaaggattcagttgagtcccagggctaaactgtggagaagcaaagctgctgttggcagtagggaagtgtttgggagagtttccgtggtaaacggggggattgctgtaggaggggggatgagctagc

SEQ ID NO: 73538 - DNA, 601 bp, Human
gtggcctattttattaattttttcaaaaaaaaaaaaaacaactcctggattcgttgatcttttgaatggttttttgtgtcttgattttcttcagttcagctctgatttttgtcatttcttgtcttctgctaggcttggggttgatttgtttttgcttctctagttctttcagttgtgaagttaggttgttaatttgagatctttctaagtttttgattcggacatttagtgctatgaatttccctcttaacactaccctagctgtgtcccaaagaatcaaagaacaactttctacccatcmctagaagtagctctctggggccaggtgagaacatcagccttttccctcagtttttctccagttgcctatccttttcattaactgattcagcctccacccccagcccagtcccaactaggccagagctggcctcagaggtctgacacagcccctcctttgcaagaggggaaactaaggcacaggtcaggcaagagacttgtttagggtcacagagcaggttggtggctaagctgggactggaatgcaggtttctggtccccaagactgatcagcagcctgtgccctgggagtgggaacaaa

SEQ ID NO: 73539 - DNA, 601 bp, Human
agcctctcaagtagcttggactacaagtgtatgccaccaagcctggctaattaaaaaaaaaataaacaactttttatagcgatggggtctcattatattgcccaggctggtcttaaactcctgaactcctggctggggctgggctgtggagcctggaaagtgtgatggagggatgagcggggctgtcccctccaagacccagctcctttctggaggactggctgtgtctgcaggggcacactcttacctctgtgctgactgagacccttccagttgactctgaacccactgaggggccacrggtgcttgttagacgcaacaaactgggtccagaagcctgatgtggactttgagactcttggttgcgagtgacagaagctcaaactggctgaagctgaaaggggcattgcttgtcccatgtggttaaatatctagaggttgcgtaagcttcaggcacagctggctcctgtgaccccaggaggtgttgccaggcccctgtcttgtgccagttctccatgttggtgtcagtttcaggtgggctctctccttgtggtggctcgggtgtctgctgacagtgtcaggtcaccgacaaaagagaacg

SEQ ID NO: 73540 - DNA, 601 bp, Human
aagcctggctaattaaaaaaaaaataaacaactttttatagcgatggggtctcattatattgcccaggctggtcttaaactcctgaactcctggctggggctgggctgtggagcctggaaagtgtgatggagggatgagcggggctgtcccctccaagacccagctcctttctggaggactggctgtgtctgcaggggcacactcttacctctgtgctgactgagacccttccagttgactctgaacccactgaggggccacgggtgcttgttagacgcaacaaactgggtccagaagccygatgtggactttgagactcttggttgcgagtgacagaagctcaaactggctgaagctgaaaggggcattgcttgtcccatgtggttaaatatctagaggttgcgtaagcttcaggcacagctggctcctgtgaccccaggaggtgttgccaggcccctgtcttgtgccagttctccatgttggtgtcagtttcaggtgggctctctccttgtggtggctcgggtgtctgctgacagtgtcaggtcaccgacaaaagagaacgcctctttccctgggtcagcagaagtccaaagagagcct

SEQ ID NO: 73541 - DNA, 601 bp, Human
cccatgtggacaccttccccacaggggagtcccctcttctttaaaatggggctgctcaccctgctctaccactggggtggtcgtgaggtgagagtaagtaagggaccccctgggactgcagtctcctcaggaagaggggacgtgatacctctgctcttggtggctttggagttcagacaggacccatgcggtgtgggtgagggagtgacagggaggcagggcttgccttgagctaagggaggactcagggccagaaaaagtgcccagtgatggaggagactgccctgagaggtggtgagcmcccccgtcatggaggtgtgcaagctaacagcagggtcattcaatccgggagccctggattggatgtgtctcagacatggcagaaggattcctttatccagggccttgtggggaggccctccctgttgccaactgagtcgagggctggtggaagaactggtgattggacaggaggccttgaaaacttcccgggcagggggtgcctctgggtctggctttggcggggtggctcctagggaggagctggcctggggacatgccactggtggtgggttcctgggccccctctggagatgtgatc

SEQ ID NO: 73542 - DNA, 601 bp, Human
ctgggctcagttctgcatctgtgagacggtggtgccaccttggcctttgccggttgtgaagatgagagtgaatgtgtgtgcaggtgccgggggtgacaggaactgctgctgttattactgcaaagggctattttggggtggggggtgctgaattgaatgtatctcaggcagggaccttatcttgtttggcaacccccacagcacagggttggatgtatatggttagcacacagtaaatgcctcttgtggaatacagactgattagtttagatttagaggttgtaaactagtgggctgcaawtattgaaaaatttgaaatcagctgccaacatttaaaaatcatcatttcacgtagaaatcagatttgtagcctgtctgagcactttgggcactttgacagctcttggccacatccctgaagggttgcccctcgttgaacaggtgccaaggcctgtagacacctgcccaggcactgaaggggatggggcccccagcaaatgaccccttcctccttccccaaatatgtggttttaccattttgttcctggtgtgtggtgatggaataggaacttccagaggaaatagagcctgaggtggctcc

SEQ ID NO: 73543 - DNA, 601 bp, Human
tgggctcagttctgcatctgtgagacggtggtgccaccttggcctttgccggttgtgaagatgagagtgaatgtgtgtgcaggtgccgggggtgacaggaactgctgctgttattactgcaaagggctattttggggtggggggtgctgaattgaatgtatctcaggcagggaccttatcttgtttggcaacccccacagcacagggttggatgtatatggttagcacacagtaaatgcctcttgtggaatacagactgattagtttagatttagaggttgtaaactagtgggctgcaaayattgaaaaatttgaaatcagctgccaacatttaaaaatcatcatttcacgtagaaatcagatttgtagcctgtctgagcactttgggcactttgacagctcttggccacatccctgaagggttgcccctcgttgaacaggtgccaaggcctgtagacacctgcccaggcactgaaggggatggggcccccagcaaatgaccccttcctccttccccaaatatgtggttttaccattttgttcctggtgtgtggtgatggaataggaacttccagaggaaatagagcctgaggtggctcct

SEQ ID NO: 73544 - DNA, 601 bp, Human
agaggaaatagagcctgaggtggctcctggaattgaggtggccccagggatctcatactagcaggtgctggttggggacttggggaccctggatatcctgctttttgcctttgggggctgggggctcacctggccatcttccctccgctggaccagctgtcctttgaagcttctgctggcggctggccatttgtgccctgtgactgctctgagctgtcccgtgtctcacagcctccctgccctctgcctctggccctgtcctggttccaatctgaggcaggcctggaggacactgggggcstggactcttggtccagggttgcccccttcatgcaaggttcctgctgggaatatggcagctgtccccaagtccccattgctgtgtgagggattgcacaattttggtaattttccttcctttggagactgatggggatccctggggagagagagcccagactagcacacaggagatataagggctggcaggcgtaggtgtgattcacaagcctttttggaatcaatgaatatgctaaggaatgaatggtgctggggaaagaaggaacccatatgggctgagcatggcaagtgtggggtcagc

SEQ ID NO: 73545 - DNA, 601 bp, Human
ggctgggggctcacctggccatcttccctccgctggaccagctgtcctttgaagcttctgctggcggctggccatttgtgccctgtgactgctctgagctgtcccgtgtctcacagcctccctgccctctgcctctggccctgtcctggttccaatctgaggcaggcctggaggacactgggggcctggactcttggtccagggttgcccccttcatgcaaggttcctgctgggaatatggcagctgtccccaagtccccattgctgtgtgagggattgcacaattttggtaattttcctwcctttggagactgatggggatccctggggagagagagcccagactagcacacaggagatataagggctggcaggcgtaggtgtgattcacaagcctttttggaatcaatgaatatgctaaggaatgaatggtgctggggaaagaaggaacccatatgggctgagcatggcaagtgtggggtcagctcacagtgttgtcacaaaggggccactgtgtccctctctgagactcagctcccttttctgtgaagcacggcttgcagacatctgaaatttgtatcagtgggctatttaaaaaaat

SEQ ID NO: 73546 - DNA, 601 bp, Human
acactgggggcctggactcttggtccagggttgcccccttcatgcaaggttcctgctgggaatatggcagctgtccccaagtccccattgctgtgtgagggattgcacaattttggtaattttccttcctttggagactgatggggatccctggggagagagagcccagactagcacacaggagatataagggctggcaggcgtaggtgtgattcacaagcctttttggaatcaatgaatatgctaaggaatgaatggtgctggggaaagaaggaacccatatgggctgagcatggcaagygtggggtcagctcacagtgttgtcacaaaggggccactgtgtccctctctgagactcagctcccttttctgtgaagcacggcttgcagacatctgaaatttgtatcagtgggctatttaaaaaaataaacaagatttttgctgggtacagtgcctgaaagcttaacacttcggaggctgaggagggtagattgcttgagcttaggagttcaagactagcctgggcaacatggcaaaaccccatctctacaaaaaatacatggcctactgcagcctaagtctccccaggctcaggtaattc

SEQ ID NO: 73547 - DNA, 601 bp, Human
gcacaattttggtaattttccttcctttggagactgatggggatccctggggagagagagcccagactagcacacaggagatataagggctggcaggcgtaggtgtgattcacaagcctttttggaatcaatgaatatgctaaggaatgaatggtgctggggaaagaaggaacccatatgggctgagcatggcaagtgtggggtcagctcacagtgttgtcacaaaggggccactgtgtccctctctgagactcagctcccttttctgtgaagcacggcttgcagacatctgaaatttgtrtcagtgggctatttaaaaaaataaacaagatttttgctgggtacagtgcctgaaagcttaacacttcggaggctgaggagggtagattgcttgagcttaggagttcaagactagcctgggcaacatggcaaaaccccatctctacaaaaaatacatggcctactgcagcctaagtctccccaggctcaggtaattctcccaccttagcctcctgcatagctgaggtcccagctacgcaggagtctgaggtgggaggattgcctgagccctgggaggttgaggctgcagcgggctatgatc

SEQ ID NO: 73548 - DNA, 601 bp, Human
agctcacagtgttgtcacaaaggggccactgtgtccctctctgagactcagctcccttttctgtgaagcacggcttgcagacatctgaaatttgtatcagtgggctatttaaaaaaataaacaagatttttgctgggtacagtgcctgaaagcttaacacttcggaggctgaggagggtagattgcttgagcttaggagttcaagactagcctgggcaacatggcaaaaccccatctctacaaaaaatacatggcctactgcagcctaagtctccccaggctcaggtaattctcccacctyagcctcctgcatagctgaggtcccagctacgcaggagtctgaggtgggaggattgcctgagccctgggaggttgaggctgcagcgggctatgatcacaccacttcactccagcctgggtgacagagtgagaccccatctcaaaaaaaaaaaaaaaaagagagaaagaaaatgcagttttatgtggagcttactgtaacacagatgcagggggctaccctggctgaagcaggcatgggggcctgagcctatgcccccccaccttcccttcccattgggggcctgatgcatgtccccaaatc

SEQ ID NO: 73549 - DNA, 601 bp, Human
cacttcggaggctgaggagggtagattgcttgagcttaggagttcaagactagcctgggcaacatggcaaaaccccatctctacaaaaaatacatggcctactgcagcctaagtctccccaggctcaggtaattctcccaccttagcctcctgcatagctgaggtcccagctacgcaggagtctgaggtgggaggattgcctgagccctgggaggttgaggctgcagcgggctatgatcacaccacttcactccagcctgggtgacagagtgagaccccatctcaaaaaaaaaaaaaaaaagagagaaagaaaatgcagttttatgtggagcttactgtaacacagatgcagggggctaccctggctgaagcaggcatgggggcctgagcctatgcccccccaccttcccttcccattgggggcctgatgcatgtccccaaatctcagggctcctaggatcacagcttggaaccctctgtgcctggaggcatgagactcactggaaaatgaagtgaatgtggtgattgcaccaggaccatggggacagagcagagcctggaaacagacaccatctgtgtgtgatcacctgacttatgacag

SEQ ID NO: 73550 - DNA, 601 bp, Human
ctgtttatctgtgctgtccagtacagcagctgcatgtagccattgggtatttgatttttttttttttttgagatggagtctcactctgttgcccaggctggatgcaatggcacgatctcagcttactgcaaaatttgcctcccaggttcaagccattctcctgcctcagcttcccgagtagctgggattacaggcacacgtcaccatgtccggctaatttttgtatttttagtggaggggggttttaccacgtgggccaggctggtctcgaactcctgacctcaggtgatctgcctgcctygacctctcaaagtgctgggattacaggcatgagccaccatgcctggctggctgttgagtatttgaaatgtggctagtgtgactgagggactgaatttctaattttattttaaattaatttaaatttaatttaaaatagtggctgggcatggtggctcatgcctgtaatcccagcactttgggaggctgaggcaggaggattgcttgagcccacgagttcaaaaccaccctgggcagcagggggagacgcccatctctacaaaagagaatttaaaaattagctgcacacctgtagtcccag

SEQ ID NO: 73551 - DNA, 601 bp, Human
ttaaaatagtggctgggcatggtggctcatgcctgtaatcccagcactttgggaggctgaggcaggaggattgcttgagcccacgagttcaaaaccaccctgggcagcagggggagacgcccatctctacaaaagagaatttaaaaattagctgcacacctgtagtcccagctacgtaggaggctgaggtgggagaatcacttgagcccgggagtttgaggctgcagtgagctatgatcgtgccactgcactccagcctgggcaacagagtgaggccctgtcttgaaaaaaaaaaaaaaaagcagccacatgtggctagtggctactatcttggacagtgcagtcctagaagacacaggggactagctttacgacaacaggacataaaagttaggttagggttaagatggataaatcagacttggtgctgtgaggcctgggccccgctctccctgatgctagccctcccctgacttggaccattaggtcaagttcctgtctgcttcgtctccgcagagctgaggaactgcgtgtggagtcagcccagtctggatgcacaggaggatgctggcggcacagtgagtgaggcctggtgccagag

SEQ ID NO: 73552 - DNA, 601 bp, Human
gaggccctgtcttgaaaaaaaaaaaaaaaagcagccacatgtggctagtggctactatcttggacagtgcagtcctagaagacacaggggactagctttacgacaacaggacataaaagttaggttagggttaagatggataaatcagacttggtgctgtgaggcctgggccccgctctccctgatgctagccctcccctgacttggaccattaggtcaagttcctgtctgcttcgtctccgcagagctgaggaactgcgtgtggagtcagcccagtctggatgcacaggaggatgctggyggcacagtgagtgaggcctggtgccagagctgtgcggaccccttgttggccatggagcagcaggcccagaggccctctccccagccctgcttgcctgcctcggagaggacagaggcctaggcccacgggggagggtgttggcagacagatgccctccaggccctggggcctccttaacggccccttaacgacacgcgtgccaagggtggaggatgccagccaaggggcgctacttcctcaacgagggcgaggagggccctgaccaagatgcgctctacgagaagtaccagctcaccagcc

SEQ ID NO: 73553 - DNA, 601 bp, Human
gtaatcatcctggcttatcctcctgagtagctgggagtacaagcatgcacgaccatgcccagcctctctaactttaattcagttttgaagtctggagtggtttcagacattacattaacttgtccagataaactactctcatttttctccatgatgaaattcgattctactgaagacctgggtcagggatggcctgtgtatcactgccctcacttcctgtacccatgcagacatcattaatcaatccctacattccacactgagcctgtctacattctcagaatcctccttttgttttttktttgtttgtttgtttttgtagagacatggcctcgctatgttgcccaggctggtcttgaactcctggcctcaagtaatcctcctgccttggcctcccaaagtgttgggattacaggtgtgaaccactgtgcccggcctcagaatcctttttaacacagctctccaggctggcaccacctatgtcatttccggcccaggcacttgccttggtacagccactagctgtgtttagctattgagcatttaaaaagtgggtaatgtgactgaggaactgcatttttcaaaaaaaagagttttgctc

SEQ ID NO: 73554 - DNA, 601 bp, Human
gcaggcagggaggatgggggccaaggaggccaggtctgggacctgatgctaccctgcctgtcccccgctggtccctccgccggtcgctttgctggtccctctgctggtctgcccacccacacccaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcaggtgggcggtgagacgtgtgattagcrtatcccggggactgggcccaccgttccaccggcccccaggcggcctccccgccctatctggaggctcagacccctgcccatatagggattgggagagggccccatggttccaggtcaatctggggccctccctgggtctcagaacccccacttgtgggcaggatcagatcagggctcttaaattagagaatttagattggtattgaaagatctagcacacccccaaaactgtaaaactgtgtgagcaaacatagcttttgtgaaggaaggggtcctttcagatggttctcaagggagcac

SEQ ID NO: 73555 - DNA, 601 bp, Human
gggccaaggaggccaggtctgggacctgatgctaccctgcctgtcccccgctggtccctccgccggtcgctttgctggtccctctgctggtctgcccacccacacccaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcaggtgggcggtgagacgtgtgattagcatatcccggggactgggyccaccgttccaccggcccccaggcggcctccccgccctatctggaggctcagacccctgcccatatagggattgggagagggccccatggttccaggtcaatctggggccctccctgggtctcagaacccccacttgtgggcaggatcagatcagggctcttaaattagagaatttagattggtattgaaagatctagcacacccccaaaactgtaaaactgtgtgagcaaacatagcttttgtgaaggaaggggtcctttcagatggttctcaagggagcacaggacccccagaatgag

SEQ ID NO: 73556 - DNA, 601 bp, Human
aggaggccaggtctgggacctgatgctaccctgcctgtcccccgctggtccctccgccggtcgctttgctggtccctctgctggtctgcccacccacacccaggagaacctgctgctgtcagtgcttccggcccacatctccatgggcatgaagctggccatcatcgaacggctcaaggagcatggtgaccgtcgctgcatgcctgacaacaacttccacagcctctacgtcaagaggcaccagaatgtcaggtgggcggtgagacgtgtgattagcatatcccggggactgggcccaccrttccaccggcccccaggcggcctccccgccctatctggaggctcagacccctgcccatatagggattgggagagggccccatggttccaggtcaatctggggccctccctgggtctcagaacccccacttgtgggcaggatcagatcagggctcttaaattagagaatttagattggtattgaaagatctagcacacccccaaaactgtaaaactgtgtgagcaaacatagcttttgtgaaggaaggggtcctttcagatggttctcaagggagcacaggacccccagaatgaggtaaag

SEQ ID NO: 73557 - DNA, 601 bp, Human
gggccccatggttccaggtcaatctggggccctccctgggtctcagaacccccacttgtgggcaggatcagatcagggctcttaaattagagaatttagattggtattgaaagatctagcacacccccaaaactgtaaaactgtgtgagcaaacatagcttttgtgaaggaaggggtcctttcagatggttctcaagggagcacaggacccccagaatgaggtaaagccccccggccttggtgcccaagagtgccccggttctgacacctgtctttggctgatttgcagggaaccacaaarttttacttgaatgcactgacctgagtttgtcaagtgtcgatgtgggtgctgggtgccgttgagtgtagatgtgggtcccaggagaccccctgggtcctctgcctgcagcgccagcattacatccaaggctggcccgctgccttttctctgggctgtggatggtccatgagcttaaggactttggagcagggagaactggtgcagatgccagctcttggcttcccagcaagtctcaatgtcctggagcctcagtttgtgcatctgtagaacgggagttcggcaagggctgtgtgaggactc

SEQ ID NO: 73558 - DNA, 601 bp, Human
aaggggtcctttcagatggttctcaagggagcacaggacccccagaatgaggtaaagccccccggccttggtgcccaagagtgccccggttctgacacctgtctttggctgatttgcagggaaccacaaagttttacttgaatgcactgacctgagtttgtcaagtgtcgatgtgggtgctgggtgccgttgagtgtagatgtgggtcccaggagaccccctgggtcctctgcctgcagcgccagcattacatccaaggctggcccgctgccttttctctgggctgtggatggtccatgarcttaaggactttggagcagggagaactggtgcagatgccagctcttggcttcccagcaagtctcaatgtcctggagcctcagtttgtgcatctgtagaacgggagttcggcaagggctgtgtgaggactcgatgcctgtaaagtgctgggtgtggaggttggcttgagggagcatggagctgcctctcaccagggagttctgaagtctgtgctgtggtgaacattggatgggaaaggggaaggctccgggctgcctgcaggagtgcccttcggctgtctgcagtgatagggcctggggtg

SEQ ID NO: 73559 - DNA, 601 bp, Human
tctgacacctgtctttggctgatttgcagggaaccacaaagttttacttgaatgcactgacctgagtttgtcaagtgtcgatgtgggtgctgggtgccgttgagtgtagatgtgggtcccaggagaccccctgggtcctctgcctgcagcgccagcattacatccaaggctggcccgctgccttttctctgggctgtggatggtccatgagcttaaggactttggagcagggagaactggtgcagatgccagctcttggcttcccagcaagtctcaatgtcctggagcctcagtttgtgcrtctgtagaacgggagttcggcaagggctgtgtgaggactcgatgcctgtaaagtgctgggtgtggaggttggcttgagggagcatggagctgcctctcaccagggagttctgaagtctgtgctgtggtgaacattggatgggaaaggggaaggctccgggctgcctgcaggagtgcccttcggctgtctgcagtgatagggcctggggtggggccgagggctcctgtaggctctgaattttgctcccttctgctttaacgtgaagcccctggaactttaatctgtctctatggctgggcg

SEQ ID NO: 73560 - DNA, 601 bp, Human
ggctgtgtgaggactcgatgcctgtaaagtgctgggtgtggaggttggcttgagggagcatggagctgcctctcaccagggagttctgaagtctgtgctgtggtgaacattggatgggaaaggggaaggctccgggctgcctgcaggagtgcccttcggctgtctgcagtgatagggcctggggtggggccgagggctcctgtaggctctgaattttgctcccttctgctttaacgtgaagcccctggaactttaatctgtctctatggctgggcgcgactctcccatccctatggaggcygaggaaggacgggggtgaatgggctcaggcctggcaggctcctggggctccagacagtcctgcgtgctcctgctgctgctgtctaggagcctggctctgacactccctcccaccctgccccatccccagcatcctctatgcggacatcgtgggcttcacgcagctggccagcgactgttctcccaaggagctggtggtggtgctgaatgagctctttggcaagttcgaccagatcgccaaggtgagcccgctggcctacaatgggcaaagccaggcccctcccctgcctattacacccca

SEQ ID NO: 73561 - DNA, 601 bp, Human
gagctgcctctcaccagggagttctgaagtctgtgctgtggtgaacattggatgggaaaggggaaggctccgggctgcctgcaggagtgcccttcggctgtctgcagtgatagggcctggggtggggccgagggctcctgtaggctctgaattttgctcccttctgctttaacgtgaagcccctggaactttaatctgtctctatggctgggcgcgactctcccatccctatggaggctgaggaaggacgggggtgaatgggctcaggcctggcaggctcctggggctccagacagtcctscgtgctcctgctgctgctgtctaggagcctggctctgacactccctcccaccctgccccatccccagcatcctctatgcggacatcgtgggcttcacgcagctggccagcgactgttctcccaaggagctggtggtggtgctgaatgagctctttggcaagttcgaccagatcgccaaggtgagcccgctggcctacaatgggcaaagccaggcccctcccctgcctattacaccccaggggtgtcctgtgttcagtgccctgctggaattgggatggggaggcgtggctgaattttagc

SEQ ID NO: 73562 - DNA, 601 bp, Human
aacattggatgggaaaggggaaggctccgggctgcctgcaggagtgcccttcggctgtctgcagtgatagggcctggggtggggccgagggctcctgtaggctctgaattttgctcccttctgctttaacgtgaagcccctggaactttaatctgtctctatggctgggcgcgactctcccatccctatggaggctgaggaaggacgggggtgaatgggctcaggcctggcaggctcctggggctccagacagtcctgcgtgctcctgctgctgctgtctaggagcctggctctgacactycctcccaccctgccccatccccagcatcctctatgcggacatcgtgggcttcacgcagctggccagcgactgttctcccaaggagctggtggtggtgctgaatgagctctttggcaagttcgaccagatcgccaaggtgagcccgctggcctacaatgggcaaagccaggcccctcccctgcctattacaccccaggggtgtcctgtgttcagtgccctgctggaattgggatggggaggcgtggctgaattttagcatccagccagcaaacacaagcgccccatggtaaaggtgggggt

SEQ ID NO: 73563 - DNA, 601 bp, Human
cgtggctgaattttagcatccagccagcaaacacaagcgccccatggtaaaggtgggggtgagtggtggccacggcagccaggatcctgtgcccccagagtgacaggccagtggggagactgacagtgcacactgggcgatatactggggctctggagctcagatgggggctcaggaggaggagatggctccatcctcactggcaaggctagcagcctccactcacctggtagctcaggaggactgtggaatgcccagcctcacccagaagctgcttttcacaggatctgaggtgaatcaygtgcacattaaacttttacgttttgtttgtttgtttttgtgagatggagtctcattctgtcatgaaggctggagtgcagtggtgccatcactgctcactgcagcctcgacctgccaggctcaagtgattctcatgcctcagcctcctgagtagctgggactacaggcatgcaccaccacgcctggctaattttttttttttttttttttttttttttttgtagcaatggggtttcgccatgtaggccaggctggtctcgaactcctgacctcaagtgatcatcccctcttggcctcccaa

SEQ ID NO: 73564 - DNA, 601 bp, Human
gtggtggccacggcagccaggatcctgtgcccccagagtgacaggccagtggggagactgacagtgcacactgggcgatatactggggctctggagctcagatgggggctcaggaggaggagatggctccatcctcactggcaaggctagcagcctccactcacctggtagctcaggaggactgtggaatgcccagcctcacccagaagctgcttttcacaggatctgaggtgaatcatgtgcacattaaacttttacgttttgtttgtttgtttttgtgagatggagtctcattctgtcrtgaaggctggagtgcagtggtgccatcactgctcactgcagcctcgacctgccaggctcaagtgattctcatgcctcagcctcctgagtagctgggactacaggcatgcaccaccacgcctggctaattttttttttttttttttttttttttttttgtagcaatggggtttcgccatgtaggccaggctggtctcgaactcctgacctcaagtgatcatcccctcttggcctcccaagtgctgggattacagccgtgggccaccactcctggcccaccttaaagtctgagatacttgaa

SEQ ID NO: 73565 - DNA, 601 bp, Human
actcacctggtagctcaggaggactgtggaatgcccagcctcacccagaagctgcttttcacaggatctgaggtgaatcatgtgcacattaaacttttacgttttgtttgtttgtttttgtgagatggagtctcattctgtcatgaaggctggagtgcagtggtgccatcactgctcactgcagcctcgacctgccaggctcaagtgattctcatgcctcagcctcctgagtagctgggactacaggcatgcaccaccacgcctggctaattttttttttttttttttttttttttttttktagcaatggggtttcgccatgtaggccaggctggtctcgaactcctgacctcaagtgatcatcccctcttggcctcccaagtgctgggattacagccgtgggccaccactcctggcccaccttaaagtctgagatacttgaaaaaatatctgaggaggaaagggaacagtgttcttagcagggggaacagcatagacaaagcctggagtagaaagaaagccccgtgtgtccatggggtgaacgtgctcagtgtgcgtgtgaggtgtgagggggacaagggcacaaggtctgacatgcaag

SEQ ID NO: 73566 - DNA, 601 bp, Human
cctcacccagaagctgcttttcacaggatctgaggtgaatcatgtgcacattaaacttttacgttttgtttgtttgtttttgtgagatggagtctcattctgtcatgaaggctggagtgcagtggtgccatcactgctcactgcagcctcgacctgccaggctcaagtgattctcatgcctcagcctcctgagtagctgggactacaggcatgcaccaccacgcctggctaattttttttttttttttttttttttttttttgtagcaatggggtttcgccatgtaggccaggctggtctygaactcctgacctcaagtgatcatcccctcttggcctcccaagtgctgggattacagccgtgggccaccactcctggcccaccttaaagtctgagatacttgaaaaaatatctgaggaggaaagggaacagtgttcttagcagggggaacagcatagacaaagcctggagtagaaagaaagccccgtgtgtccatggggtgaacgtgctcagtgtgcgtgtgaggtgtgagggggacaagggcacaaggtctgacatgcaaggacatgagggctgaggcgaggaccaggatgctgaggag

SEQ ID NO: 73567 - DNA, 601 bp, Human
gagtcttgctctgtcacctagcgtgaagtgcaatggcataatcatggctcacagcagcctcaacctgcctgggctcaggcgtcctcccacttcagcctcccgagcagctgtgactacaggtgtgcaccacaaccccaggctaatttttttgtattttgtggagatggggttttgctacattgtctaggctggtcttgaattcctacgctcaagtgatccacccacctcagcctcccaaagtgctaggattacaggcatgcaccatcatgccctgccccatcagaattttttttttttttttgagacggagtcttgctctgttgcccaggctggagtgcagtggtgtgatctctgctcactgcaagctccgcctcccgggttcacaccattctgcctcaccctcctgagtagctgggactacaggcgcctgccaccacgcctggctaattttttgtatttttagtagagacggggtttcaccatgttagccaggatggtcttgatttcctgaccttgtgatccgcctgcctcgacctctcaaagtgctgggattacaggtgtgagccactgcgcctggccagaatttgtaagagccccgcag

SEQ ID NO: 73568 - DNA, 601 bp, Human
aggctaatttttttgtattttgtggagatggggttttgctacattgtctaggctggtcttgaattcctacgctcaagtgatccacccacctcagcctcccaaagtgctaggattacaggcatgcaccatcatgccctgccccatcagaattttttttttttttttgagacggagtcttgctctgttgcccaggctggagtgcagtggtgtgatctctgctcactgcaagctccgcctcccgggttcacaccattctgcctcaccctcctgagtagctgggactacaggcgcctgccaccaygcctggctaattttttgtatttttagtagagacggggtttcaccatgttagccaggatggtcttgatttcctgaccttgtgatccgcctgcctcgacctctcaaagtgctgggattacaggtgtgagccactgcgcctggccagaatttgtaagagccccgcaggtgtctctgtgggcagagaatcaatggtctagaacttgatgggaggcaagttatgacttcacactgggaagaatttttcatgatcagagctactcaatcccaggagggactggaagtgggctccctgttgcagggg

SEQ ID NO: 73569 - DNA, 601 bp, Human
gtgtgatctctgctcactgcaagctccgcctcccgggttcacaccattctgcctcaccctcctgagtagctgggactacaggcgcctgccaccacgcctggctaattttttgtatttttagtagagacggggtttcaccatgttagccaggatggtcttgatttcctgaccttgtgatccgcctgcctcgacctctcaaagtgctgggattacaggtgtgagccactgcgcctggccagaatttgtaagagccccgcaggtgtctctgtgggcagagaatcaatggtctagaacttgatgsgaggcaagttatgacttcacactgggaagaatttttcatgatcagagctactcaatcccaggagggactggaagtgggctccctgttgcagggggtaaccaagcttctacaggattgcactggtcagggatgctctggaaaactgtcccatcctggggattgtggactgagtgactcagagggcctgtctagcctggaaccttccttcaggatctgcatggcttctgaaccagcagctgggagccccagaggttgggcctcatgtgaggcaggggccctgggctcgggccacagctggcc

SEQ ID NO: 73570 - DNA, 601 bp, Human
tgttccagcctgtccttctcctgaagtcctgccataggtggctggtgttgccagaaagaagcctgggcagagctggaggggcctggcctgcaccactgcctgtgtgacctcaggctggcccctgccctgtaacaggcggaggttgtacaggccctcgtgcacctctggttccgaccctggaaggcttggtcagtgcccagccttgttggtggacacgtggtgccgcttgtcatggggactcaggctctgttcctgtcttgggcgtcccctgtgccccaaggaagctctcccgtggggctcygctcctgtgctcagtggtgctaacaactcccagggcccctgcttcccagggattgggggggcatagaaggtgcccatggtctgggcccctgtgttccttgtctatgctaggttttgggtggttcctggaccccctctgtagacgccagtaaactttatttatttatttatttatttgagatggagtctcgctgtgttgcccagagcgtatctcggttcaccacaacctctgcctcctgggttcaagcgattctcctgtctcagcctcccaagtagctgggactacaggcgcctgctacca

SEQ ID NO: 73571 - DNA, 601 bp, Human
ccctgtacccaccccacacctgggagcttcagcctgtcccagggcttaggcagggctggggtgactgggccactctgccccaggcaggtgcgggaggccacgggcgtggacatcaacatgcgtgtgggcatacactcggggaatgtgctgtgcggggtcatcgggctgcgcaagtggcagtatgacgtgtggtcccacgacgtgtccctggccaaccggatggaggcagccggagtacccgggtgaggctgggctgggtagccgcagggacagaggcctggggctggctgtggatggagggttctgcggttgggggtgggggtcaggtgtggagggagagatgaatgtagaaaagctggcctggggcccaggcctgcctgctgtgcatccctgggtggatgccagccctctctgggccccaaggctctgcctgacttgggtctcccgtagccgggtgcacatcacggaggccacgctaaagcacctggacaaggcgtacgaggtggaggatgggcacgggcagcagcgggacccctacctcaaggagatgaacatccgcacctacctggtcatcgacccccgggtacgagggctcagaggc

SEQ ID NO: 73572 - DNA, 601 bp, Human
cagtggtgagacccacgtccccaacgggcggaggcctaaggtaggtccccctcccacccagaaagccagggattggggccccaagccaggagcaggagagtgagtgctgaagatctcctgccctctcagcctcactgtccccatctgtaaaatggccacagcctctgccccacctcctggggctggagaggaagcaaagacatttggagaatactccgggatggccaggaacatccctgtcctccttgatgcctggaccacgctcagctatagtcaggatgtctgtggcttggacgacccygacaccttgtcctgtgtatcaagtgccggaggggctgaacctggcccagcagtggccttcagggcccagtgttctggggaatgactgtatcctttcctcccttccctttcagagcgttccccagcgccaccgccggaccccagacaggtgcgtgccctgccctcctggccaagtcctgctgcagccacctcctccaagcaggctgccctgagcagcctctgtccagtgggcagctccgcaaggcccagcccaggacctctgtgaagttggccagggcttgggtcaaagcatttctaggaa

SEQ ID NO: 73573 - DNA, 601 bp, Human
gttggccagggcttgggtcaaagcatttctaggaaccagagtttcctggcccctggcccttctgcatggccacatgatggagcacctgttgtatggtgccctggcggggtcagtggagtcggtggaagggaaggagatgactgtgggtgtcctggtccccatgccaatcccgggggtgtagccgaagatgccttagactggggctcgggtctgccctctgcctctggcttggctgctggccagctgggccatgctgggccatgctgggtcctcactcgccctctctgggcctcagtgggayccacccattccttcaccatcccacctgaggttctgggaccccactggtgtctacgtccacaccctcctctgggagagttggaggtggtcgctgtgctgatgcagttgtgggtatctgattccagaagcatgtcccccaaggggcggtcggaggatgactcgtacgatgacgagatgctgtcagccattgaggggctcagctccacgaggtgaggtctgagacctctgtccacccccctctcctctccccctcggataggggtcccctatatgggcaggcccatctcataccccatgcctg

SEQ ID NO: 73574 - DNA, 601 bp, Human
agactggggctcgggtctgccctctgcctctggcttggctgctggccagctgggccatgctgggccatgctgggtcctcactcgccctctctgggcctcagtgggacccacccattccttcaccatcccacctgaggttctgggaccccactggtgtctacgtccacaccctcctctgggagagttggaggtggtcgctgtgctgatgcagttgtgggtatctgattccagaagcatgtcccccaaggggcggtcggaggatgactcgtacgatgacgagatgctgtcagccattgagggrctcagctccacgaggtgaggtctgagacctctgtccacccccctctcctctccccctcggataggggtcccctatatgggcaggcccatctcataccccatgcctggtggcccagccttgttccttccccctgcctgctgccacctcctgagggaatggaccccttcccagcccccatctcaccgcagctgcccccgcccacaggccctgctgctccaagtccgatgacttctacacctttgggtccatcttcctggagaagggctttgagcgcgaggtgagggcccccagcagcctcct

SEQ ID NO: 73575 - DNA, 601 bp, Human
tggccagctgggccatgctgggccatgctgggtcctcactcgccctctctgggcctcagtgggacccacccattccttcaccatcccacctgaggttctgggaccccactggtgtctacgtccacaccctcctctgggagagttggaggtggtcgctgtgctgatgcagttgtgggtatctgattccagaagcatgtcccccaaggggcggtcggaggatgactcgtacgatgacgagatgctgtcagccattgaggggctcagctccacgaggtgaggtctgagacctctgtccaccccyctctcctctccccctcggataggggtcccctatatgggcaggcccatctcataccccatgcctggtggcccagccttgttccttccccctgcctgctgccacctcctgagggaatggaccccttcccagcccccatctcaccgcagctgcccccgcccacaggccctgctgctccaagtccgatgacttctacacctttgggtccatcttcctggagaagggctttgagcgcgaggtgagggcccccagcagcctcctccgcagagggacggggtctccaggcctggggtagggtggggg

SEQ ID NO: 73576 - DNA, 601 bp, Human
caagaccggctaggggaggggcactgagaatccacagctgctcctgggcggggggcaggggcggggccagtgcagcaccagcctggctctctcctgtcggcttcattccatgacccaaatgcaccatcagagatttgcctccatgggtctgcaagacttttgctccgtccagtgccaaagccttagcagatcctggcatggatgcctcaggctgatggcaccggccttgcaatgagacgagaacccaaagctcagttatcagtgtcctgtcttgctgctatgagctttttgtactgataaygaccatttctttactgagcgccttctgggttctggcagcatcctcggcacccacattatataatttaaccgtcacaacggccagcccaggggtgctgctataccacttcacagagaggaaactggctctcagaggcttcagagcctgtccccagcttcaggtgtggctccctgagttgggggcttcctaggtgaggtcacgaggaaacctgctggccaagtgacctggcagggtgtggccagtgtggccagggccgccgagcctgctttccttccctgcagcaggaacccttctggggct

SEQ ID NO: 73577 - DNA, 601 bp, Human
acaccttgagttaccaacacttctttttaatagaatgtgtgttttctgccacaggcctccctactccctaacgtctctctcctcagccacctgtcatatgtgtggcctgcatgcattttggttgacagcccttgccttaggtgtttggagtgctaggaggatagactctgaaaactgtaggcgccatcctttttctcttatatatagggaaattggggcacagaggattaatgatttatccaaaactcactgagattcatgcttctggctctagggccctgctggtggggtatagggatgrgggtgaagtcagagggaagggggatctaaggtcagctacttggtgctttctagaagagcagttaggccgaagcatcgaccaggattgtggttttggctatgcttactaaagacataatagggaggctgtgcgtggtgactcacgcctgtaatcccagcactttgggaggctgcggggcgaatcactcgaggtcaggggtttgagaccagcctggccaacatggtgaaaccccgtctctaccaaaaatacaaaaattagctgggcgtggtggctggcgcctgtaatcccagctactcggga

SEQ ID NO: 73578 - DNA, 601 bp, Human
gcccagagagcttgtgtggccagctccaggaggatgtgatgccttgagccaccacatcctgacatcccattcattcttcacggcccttctgagactcagtttcccctctcagggatgaacccttgctcctctgctggggctcagaggctcagtgctgcagaaagcagcctgcgggacacttgtccacctctctcccagaccccgcatcctgggctagggcctctccctcacctctctgccccggaccctgggtttttggaatgtgttcctgtgaccacctccctcagggtcacctggggargctgaaaatgttggtcccggcccctccccctggctgctgccgctctgggggtgtctgcaccctcatctcctagcccctctgccctctgaacctgacggctgctgtggggagtcggcacggcggcttgagccgtgctcagagctgatcccaacgtgaaacctcaggctgctgtgatactcatggttgcctggggcccaccttgcatggcttgggcaggttccagcgttcttgtccctggactgatggggacctgtctcctctacagcccctgatgcctttccaagttccagagctgcctgt

SEQ ID NO: 73579 - DNA, 601 bp, Human
tttctacccaccccattagaatcaattttcccctttcccctgggtgtgcgtggcacctggagagcatgactcagtgggttggagtggtgagtgctgggagtgacttgggcctcccttcgcattcagtggcacccctagctgttcctggaaggacctgaagaccatgaccaatttctacctggtcctgttctacatcaccctgcttacactctccagacaggtaaggaggctggccccccccccccccccaagctctgcccacttttcctcacctccatctggagatggggtggggtggggygggctcaggtggagtagcagaaaagactagagtcctgccaggaaagcactggtcccctggccagaggctccaaggacgccagggacagacagacctggctaggagatgcacagcagcacggctcccacttgcctgtggacggggcgcttatgttgctgccgtttgcagattgactattactgccgcttggactgcctatggaagaagaagttcaagaaggagcacgaggagtttgagaccatggagaacgtgaaccgccttcttctggagaacgtcctgccagcccacgtggctgcccac

SEQ ID NO: 73580 - DNA, 601 bp, Human
gagtttgagaccatggagaacgtgaaccgccttcttctggagaacgtcctgccagcccacgtggctgcccactttatcggtgacaagttaaacgaggtgtgctgagaaggggctggggcgggggcagggaggcggacggtccaggcgcagtccgtagggtgaaggtgtggagctggagtgcatgctgagcttggcttcctcaggtcctggcctcaccgggatgcccaggcgacaatgtatggcatcagctgtgagagcatgggcctggggtcagggacctgggctcaagtgtggtcgtgarcaaggcaccttgctttcccaggccttggtcttcacctctgtaaaatgggctgacagcccttccccacaggcttgtggcgaggatgaaatgtgtgttcaggggtttgtgatctggacattctgtgttgatgaaaatgtctgtacttctactagttatgtgtagcaagttttctagataggaaacggaggcccagtgagaatgaagacctcccgttaccctccactactgcagaggttctcaccccatgtgtacatggaaacacccatggtgcttctgtgagcaaaaaccaacctgagcctg

SEQ ID NO: 73581 - DNA, 601 bp, Human
cttctactagttatgtgtagcaagttttctagataggaaacggaggcccagtgagaatgaagacctcccgttaccctccactactgcagaggttctcaccccatgtgtacatggaaacacccatggtgcttctgtgagcaaaaaccaacctgagcctgaccctccctggccacccaattcttaatcacccggtaacagccaccagatgaaactcatgcagcccgcccccctccccactccccgaaagctgggctgggcagttcagcagtgccatctgctcctgaggccttgccactcttcctgtcccctcaagaggtgaagtggtgtaaggtccggtttcttcccatccaggactggtaccatcagtcctatgactgcgtctgtgtcatgtttgcctccgtgccggacttcaaagtgttctacacagagtgcgatgtcaacaaagaagggctggagtgcctacgcctgctcaatgagatcattgccgacttcgacgaggtacagcctctagcccagccttgcgcagcagcccccacccatgctggagagggaagggcggtggcacctgccatcctaaaacccaatttaaaaatgtgacaca

SEQ ID NO: 73582 - DNA, 601 bp, Human
catcaacaggcactccttcaactccttccgcctccgcgtcggtgagcccgggtgatggagcggggtggggagcccctgcctctaggccagtccacccagtctgtgtggcacagctgcacctcgccatctattatgaaaggttttagaaatccctctgatctgacaagctcagcagttggacaattattctgatgttttgcatatagttagcatatagttaccattgagagttttaataatacgtaactacagaaaatggagaaccaaaattattgtctgtaaacaggtgaccttaaaatayagagaaggaagcaaagttactaaacctaaatagttgcgggcctgcgctcaaagccaggcctttgttaatacttttaacaaagtattctttgttaaaagagagattagcagatacaagtgttaacatcaaacccagacttctgagtctgaaaaagagctggccggggaatgccctcctcataccccaagcccgactgcaacgcagtgactctgggaagcaacccagccttcactctagttgttttgtccccgcatcctgtgctggggtatggattctctggcctcctctaagggcagaagc

SEQ ID NO: 73583 - DNA, 601 bp, Human
tgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcrgggagcagcagagccttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctc

SEQ ID NO: 73584 - DNA, 601 bp, Human
atggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaaggcggggagcagcagagccttgcctttgaatgaggcagcttgtgaggcaagcattctggagagaggtgctttgaaagtaaggtgcggcctttcacctcttccttgattactcacacatctttgcrttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcc

SEQ ID NO: 73585 - DNA, 601 bp, Human
gaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtaraagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctcctgagttaacttttgtgaaaataatacctaaggttttctggcttattgaggaaatttcctaacaaacaaacaaacaaacaaacagaagagaagatcattaa

SEQ ID NO: 73586 - DNA, 601 bp, Human
acagccacgtgaggttggcagggctttgcacagatgtgcacagagcaaaaaccagcagaatgagagtgtaggcagggccagcatacttcctaccccactccccgcctatcaaactccgaagctaaggaagaacaaggaatggaaattcaatttcagtgtattcagtgataccccacctcctcctaaacagaatctgagataacacacagaaagctctctctgcaggtatatgcagagcaatgccacgcattgccagcgtctgtgcatgccttttcctttaaagaatggccggtggttttaraagaaattgcaattttattaggagtctaatgaaaatttatttcttactcatcaacatatgttctgaccgttatttattccattcttggtttcctcatctgtaaaatgttaactgctgtgtacttggccctttctatgttattaatatgccctgagaattcagttaagggtttgaagtccattgagctcctcgagaaagacattctaataacagtaacaattaccaattcatgattgtaaaatgtggaactctactgcgaagtgagagcggaagagaaggggaaattatacgaatatttca

SEQ ID NO: 73587 - DNA, 601 bp, Human
taagttcattttagaaaataatttacttaaaatttttcaatggtttagtgattcatggtgaaccaagtccaatgcaacatatacgtaaacacactgaaatttaattttgttctgtctgaaactttacaatggatgtttctcaaagattcacattctttttttctagttttacaaacatctttgaccaaaagcaagacagttaactagcatttacactgttacttacaaagtttataaatataaactaaaatcatcaaaatttggatggaaatgtttatttttaatatatattaaagacttwaattatccagttttaattacatttgaaggatcaaataaggcagaggttgtgtttcatttggaatgttgggatagacacaatgaagacattagttttgaactggaaattaaatgatatgaagaattttcactggctgcatagccaagagagaataggagtagaatcagatgattctgaagattccagctcaaggtgattggaagaatacattcacttattcattcaaccaacatttactggttgcttagtaggtgctaaacggattcaatggctagagcagtgaacaaagccaagtccttg

SEQ ID NO: 73588 - DNA, 601 bp, Human
tattttgaaggtgtatcttctcataaataaaagttaagttcattttagaaaataatttacttaaaatttttcaatggtttagtgattcatggtgaaccaagtccaatgcaacatatacgtaaacacactgaaatttaattttgttctgtctgaaactttacaatggatgtttctcaaagattcacattctttttttctagttttacaaacatctttgaccaaaagcaagacagttaactagcatttacactgttacttacaaagtttataaatataaactaaaatcatcaaaatttggatrgaaatgtttatttttaatatatattaaagactttaattatccagttttaattacatttgaaggatcaaataaggcagaggttgtgtttcatttggaatgttgggatagacacaatgaagacattagttttgaactggaaattaaatgatatgaagaattttcactggctgcatagccaagagagaataggagtagaatcagatgattctgaagattccagctcaaggtgattggaagaatacattcacttattcattcaaccaacatttactggttgcttagtaggtgctaaacggattc

SEQ ID NO: 73589 - DNA, 601 bp, Human
tatcaggaaggcagcacaggtatatacataggaaagagaaaaccaaatttactgaggcagcaaactgtttcagtacatttttaattgcttatgagatatgatatcaaatcaataatatcctaaacaaaaagtaaatgcttttaaagacaaacattaacttattgccatgaagtgatttggagaatatttatgtgttactccacacaataggcacataactttgaaatataaaattattttgaaggtgtatcttctcataaataaaagttaagttcattttagaaaataatttacttaaaawttttcaatggtttagtgattcatggtgaaccaagtccaatgcaacatatacgtaaacacactgaaatttaattttgttctgtctgaaactttacaatggatgtttctcaaagattcacattctttttttctagttttacaaacatctttgaccaaaagcaagacagttaactagcatttacactgttacttacaaagtttataaatataaactaaaatcatcaaaatttggatggaaatgtttatttttaatatatattaaagactttaattatccagttttaattacatttgaaggatc

SEQ ID NO: 73590 - DNA, 601 bp, Human
aatgaaaaaaaatcaaataaatattatgcataaaaagaaaactttaatgtgtatattatttatataaattataaatttataatgatatacacataaaaaggcatataatacttatataaatgttaattatattacatattgactacactaaatattaattttaaaatatttaattaaatataaatacatgaatttatatttataattatatgtgatttatgttattataaataaaacataaataaaatattggagataaaataaaaacatattggagaaagaaatcaggacaaaaatatawcaaggagaagaataaaacaatatactgagttctagcttcctcctgcaaaaagcttgtaaactcaaagagttatgtatgctcttcagctttgtttactatattgtaaaacgtatgtaataacttcactgattaactcagtgggtacagtgacgatccaacaacagcctaggtgggagagtgctgaaaactatcaggaaggcagcacaggtatatacataggaaagagaaaaccaaatttactgaggcagcaaactgtttcagtacatttttaattgcttatgagatatgatatcaaatcaa

SEQ ID NO: 73591 - DNA, 601 bp, Human
caaatattaagatctaaaaaatgaaaaaaaatcaaataaatattatgcataaaaagaaaactttaatgtgtatattatttatataaattataaatttataatgatatacacataaaaaggcatataatacttatataaatgttaattatattacatattgactacactaaatattaattttaaaatatttaattaaatataaatacatgaatttatatttataattatatgtgatttatgttattataaataaaacataaataaaatattggagataaaataaaaacatattggagaaagraatcaggacaaaaatatatcaaggagaagaataaaacaatatactgagttctagcttcctcctgcaaaaagcttgtaaactcaaagagttatgtatgctcttcagctttgtttactatattgtaaaacgtatgtaataacttcactgattaactcagtgggtacagtgacgatccaacaacagcctaggtgggagagtgctgaaaactatcaggaaggcagcacaggtatatacataggaaagagaaaaccaaatttactgaggcagcaaactgtttcagtacatttttaattgcttatg

SEQ ID NO: 73592 - DNA, 601 bp, Human
gtaaacatatgtgagctccagtgtttgaatctttaaaccaaaaccaaaacaatttttttctttatcaacagaaataagctatagagtaacacctaaatacacctgaagttatacagaatctagcagatgaaaattggcatttactaaatgaaaatattactaaattctttacatctattgctaaacagtgatcacattttatgctatcattggattgatcttttcttacagaattatgtgaaataatttaattgataaaaaaatacaatacagagtgaaatatttaagaataaaaatccaraaacagtatctttaaactaaaaaaaacagtttcagtactatttctcaattttttagaggcatgttaaatgtctttatcttttctctaaagtaaatgttaataattattactcaagtgaaatatttttatcaacttcatataatcatgttttccaaaaataacaatattcctttcattagaatgacaccacaaatattacaaatgataatatactacattagttttatctactggtcccaacagagttatcattctaaaaattacactaattttaaaataccacagcaaatcaggatttat

SEQ ID NO: 73593 - DNA, 601 bp, Human
ttaacattctcttaaagaagagacatttgctctgaagtaaacatatgtgagctccagtgtttgaatctttaaaccaaaaccaaaacaatttttttctttatcaacagaaataagctatagagtaacacctaaatacacctgaagttatacagaatctagcagatgaaaattggcatttactaaatgaaaatattactaaattctttacatctattgctaaacagtgatcacattttatgctatcattggattgatcttttcttacagaattatgtgaaataatttaattgataaaaaaatrcaatacagagtgaaatatttaagaataaaaatccaaaaacagtatctttaaactaaaaaaaacagtttcagtactatttctcaattttttagaggcatgttaaatgtctttatcttttctctaaagtaaatgttaataattattactcaagtgaaatatttttatcaacttcatataatcatgttttccaaaaataacaatattcctttcattagaatgacaccacaaatattacaaatgataatatactacattagttttatctactggtcccaacagagttatcattctaaaaattac

SEQ ID NO: 73594 - DNA, 601 bp, Human
gggccgtgtcagattgaacctagaaagtagatattatatacatgagacaaatctttatttcagcagagctttcatctatatatttatgaaatctcattgccattttattagtttaaataattgcccttaatttattattatatataaattaaaacagcaatagaataagaaagtccaattgagaaatttcaagagcaaggcatgagtaaaataatgtagtgcatcttagttctccagaataactaaaggaatatttgacaggctagatggtgtctatacatggaaaaaacacttaagactyttcctgtcttagaaaacaaagtattctgagcatggaaaattattctgtcgtcaatgttttaaaaaactgagtttttattatatgtaacataacatttaagaaccgagtttaaagtgtactgtctgcagggcaaaaatgtggacaataatttccttaatgagttttttgttctttgccaacatcttccttataggaactgagtaaaaaaaaaaatatgagtgagaatagaaatggaataatattttggaatgtgtaatattctgatccttgattcgaaaagcaaatttcctccaagctgtg

SEQ ID NO: 73595 - DNA, 601 bp, Human
catggtgaaaccccatctctactaaaaatacaaaaaattagctgggtatcatggtgcgtgcctgtgatcccagctactcaggaggctaaggtgggaggatcacttgaaccccggagccagagattgcagtgagccgagattacgccactgcacttcagcctgggtggcaaagtgagatgctgtctcaaaaaaaaaaaaaaaaaaaactgttcttcaaagtggtactgttgtgggggaaaaaaaaatagtaaaaccataataccaggaacaatctaatggaatccaatattatttattctaygaaaatattttttgtttcaagtcaattatgtgctattagggagtagccagagcattggtgacaaactcagaaagcagaaaaggttacgtgaattgcaaatgagagacaaaatggccaagcatcatcattgctaatacagtacacacattttagactttacctcaaaagattcatactgctcacgatctacaggacgagtacaatacaagtttccagtgtctctctccacataaaataaattccgaggttcttggtcaactccaggacctcttatggaatagtatatggtatagttttggg

SEQ ID NO: 73596 - DNA, 601 bp, Human
taagtttcttctgtaaaaattgggtagttatcattttcatcctctattttgattattaggggcagtggaagttctggagtatacccatctggagttgttgcaaaggcaattatctgtgaagagagtaaaataaggagaaaagtgaaaataatcttttaaaatgaggtatgcttcaaattcattttggctttaacttggagactgttcagaactacagtatgagtctcaccatttgttattgttctgggatatggatataattttaatgccaaagaggtgcctaatttcatgattcaatatrgcattgtatgtttaaatttatctctttaaatttatgaaagataattttagtttcttcattattgctatactgttattcatgagtgtaacaatttttactgttattttcccaaacagccttgaagacttctttattttgctttgtttgaaaggttcaggtgcatggattttaaatacaactttctggatctttctgaacttgggatcctgtaggattacccaggtacagttaactgggatattatcctattttctactaatgaggactttaggcatatcaatggttacatttgggtaagtc

SEQ ID NO: 73597 - DNA, 601 bp, Human
atgtttatgttacctctctgtctagctgagatgatgttgtggtgatcacgcctgtagttggatgcatagaaaatagggtgggtgatggtggcacctgcccaatgatggagtacttcaggcgtgtgtgcatcgtgtcaggctcatctttgtcagtagcacacacttgtcccacagtagtgcctagagaagaaaagtcctttttaatctccaaaacattcacatgttctatgttccctttatttcattccttttcacccacctcaaaaaagttctggaccacattattacatggcaaagtcayggcttttataaatttgcagacctctccatacagtatcacttcctttcaaatattctggcatactagcattttcgaattgggtgatcatattcatatttattgtatttaatgtatgattttataaatgttgatactatccctccatgtattttcagactaaacaattctgattattctataacttttctctgtttgtaagcttgtgcttagattgatcataggagtcagttttctctaaaactgcatggttcacttagacatttctagacaaggtctccaaaactgcattctgacttttag

SEQ ID NO: 73598 - DNA, 601 bp, Human
taaaatttattggaaataattaactggctaatgaaacaaggaaatgaagtttgataccctaagtattaacttatgctatcttcagatggaagagaaattctgatgtttaaagggactaaaaggttgtaggcaactgaagaaaaccggaatcctgaggtcaaaaagttactagagagcaccactggataaacaccttcactggacaagtgttttcaactgattatttcagaagaatctattcaaagaaaagcacttctgtgattgtttgatttaggagctgaacaagctgttgagtttttgytttttttttttttccatagaatgctattttcacatagacatctatggctatgcagactatagttttatgaaagtattttgtaaaacataaagttaatctgtcacttcagggaaaacaactatttgttgccaatgataaattggagatttcaaacaaaaatgagaagcttggaaaacctttatcaaccaatgtgatatcaatggaagtaaagaggtgatctttttgatattatttaatgcaatgtgtcaatatttggaagctctgcattacttggtgaaccaatattttccaaatgaccaa

SEQ ID NO: 73599 - DNA, 601 bp, Human
ctttttcttttctgagacgaagtctcgctctgttgcccaggctggagtgcagtggtgtgatcttggctcactgcaacctctgcctcccgggttcaagcgaggcaggagaatcacactaggaatttttaatcaatttatgaaaattgaatagtttctcaaatttatagtgctattaacttacagaatatagattcaattggttttgtctttattcaacagaaaaagaagagctatttgccacaagtgcatttaaaattgcctggtaattaatcaaaacctttatctcctagccaaagtacaktcttatgttcaaaaaaatagacagcaatgactcttaaaatagtcttttaacaaaacaataaaatgaaatttcttcctgcaaaaaatatagattttaagggtttatgttacatttaagagatcatctaaactgacatgaagataaaggtctggggctatgtaggtttttttctttctgtggaaaatagaatctggctcttaaggctttcaatttatcagatattgttgaaaactcatcactaccttaaaaaatatttttaaacatctgaagcatttaaatattttaaagtgtttctcctta

SEQ ID NO: 73600 - DNA, 601 bp, Human
ccagtgatatggtttggctctgtgtcgccacccacatctcatgtcgaattgtaattcccaatgttgggggagggacctgagggaaggtgattggatcatgggggtggatttccccactgctcatgatagtgagtgagttctcacaagatctggttgttcaaaagtgtgtagcacatccccctttgctctgtctctcctgttgccatgtgaagatgggcttgcttcccctttgccttccgccatgattataagtttcctgaggcctacctagtcatgcctcctacacagcctgtggaactgsgagtcagttaaacctcttttgtttataaactatccagtctcaggtagttctttataacaatgtgagaacagactaatacacccagaaacccagtggtggtggagacagaggagttctcccactgattcagtacttgggtaaagctggaaaaaaaaaaggacagaaaattgttcttcaactgcaaatttaagataagtagtataacaggtattgatgaagatttcagagagtatttaatgagggttcttggatattaatacatgagatactcctttaggggattcatactataaacaatag

SEQ ID NO: 73601 - DNA, 601 bp, Human
ttcaaaggctacgaaagcaaatgtattgaaaaatcagatgaactcatttaatatttggcaatgctaacgagtatatataatgttaaatttggaaatatgttaagtgtcatgttgggaataaccacgagaatatgaaacatatatccagtgatatggtttggctctgtgtcgccacccacatctcatgtcgaattgtaattcccaatgttgggggagggacctgagggaaggtgattggatcatgggggtggatttccccactgctcatgatagtgagtgagttctcacaagatctggttgytcaaaagtgtgtagcacatccccctttgctctgtctctcctgttgccatgtgaagatgggcttgcttcccctttgccttccgccatgattataagtttcctgaggcctacctagtcatgcctcctacacagcctgtggaactgcgagtcagttaaacctcttttgtttataaactatccagtctcaggtagttctttataacaatgtgagaacagactaatacacccagaaacccagtggtggtggagacagaggagttctcccactgattcagtacttgggtaaagctggaaaaaaaaa

SEQ ID NO: 73602 - DNA, 601 bp, Human
caacaaaagcaccagtcaaaagattaattcattctatccaagacgtctctgaaacaggtatgtttagaatcttcaaagacataaagaggggtaaccaattaaacaagaatgaaattacagctcaaattccagtagaaaataaacagcaacatttacctaccagggattctaaaaaagagaatagacagaatggcagagaagcaatagttaaagagattaatagctgagaatactccagaattaaagaaaaacatggcttttcagattgaaagtattttctgactgcagaactagacaaatrtaaaaaaatccacggcatacacattgtactaacactgtagaactcaatttagggtactataaaagctacctaaatatattaactacaaaaggacaatcgttaatcgacagaacaagaagcatcagcaagaagagataccagaagataatgggttaatagctgcacagtgccatgggaaagaagctgttgactcagaattttaaaccaagtcaaagtgtcacttaagtatgaggccaatattaaaatatttttcagaacaacaaaactgagagagtttaaaattcacattccacaattgaa

SEQ ID NO: 73603 - DNA, 601 bp, Human
tcttcttaaaacttgggtgtttcccaagcttataagtgattactcagacaagtacatctttaaaataacaaagatgttgacaaacatacagctgccaaagttttattttgctaagtaagactattgggaaaaaaaaatgtccactttctatcaacactatttaaaaattaatatcatgacaccaaataagtagaaaagaaaaaaatctaagaataaagttaattcttcctccccaccccaaaataaactgataaccccgatacacacacacgcacacacacacacacacacacacacacaagcacacacaacagaatattgtttagaaagctgaaaatcttgttagttcacagagcaggatccaagacatagtagtttagcttatttctataagtcttcatctttcttttccccatcctgttctccctttacgttccctcataacctttcttttctaatttgtcataacaggaaattgagggatattcactgaaagcatggggctgaaaaacattcaagggcatttaaaaagcaagcctcattcagtggttctagagtcacgaaagctggtagaccatgacatcatggtccataggcagtg

SEQ ID NO: 73604 - DNA, 601 bp, Human
gcttcatcgaagtaatagtctgaaattctggatgttttcctttacttcattttcaaaaattgtgccaaataaacataaatacttgtgacttactgtcagagactaattctgacaacttaaaacacccctgacagtgactacattagcaggtcatgagtcacacagctgcagctgcatctcctggtcctaaaggacaaagggaccaactgcacgtgtcttagttttgatgtagttttcttagataaaggctagaaaatatctagaaccgaaagcccatacagattcttttatggcttttatrgtgcataagcatgatgatagggtttttatgctcatgtgtgagacacacgtctctcaaaccttattacgacaacagtacattacctgtatgacttgaatttagaagaagaaaaaaacaataaaaaactaaaaaaaatttagaagccaatacaatcttggttttggagactagatatactactactctaaatgcagataccaggtcccatagaataatccctctcccacatagctgcccagtatgacattctcattttctgcatagtatttgaagctctaaatacaaatttgaatgcttggg

SEQ ID NO: 73605 - DNA, 601 bp, Human; identical to SEQ ID NO: 73586

SEQ ID NO: 73606 - DNA, 601 bp, Human; identical to SEQ ID NO: 73587

SEQ ID NO: 73607 - DNA, 601 bp, Human; identical to SEQ ID NO: 73588

SEQ ID NO: 73608 - DNA, 601 bp, Human; identical to SEQ ID NO: 73589

SEQ ID NO: 73609 - DNA, 601 bp, Human; identical to SEQ ID NO: 73590

SEQ ID NO: 73610 - DNA, 601 bp, Human; identical to SEQ ID NO: 73591

SEQ ID NO: 73611 - DNA, 601 bp, Human; identical to SEQ ID NO: 73592

SEQ ID NO: 73612 - DNA, 601 bp, Human; identical to SEQ ID NO: 73593

SEQ ID NO: 73613 - DNA, 601 bp, Human; identical to SEQ ID NO: 73594

SEQ ID NO: 73614 - DNA, 601 bp, Human; identical to SEQ ID NO: 73595

SEQ ID NO: 73615 - DNA, 601 bp, Human; identical to SEQ ID NO: 73596

SEQ ID NO: 73616 - DNA, 601 bp, Human; identical to SEQ ID NO: 73597

SEQ ID NO: 73617 - DNA, 601 bp, Human; identical to SEQ ID NO: 73598

SEQ ID NO: 73618 - DNA, 601 bp, Human; identical to SEQ ID NO: 73599

SEQ ID NO: 73619 - DNA, 601 bp, Human; identical to SEQ ID NO: 73600

SEQ ID NO: 73620 - DNA, 601 bp, Human; identical to SEQ ID NO: 73601

SEQ ID NO: 73621 - DNA, 601 bp, Human; identical to SEQ ID NO: 73602

SEQ ID NO: 73622 - DNA, 601 bp, Human; identical to SEQ ID NO: 73603

SEQ ID NO: 73623 - DNA, 601 bp, Human; identical to SEQ ID NO: 73604

SEQ ID NO: 73624 - DNA, 601 bp, Human; identical to SEQ ID NO: 21557

SEQ ID NO: 73625 - DNA, 601 bp, Human; identical to SEQ ID NO: 21558

SEQ ID NO: 73626 - DNA, 601 bp, Human; identical to SEQ ID NO: 21559

SEQ ID NO: 73627 - DNA, 601 bp, Human; identical to SEQ ID NO: 25457

SEQ ID NO: 73628 - DNA, 601 bp, Human; identical to SEQ ID NO: 25458

SEQ ID NO: 73629 - DNA, 601 bp, Human; identical to SEQ ID NO: 25459

SEQ ID NO: 73630 - DNA, 601 bp, Human; identical to SEQ ID NO: 25460

SEQ ID NO: 73631 - DNA, 601 bp, Human; identical to SEQ ID NO: 25461

SEQ ID NO: 73632 - DNA, 601 bp, Human; identical to SEQ ID NO: 25462

SEQ ID NO: 73633 - DNA, 601 bp, Human; identical to SEQ ID NO: 25463

SEQ ID NO: 73634 - DNA, 601 bp, Human; identical to SEQ ID NO: 25464

SEQ ID NO: 73635 - DNA, 601 bp, Human; identical to SEQ ID NO: 25465

SEQ ID NO: 73636 - DNA, 601 bp, Human; identical to SEQ ID NO: 25466

SEQ ID NO: 73637 - DNA, 601 bp, Human; identical to SEQ ID NO: 25467

SEQ ID NO: 73638 - DNA, 601 bp, Human; identical to SEQ ID NO: 25468

SEQ ID NO: 73639 - DNA, 601 bp, Human; identical to SEQ ID NO: 25469

SEQ ID NO: 73640 - DNA, 601 bp, Human
ccaccagaggaaggctgggaggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgygtgcctaactccggcaggcagacttcaggcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacggtggcccagcagtgtgaggcctttcgggtgcagctgcagctgccagaaacccactgtctgggccctgtgtcc

SEQ ID NO: 73641 - DNA, 601 bp, Human
ggctgggaggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgcgtgcctaactcyggcaggcagacttcaggcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacggtggcccagcagtgtgaggcctttcgggtgcagctgcagctgccagaaacccactgtctgggccctgtgtccgctcatgccgtg

SEQ ID NO: 73642 - DNA, 601 bp, Human
ggagcagatgtgtgtcaaactctcggaggtaatgcgggtcccgtggccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgcgtgcctaactccggcaggcrgacttcaggcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacggtggcccagcagtgtgaggcctttcgggtgcagctgcagctgccagaaacccactgtctgggccctgtgtccgctcatgccgtgttttctct

SEQ ID NO: 73643 - DNA, 601 bp, Human
gtgtgtcaaactctcggaggtaatgcgggtcccgtggccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgcgtgcctaactccggcaggcagacttcagrcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacggtggcccagcagtgtgaggcctttcgggtgcagctgcagctgccagaaacccactgtctgggccctgtgtccgctcatgccgtgttttctctcccgactct

SEQ ID NO: 73644 - DNA, 601 bp, Human
gccgttgatagcgggcgatgctggctgcattgctttaatcaggatcccaagtgggacggcattttaagcaagtgaaaaaatttctctgtctccagtttgtcacactttgtatttcactctatggactgtgagcgtggggcatgttttcctctatgaaggctgagactcaaggcagaagaggtttcatttaagacctgaggctgagacagagtgagcctggttagaatgccccatgcgtgcctaactccggcaggcagacttcaggcactgttggctccaggctccacacagccacccctaycattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacggtggcccagcagtgtgaggcctttcgggtgcagctgcagctgccagaaacccactgtctgggccctgtgtccgctcatgccgtgttttctctcccgactctctgctgctggagcgtgtgtgcaatacaacctcatcc

SEQ ID NO: 73645 - DNA, 520 bp, Human
tttgtatttcactctatggactgtgagcgtggggcatgttttcctctatgaaggctgagactcaaggcagaagaggtttcatttaagacctgaggctgagacagagtgagcctggttagaatgccccatgcgtgcctaactccggcaggcagacttcaggcactgttggctccaggctccacacagccacccctatcattttctatgggtgggtctttaatttggggcttaatagaaagcgagtccattgaggatgagttaatccacatcatggagtggtcgctatgttcctttcatgacytctttaggctcacgtgactgccgtgagcataggaaggacgacggggacagcagccacggtggcccagcagtgtgaggcctttcgggtgcagctgcagctgccagaaacccactgtctgggccctgtgtccgctcatgccgtgttttctctcccgactctctgctgctggagcgtgtgtgcaatacaacctcatcccagtggccaggcttcggggcctcc

SEQ ID NO: 73646 - DNA, 462 bp, Human
gactcaaggcagaagaggtttcatttaagacctgaggctgagacagagtgagcctggttagaatgccccatgcgtgcctaactccggcaggcagacttcaggcactgttggctccaggctccacacagccacccctatcattttctatgggtgggtctttaatttggggcttaatagaaagcgagtccattgaggatgagttaatccacatcatggagtggtcgctatgttcctttcatgacctctttaggctcacgtgactgccgtgagcataggaaggacgacggggacagcagccacrgtggcccagcagtgtgaggcctttcgggtgcagctgcagctgccagaaacccactgtctgggccctgtgtccgctcatgccgtgttttctctcccgactctctgctgctggagcgtgtgtgcaatacaacctcatcccagtggccaggcttcggggcctcc

SEQ ID NO: 73647 - DNA, 601 bp, Human
cccctctcctctcccctgcactgccccttcacccctgcccctctcctcaccctgcccctgccccttcacccctgcccctctcctcgcccctgcccctcctctcacccctgtccctccctgctgtcacccagcacacctttcaccaccttctgatgtcattgggaagcagctcttaggaagttaggcaaagattcctgcccagaaagaggccagttcagtttgagacagacttctgtggttttgttgcatttgttgctaagaacaggattaggaatttgagagctttaattttctgtctccrcagaaccgtgcccggaaaaaaaggctgaatattattattgtggctgaaggagcaattgatacccaaaataaacccatcacctctgagaaaatcaaagaggtgagtgtgtgtagctgctcactttctctcggtttctgcctggaagcaggggaggctagcgtcatgggcaggcttggtttagaacattgaattattaactttttatccttgatatttaaaacattttcataatgactcagaagttggacggcaggggaaacacgcagctcccgctcctgggagcccattccgcttacgtca

SEQ ID NO: 73648 - DNA, 601 bp, Human; identical to SEQ ID NO: 25470

SEQ ID NO: 73649 - DNA, 601 bp, Human; identical to SEQ ID NO: 25471

SEQ ID NO: 73650 - DNA, 601 bp, Human; identical to SEQ ID NO: 25472

SEQ ID NO: 73651 - DNA, 601 bp, Human; identical to SEQ ID NO: 25473

SEQ ID NO: 73652 - DNA, 601 bp, Human; identical to SEQ ID NO: 25474

SEQ ID NO: 73653 - DNA, 601 bp, Human; identical to SEQ ID NO: 25475

SEQ ID NO: 73654 - DNA, 601 bp, Human; identical to SEQ ID NO: 25476

SEQ ID NO: 73655 - DNA, 601 bp, Human; identical to SEQ ID NO: 25477

SEQ ID NO: 73656 - DNA, 601 bp, Human; identical to SEQ ID NO: 25478

SEQ ID NO: 73657 - DNA, 601 bp, Human; identical to SEQ ID NO: 25479

SEQ ID NO: 73658 - DNA, 601 bp, Human; identical to SEQ ID NO: 25480

SEQ ID NO: 73659 - DNA, 601 bp, Human; identical to SEQ ID NO: 25481

SEQ ID NO: 73660 - DNA, 601 bp, Human; identical to SEQ ID NO: 25482

SEQ ID NO: 73661 - DNA, 601 bp, Human; identical to SEQ ID NO: 25483

SEQ ID NO: 73662 - DNA, 601 bp, Human; identical to SEQ ID NO: 25484

SEQ ID NO: 73663 - DNA, 601 bp, Human; identical to SEQ ID NO: 25485

SEQ ID NO: 73664 - DNA, 601 bp, Human; identical to SEQ ID NO: 25486

SEQ ID NO: 73665 - DNA, 601 bp, Human; identical to SEQ ID NO: 25487

SEQ ID NO: 73666 - DNA, 601 bp, Human; identical to SEQ ID NO: 25488

SEQ ID NO: 73667 - DNA, 601 bp, Human; identical to SEQ ID NO: 25489

SEQ ID NO: 73668 - DNA, 601 bp, Human; identical to SEQ ID NO: 25490

SEQ ID NO: 73669 - DNA, 601 bp, Human; identical to SEQ ID NO: 25491

SEQ ID NO: 73670 - DNA, 601 bp, Human; identical to SEQ ID NO: 25492

SEQ ID NO: 73671 - DNA, 601 bp, Human; identical to SEQ ID NO: 25493

SEQ ID NO: 73672 - DNA, 601 bp, Human; identical to SEQ ID NO: 25494

SEQ ID NO: 73673 - DNA, 601 bp, Human; identical to SEQ ID NO: 25495

SEQ ID NO: 73674 - DNA, 601 bp, Human; identical to SEQ ID NO: 25496

SEQ ID NO: 73675 - DNA, 601 bp, Human; identical to SEQ ID NO: 25497

SEQ ID NO: 73676 - DNA, 601 bp, Human; identical to SEQ ID NO: 25498

SEQ ID NO: 73677 - DNA, 601 bp, Human; identical to SEQ ID NO: 25499

SEQ ID NO: 73678 - DNA, 601 bp, Human; identical to SEQ ID NO: 25500

SEQ ID NO: 73679 - DNA, 601 bp, Human; identical to SEQ ID NO: 25501

SEQ ID NO: 73680 - DNA, 601 bp, Human; identical to SEQ ID NO: 25502

SEQ ID NO: 73681 - DNA, 601 bp, Human; identical to SEQ ID NO: 25503

SEQ ID NO: 73682 - DNA, 601 bp, Human; identical to SEQ ID NO: 25504

SEQ ID NO: 73683 - DNA, 601 bp, Human; identical to SEQ ID NO: 25505

SEQ ID NO: 73684 - DNA, 601 bp, Human; identical to SEQ ID NO: 25506

SEQ ID NO: 73685 - DNA, 601 bp, Human; identical to SEQ ID NO: 25507

SEQ ID NO: 73686 - DNA, 601 bp, Human; identical to SEQ ID NO: 25508

SEQ ID NO: 73687 - DNA, 601 bp, Human; identical to SEQ ID NO: 25509

SEQ ID NO: 73688 - DNA, 601 bp, Human; identical to SEQ ID NO: 25510

SEQ ID NO: 73689 - DNA, 601 bp, Human; identical to SEQ ID NO: 25511

SEQ ID NO: 73690 - DNA, 601 bp, Human; identical to SEQ ID NO: 25512

SEQ ID NO: 73691 - DNA, 601 bp, Human; identical to SEQ ID NO: 25513

SEQ ID NO: 73692 - DNA, 601 bp, Human; identical to SEQ ID NO: 25514

SEQ ID NO: 73693 - DNA, 601 bp, Human; identical to SEQ ID NO: 25515

SEQ ID NO: 73694 - DNA, 601 bp, Human; identical to SEQ ID NO: 25516

SEQ ID NO: 73695 - DNA, 601 bp, Human; identical to SEQ ID NO: 25517

SEQ ID NO: 73696 - DNA, 601 bp, Human; identical to SEQ ID NO: 25518

SEQ ID NO: 73697 - DNA, 601 bp, Human; identical to SEQ ID NO: 25519

SEQ ID NO: 73698 - DNA, 601 bp, Human; identical to SEQ ID NO: 25520

SEQ ID NO: 73699 - DNA, 601 bp, Human; identical to SEQ ID NO: 25521

SEQ ID NO: 73700 - DNA, 601 bp, Human; identical to SEQ ID NO: 25522

SEQ ID NO: 73701 - DNA, 601 bp, Human; identical to SEQ ID NO: 25523

SEQ ID NO: 73702 - DNA, 601 bp, Human; identical to SEQ ID NO: 25524

SEQ ID NO: 73703 - DNA, 601 bp, Human; identical to SEQ ID NO: 25525

SEQ ID NO: 73704 - DNA, 601 bp, Human; identical to SEQ ID NO: 25526

SEQ ID NO: 73705 - DNA, 601 bp, Human; identical to SEQ ID NO: 25527

SEQ ID NO: 73706 - DNA, 601 bp, Human; identical to SEQ ID NO: 25528

SEQ ID NO: 73707 - DNA, 601 bp, Human; identical to SEQ ID NO: 25529

SEQ ID NO: 73708 - DNA, 601 bp, Human; identical to SEQ ID NO: 25530

SEQ ID NO: 73709 - DNA, 601 bp, Human
atttaacaatttgaaaggtgcaataaggtgtatttctattgttattctgtatttcagagacagggcaaatccgccgttgtgacgaaagtgcagggacaaagcacaaactcggctctggtggaccggatacggaaaagcggtgccttggggagggcgggagcaaattcgctttccccacagcgcgtgcgccgccgcaagcatggctggtgatgattggacgactggtaacagggggcggagggctccgaagtctggttttgggcgggaattgaaaccgccgctgaagccaacaagaatttgwgaactgtaaataccaagccttgaaagggaccatggtgcggcctgtgaggtgggtagttcctgacattcgtcgggggtgggaggaaaactaagggaaaagacatgagactaaggggaaaggatcgagtaagaccggagggcagcgatggtggggttaggatggacggttatcaagaacccagtctccagtgagagccacccgttgctcagaagtatcctagcatcgtagctttttccttctctttgcctcccttcacaaccgtcgccgtttcttttaccaagaccttgttagcgtttgaac

SEQ ID NO: 73710 - DNA, 601 bp, Human
gccaaggccccatacttgaccatattttagggacagtctaatgctataggattaacaagcagtggggagaatcgtagggggattaggccagagaaataggcaggtgccagaacagatagggtcttgtaagtcttagaaaggagtttaggttttattttaagtcaatgggaagtcagtggagggttttaagtaggggagaggaatctaagtttgcttttataaaggtcactggctgttggtggagaataaatgatggatagggtgaccagaacgggagcaggaaaatcaggtattatatcaytggagagcggtttgggatagggtattattagtgggcatggaatggaacagatgaatttgggatgtatttcggaggcactgtggacagaacttgctgatgaagtagatgtacaggtaagggaaagaaagaatcagagatgactccacaatagttttggtctgagctacaggatggatgatctttgtattaagatagggaagactaggaaaaggaaggttaggaggtgtgagggatcaagatttctgtttcgaacatgctgaatttgaaatgggttttaagcatccaggcagtggagtcata

SEQ ID NO: 73711 - DNA, 601 bp, Human
gatgtacaggtaagggaaagaaagaatcagagatgactccacaatagttttggtctgagctacaggatggatgatctttgtattaagatagggaagactaggaaaaggaaggttaggaggtgtgagggatcaagatttctgtttcgaacatgctgaatttgaaatgggttttaagcatccaggcagtggagtcataatccctttgtaaggaacagcagttgttaaagtatggtctacagacctctgtgggtccctggaaacttctctagaggtctatgaggtcaaaactcctttcataacwatactaagatatgatttgcctttttcgctgctttgtcatttgcactgcagtgaccccgataaaactgctggcacctcagaacaattaaggcagtggcactaaattgtactactagtctttgcaatgtttactgccatactcttaaaagtaaaaaaaaaaaaaaaaatcatttcagttaagaatatgcttgatgaagtagtggaaattattatattcatcatagcttaacccttaagtatactaattaaaaataggctattgattttattttactattattcaagttcagaatttataaag

SEQ ID NO: 73712 - DNA, 601 bp, Human
tgctgaatttgaaatgggttttaagcatccaggcagtggagtcataatccctttgtaaggaacagcagttgttaaagtatggtctacagacctctgtgggtccctggaaacttctctagaggtctatgaggtcaaaactcctttcataacaatactaagatatgatttgcctttttcgctgctttgtcatttgcactgcagtgaccccgataaaactgctggcacctcagaacaattaaggcagtggcactaaattgtactactagtctttgcaatgtttactgccatactcttaaaagtaaaaaaaaaaaaaaaaatcatttcagttaagaatatgcttgatgaagtagtggaaattattatattcatcatagcttaacccttaagtatactaattaaaaataggctattgattttattttactattattcaagttcagaatttataaaggggttttcacattttattcagctctaacttctttaactctgaagagtaagagagtaatatgagtgcactttttaatagtttgcgtgaggaaacaggaagtacacataaagcacttctgtatactgatgcgtgatagttatctcaaggaaa

SEQ ID NO: 73713 - DNA, 601 bp, Human
ccaaatgcatatgaggtaggtctggaaagatagttttctaatcatttgggataattatgctgataattatactgataaaaattatgttagtaggtgataaatgaacaggccaggtgaaaagtctctttagatctaaactactctaaagtccatagttgcaacatagaggtttgtctcctattccatccctgaagaaggaaaacactgtctttttgagatacaaagatgttacagcatattatataaaatccctattaattgtactataaaacaagaccttgaagaaaggttaggcttatgktatgccttttaagcattagtcatatgtttacttgactctgctatgattgaaaagtttgaggaacattgcattagattatgttatatgttgaagtggatttaatatttctttcttagaccactagagttttctgtaagtcaaatatttagtaagtcttcggtttgaaggaatctgtttttgccttgagcacagccttaactgtatctaccacttgggaaaaagagtgtagagtataacatctagctttttttttttttttgtcatcagtctgtcatcagatacttataaattgccaggtgt

SEQ ID NO: 73714 - DNA, 601 bp, Human
aaatccctattaattgtactataaaacaagaccttgaagaaaggttaggcttatgttatgccttttaagcattagtcatatgtttacttgactctgctatgattgaaaagtttgaggaacattgcattagattatgttatatgttgaagtggatttaatatttctttcttagaccactagagttttctgtaagtcaaatatttagtaagtcttcggtttgaaggaatctgtttttgccttgagcacagccttaactgtatctaccacttgggaaaaagagtgtagagtataacatctagctttttttttttttttgtcatcagtctgtcatcagatacttataaattgccaggtgtgtagtagtaggtggggggagtcctaagttatcttatttttacatggggaagcatataagagacaacaagtattagtgcttgctgagtatgtgatgaagactgcatagaccctgaaagtatgcatatatgtgttgtatacatgtggaaaagccacagcagtagttttacgttgacagtcaagagtagaactacaacagttcagaggattggtaagacagaaaaacctgtgagaaacagtaatggac

SEQ ID NO: 73715 - DNA, 601 bp, Human
aggaagtccttagagacccaaaacttgcagtatggagaagagatgggcggaaggggaatattaacaaatggaacatggcatatataatgttttactgccacaagtttctctatgaaaagtgagttagcctggagaaacttacctcatgtcatgctcttttttgcttttcttttttttggtttttgtttgtgagtttcttgtattacattttaaatatatagaaaaaggaacccacacgtgggagaaaatatttgtaaatcagataactgataagggactgtatccagagtatacacagaastcgtaaaactcaacagtaaaaagactaacaacacaatttaaaatgtgcaaaagatttcaatagactttctccagagaagataaacaaataaccaataaacacatgaaaagatgctcaatatcattagctgtgagggcaatgcaaatcaaaatcagaatgagataatacttcacacccactagatgacttaatacaaaagacaaggaatgtggagaaatttgaaccctcatatattgctggtgggaaagtaaaatggtgcagctaaattggaaaatggtttagcagttcctcaaaatgtta

SEQ ID NO: 73716 - DNA, 601 bp, Human
gaagttagcaactcttgaatagtaatttggagaaatctcaaactttgctctttagttgagattgatattttgaagaactcattattacttgtgtatctattttaggatggctttagatgacaagctctaccagagagacttagaagttgcactagctttatcagtgaaggaacttccaacagtcaccactaatgtgcagaactctcaagataaaagtaactttattttctgtatatttagctttaaaaccttcttaatgcttttgtgattatttgtttgggtgggccttcacagaggaaasaggtaaaatgtgaatactttgcactataaatagacccatttgcagagaatacgattggatttagttcttaattcagctgcctaaatctcatacaaacagacatacatctctgcttaacacccagaataagcttgagggcacggactgtgagcctcagtgttcgaattatatgttgttgtacagtgaacatttaatttcttcatcaaatgatttgatctgtacagtcctaacaatccatctccattttttccagatcagttaaacataccctaattatggtaatttttattacttacaaag

SEQ ID NO: 73717 - DNA, 601 bp, Human
gtttcttaaatcagtactgcctccttatttatttatttatttgagacagggtctctctctgtcatccaggcaggaatacagtggcatgatcatggctcaatacaaccttgacctcctaggctcaagcagtcctcctgcctcagcctcctgagtagccgggactacaggcatgtgccgccatgcctggctaattttttattttgtagagaggggtctcactatgttgcgcatgctgccctcaaactcccagcctcaagcaatcctcctgcctcagcctcccaaagtgctgggattacaggcragagccaccttatctggctgcctcctctttaaaaagaaatgaaagtttgattaggaagacttttagtaaccaagaatcaaagaaacatcaaaagagaattatcatgaattacatttaaaatggaggcactgaaattcatctctctcttttaagacattgtagaatgtataaggggagttccttagaagtattaatattataccatttcttattaaataatgcaccttatagcattggaatttaatagtaccaattattatgtcttaaagtcctcttagaatgctttgggtcattttaagg

SEQ ID NO: 73718 - DNA, 601 bp, Human
tatctggctgcctcctctttaaaaagaaatgaaagtttgattaggaagacttttagtaaccaagaatcaaagaaacatcaaaagagaattatcatgaattacatttaaaatggaggcactgaaattcatctctctcttttaagacattgtagaatgtataaggggagttccttagaagtattaatattataccatttcttattaaataatgcaccttatagcattggaatttaatagtaccaattattatgtcttaaagtcctcttagaatgctttgggtcattttaaggttattataacrattggagagttcttaacgttagtaaaagcatggatttgcctacacagaattgatagtttattgaccatttcctgtatattaggcacaataataagcaattcctatgtgagatccacatttggtcttctgtaataccactgggtaagacactatttttatctccacattatagatgaggaaattcagtcttaggataagcaacttgcccatggtcatatagccagtttacatggtagagcctgaatttaaacatgttagatttcagagcccagacttctaaccatatgttaacctctctga

SEQ ID NO: 73719 - DNA, 601 bp, Human
aattcagtcaaaaaagttcttggaagctattaattgtgcaaagcactgtgttaaacctttggggtgtgcaaacttcagggacacacagaacagttcaattcagtgatagcatttggggaaaaagttttttctacgagttaacctttaagctatgccttgaaaaatgagtagcgtttcaacaaactaaaggtgtaaagtagcatttctgactaacagaaaggcattacctgtggaatagacaaatgctctatttgtctctaactgaggcttgctgggatgaacatggaagaggctcgagagsgaggctggtactaatcagggagggtctcagacccactggaagaagtgtaggcttttttttcctggaggtagtagaaatccatgaattattctgaggcagaagtgatatgaaatctatattttattatgatggtttttagactcatttagaaattgggcaaatggaaagtgtagtgaccttgacagaacattataacatattaattaaaaatttaaattcataaattcataaatgtaggccaaatcaagataccatattttagattttgatatactatcaacaaacaataacagatttgct

SEQ ID NO: 73720 - DNA, 601 bp, Human
ttacctgtggaatagacaaatgctctatttgtctctaactgaggcttgctgggatgaacatggaagaggctcgagagggaggctggtactaatcagggagggtctcagacccactggaagaagtgtaggcttttttttcctggaggtagtagaaatccatgaattattctgaggcagaagtgatatgaaatctatattttattatgatggtttttagactcatttagaaattgggcaaatggaaagtgtagtgaccttgacagaacattataacatattaattaaaaatttaaattcatamattcataaatgtaggccaaatcaagataccatattttagattttgatatactatcaacaaacaataacagatttgctcatcgtcacttattcgactaatatttgaatgctttttatgtgcattatattctagatactagggatacaatagtgaaaaaaacaaacagctcctgtccttctggaacaacggaaatacatgaaaaaagactgttttgcatttgttttactttgggagggcctgggagacaggaaaatgcaaagacactctttgagcgccaatgtgatgcttaaaggaaatact

SEQ ID NO: 73721 - DNA, 601 bp, Human
aaatctatattttattatgatggtttttagactcatttagaaattgggcaaatggaaagtgtagtgaccttgacagaacattataacatattaattaaaaatttaaattcataaattcataaatgtaggccaaatcaagataccatattttagattttgatatactatcaacaaacaataacagatttgctcatcgtcacttattcgactaatatttgaatgctttttatgtgcattatattctagatactagggatacaatagtgaaaaaaacaaacagctcctgtccttctggaacaamggaaatacatgaaaaaagactgttttgcatttgttttactttgggagggcctgggagacaggaaaatgcaaagacactctttgagcgccaatgtgatgcttaaaggaaatactcatttgagcattttggatttctggaattggaatgcccaactggtataatgcagatgttccaaaacccaaagaaaatctgaaccctgaaacatgtctggtcccaagcacctcagataagggatactcagcctatactatatgatctagcaatccacttctgagtatgtatccaaaacgattgaaagca

SEQ ID NO: 73722 - DNA, 601 bp, Human
agaagttaggatatttttgagttcatagtatatgataggttattgcaaaatataactgtcattaactgagtttgttttatttcttgataatcatttttatgtcttggtttatttaatatatatgctattgatattaaaagttccattatttagtctttccatttattcataggagctgctgtcaccttcagtagcctgttgctgagtacttactaagaattaaatgagaattaagtactgattgagttatattcttctctctcctgtattttgaattaatgaggttttttaattagagtgttttttttttaattgatgacttcatctgggttccagaaattctgagtatcagaagtcgaaagtggttctcactgggctaaaatcaagtagtcagcaaaactgtggtcctttgtggaggctctaggagacaaaccacgttcttgtcttttctagctccttgagggtgcatttcttggcttgtggccccttccaccttcagagagcaatggcagggactttctcacatcatgttactcgactctgactttcttcctgctcacgtttacttataaggaccctgtgattacattgggcccctcca

SEQ ID NO: 73723 - DNA, 601 bp, Human
ttttccttctattctccaccttagcaggcccccatttcctcttacctgattaccataataaccttctaagtagcctacttctcctacactaccaccagaaagatgtttttaaaatacaaatcactcctgagaaaaatatgtgcatgactgtgactagccagactcttgtacatggtctgcaaagctcttcataagtgatctacacccagtgtctatctctcacatttcctacccttgagatttctgctccagccgtacactgaaccagtcagtactactgattctggaacttggtgcatcytccatctttgcacactgtactccctctgcctggaaagcttctctcaattcacctttactcttcaatcttgatttggttcagaccatcctcactcacctccttctaactttaaaacacatacccccagattgcagtttccttttctacttggcatacctttagagtctgccatatcccttaccacactgcattttacacatctttactttcctgttcttcccactgaagtctagtgactaaaccttaaagtccttgggagcaggagccatgtttctaaccctagagcctgacacataatct

SEQ ID NO: 73724 - DNA, 601 bp, Human
ggagcgcgtacccttttgaaggaagcagctgctactcagctccatcgtattgtttccatgcaagattatgggcttggtatttctagatctgattgctgttttcaagagaagccagaaatccagattttaatatgaaatctgctaatttttgtaagttgattttttttgttgttgttgttagcaccatgtgaaccaaaacaatatatctgagagctagatttggccctcagattgccagtttgttacctatcttatacaactggagaagaccaccaagaccccaaaagtaaaattagccagwggcataaatataacagtgtccccaagaactattaatacaacaagaaaatatgaagagtttcagtctcactggtaattaaggaagtgtaaattaaaataaaatactattttatacctttcaaactagaaaacaataaagcagtatagtctgagttatagggtagcaggtataattatttattttaaatttataatactgttgtgtaggcgagcaactacagtcaccatcaactgtgaacattcatgtggataattttgaaatagatggaaataattgcgacattaggataatagtataatg

SEQ ID NO: 73725 - DNA, 601 bp, Human; identical to SEQ ID NO: 24548

SEQ ID NO: 73726 - DNA, 601 bp, Human
cagtggtgcgatctcagctcactgcaagctccacctctggggtacaagcgattcttctgcctcagcctcccaagtagctgtgactacaggcaggcaccacaccccactaatttttgtatttttagtagagacagggtttccccatgttggccagactggtctcgaacccctgacttcaagtgatcctcccacctcggcctcccaaagtgctgagattatacgcgtgagccaccgcatctggcctcttttgggtaacttttaattgtagtgtgtaattttttcctgcactttttttttcccrtaatacacatgacaactcattgaacagtacaaaaagttatctacatagactaggaaaagtagatctccctcccactaccctgacccgaagttcccctccccgcattcatgtttaactctttaaagatgcaatgtttagctagtgcctatgtctaaggaaacaaaatcacatttctatttttaaaaatctgaagtcagttcaatttattttgctgcttctcagtcattttaattcactctaactagcactcagtgatcccttggggcctgatacgaggtgggctttcaaggaaaaggtcta

SEQ ID NO: 73727 - DNA, 601 bp, Human; identical to SEQ ID NO: 39780

SEQ ID NO: 73728 - DNA, 601 bp, Human; identical to SEQ ID NO: 39781

SEQ ID NO: 73729 - DNA, 601 bp, Human; identical to SEQ ID NO: 39782

SEQ ID NO: 73730 - DNA, 601 bp, Human; identical to SEQ ID NO: 39783

SEQ ID NO: 73731 - DNA, 601 bp, Human; identical to SEQ ID NO: 39784

SEQ ID NO: 73732 - DNA, 601 bp, Human; identical to SEQ ID NO: 39785

SEQ ID NO: 73733 - DNA, 601 bp, Human; identical to SEQ ID NO: 39786

SEQ ID NO: 73734 - DNA, 601 bp, Human; identical to SEQ ID NO: 39787

SEQ ID NO: 73735 - DNA, 601 bp, Human; identical to SEQ ID NO: 39788

SEQ ID NO: 73736 - DNA, 601 bp, Human; identical to SEQ ID NO: 39789

SEQ ID NO: 73737 - DNA, 601 bp, Human; identical to SEQ ID NO: 39790

SEQ ID NO: 73738 - DNA, 601 bp, Human; identical to SEQ ID NO: 39791

SEQ ID NO: 73739 - DNA, 601 bp, Human; identical to SEQ ID NO: 39792

SEQ ID NO: 73740 - DNA, 601 bp, Human; identical to SEQ ID NO: 39793

SEQ ID NO: 73741 - DNA, 601 bp, Human; identical to SEQ ID NO: 39794

SEQ ID NO: 73742 - DNA, 601 bp, Human; identical to SEQ ID NO: 39795

SEQ ID NO: 73743 - DNA, 601 bp, Human
tccttgtgggccgcagccggacactcccgccgcggcgctcaccccttcaagtttcctcccgggatccaaagccccaggggtcggaatacagacctttctggcacccgaaacctctgtttcgggaagcctggctcttctttggggttttcacgccaaaagggcttttctaggatatttcctcgatttttaattattttttgaaaccatccccccctgctccgactccagctgccgaggctgcggcgctcttcctcctctcctccctccccctctcttccccacctctcctcacccgcccccycaaaagcggcccctgggccgcagggatccccccagacattttttccaattgtcgggaatgatagaggaggatctggggatccggatgagaccaagaagtggacccccggagcctccagaatatttttattgattttttgaaaagatgacgaaatccaaaaaagagtgagtgagttagagtgcgcgaaggagtagccaaagggagcgtcgcggagctgccgcggctgctgcgcacttctccgactccccgttttggagctgtagttcacccccttttataggatccctgggaataccaaag

SEQ ID NO: 73744 - DNA, 601 bp, Human
cgccgcggcgctcaccccttcaagtttcctcccgggatccaaagccccaggggtcggaatacagacctttctggcacccgaaacctctgtttcgggaagcctggctcttctttggggttttcacgccaaaagggcttttctaggatatttcctcgatttttaattattttttgaaaccatccccccctgctccgactccagctgccgaggctgcggcgctcttcctcctctcctccctccccctctcttccccacctctcctcacccgccccctcaaaagcggcccctgggccgcagggayccccccagacattttttccaattgtcgggaatgatagaggaggatctggggatccggatgagaccaagaagtggacccccggagcctccagaatatttttattgattttttgaaaagatgacgaaatccaaaaaagagtgagtgagttagagtgcgcgaaggagtagccaaagggagcgtcgcggagctgccgcggctgctgcgcacttctccgactccccgttttggagctgtagttcacccccttttataggatccctgggaataccaaagcactgatgggctattctgattcactcc

SEQ ID NO: 73745 - DNA, 601 bp, Human; identical to SEQ ID NO: 23241

SEQ ID NO: 73746 - DNA, 601 bp, Human; identical to SEQ ID NO: 23242

SEQ ID NO: 73747 - DNA, 601 bp, Human; identical to SEQ ID NO: 23243

SEQ ID NO: 73748 - DNA, 601 bp, Human; identical to SEQ ID NO: 23244

SEQ ID NO: 73749 - DNA, 601 bp, Human; identical to SEQ ID NO: 23245

SEQ ID NO: 73750 - DNA, 601 bp, Human; identical to SEQ ID NO: 23246

SEQ ID NO: 73751 - DNA, 601 bp, Human; identical to SEQ ID NO: 23247

SEQ ID NO: 73752 - DNA, 601 bp, Human; identical to SEQ ID NO: 23248

SEQ ID NO: 73753 - DNA, 601 bp, Human
attagtgtttggagggaggtgagttgtgcttcctgagctctgtttaccatttcacgagtcaagaagtggtgtatttccttcattcgtttctggaagtctttactgaaggcccagttgttgctagaagttggggtggatggtggcatctgggaaatagaggatgagattcctgccttcaaggaacttagcagttgtatgatgaagcaagagtaaagcgtgcaaaaccctagcaaattaagaacgtaaacaaaggtgtgctacgtaacgtgttacgaaccctaaatgcagtaggaaatcaacycaaaagaaggagctcatcaggcctaacgtagaatgccggcctcccagcagagaaaacttggtgatagaaactgttcttagagtagagaaacaaaatgtatgggcacgcaatggaatattattcaaccttaaaaagaaatgaaattccgatccatgttataacatgggcgaaccttgaaaatactatgttaagtgaaacgagccagacacaaaaagacaaatactatatgattccacttataccaggtacctggaatagtcaaattcgtagagacagaaagtagaatagaggttcccagga

SEQ ID NO: 73754 - DNA, 601 bp, Human
tttcatatgacacagttgcacaaattcactaactaaaaaatggaatggaggctcacaggccataaaggtgttgtgaagttattgcaagatacttaacagaagaaagactctagtcatctgttccttatatttatccttttttgtctaagtcacatcaaaactctttgtcacattctttaaaaacaaaaagcaaaaaacaaaactttagattcaggggatccatgtgcggtttgttacgtggatatatcgtgtgatgctgaggtttgggcttcagtcgaacccgtcacccagacagtgtacrcagtacccaatagggagtgtttcaactctcgtccctgtccctagacacattcttaaatattgcccagagaagattccaggatatcccttccttagggtcatcctggcattttacggtcctggttatcagtgagctattaaaaagcagggaggtggaggcgccgtggaagaagtctcagtttcgaccacatgtgtgtgattcatggggtttagcattgtgtgtttctgctccgtagctggaagtgccgccaccctcgccccacatgtcattttcaagcctccactgttacagattctgtct

SEQ ID NO: 73755 - DNA, 601 bp, Human
tttatccttttttgtctaagtcacatcaaaactctttgtcacattctttaaaaacaaaaagcaaaaaacaaaactttagattcaggggatccatgtgcggtttgttacgtggatatatcgtgtgatgctgaggtttgggcttcagtcgaacccgtcacccagacagtgtacgcagtacccaatagggagtgtttcaactctcgtccctgtccctagacacattcttaaatattgcccagagaagattccaggatatcccttccttagggtcatcctggcattttacggtcctggttatcartgagctattaaaaagcagggaggtggaggcgccgtggaagaagtctcagtttcgaccacatgtgtgtgattcatggggtttagcattgtgtgtttctgctccgtagctggaagtgccgccaccctcgccccacatgtcattttcaagcctccactgttacagattctgtcttctgtggactcttcagggcctgtggtcaggaaccttgtgaagtgttgctggaagctgggggtggggaggtggaatagaatcgggggctgatgcctccctctcctgcctcatttttctgtgggcctcatt

SEQ ID NO: 73756 - DNA, 601 bp, Human
aatttggggcatcttaacacaatggctggtgctttggaggctgcaggaaagctgatgtcctagagccgccacacttgacatgcgtgtaacaccttttgattagaggcgctttcgtgtttttccagccacttgggctctgtctctttttcttggagattctctggtctgtatgtctttacttagagcttagaagtcgaggtatataggaaaaaggagttctgaaattggaggcttgccctttctaaagccagtctgagctttcagccagatgtcactgggacaagccacgtcaactctccaygctccattccctagctgggaaacgagggcatttggctatttgatttccagaggccctttggacctccaaattctccaagtctgtgattatttgtgtatgtcttcttataatccagcccctttggaagcactaactccactcttctctcagcttgatcctctaatagaagcaacctggttggatttaaggtggaggtcttcctctctccaggtggctgccctcatctctacccccaccccaatcccatgcattctcctgccctcctgctttgggcaagacccaggcgatgtggagttggca

SEQ ID NO: 73757 - DNA, 601 bp, Human
agccacgtcaactctccacgctccattccctagctgggaaacgagggcatttggctatttgatttccagaggccctttggacctccaaattctccaagtctgtgattatttgtgtatgtcttcttataatccagcccctttggaagcactaactccactcttctctcagcttgatcctctaatagaagcaacctggttggatttaaggtggaggtcttcctctctccaggtggctgccctcatctctacccccaccccaatcccatgcattctcctgccctcctgctttgggcaagacccrggcgatgtggagttggcatgtccagttgcaggtatcagcaccactgcaccatctcctctgccttcacttcccaccagcacacagaatttatatgcccttcccaagtccaaaaagggcccctgccatgctaaacaaaggtattcatatgcaaggcatgagctctgtctcatggaagggagaggccaagttctctttccaccatcagagagtagcgttcaacatcatttatacaagacaggcttttgcccttttagtcttgctgaactagaatgagggatttgtgtagtcgaaagtcaagct

SEQ ID NO: 73758 - DNA, 601 bp, Human
cctctctccaggtggctgccctcatctctacccccaccccaatcccatgcattctcctgccctcctgctttgggcaagacccaggcgatgtggagttggcatgtccagttgcaggtatcagcaccactgcaccatctcctctgccttcacttcccaccagcacacagaatttatatgcccttcccaagtccaaaaagggcccctgccatgctaaacaaaggtattcatatgcaaggcatgagctctgtctcatggaagggagaggccaagttctctttccaccatcagagagtagcgttcracatcatttatacaagacaggcttttgcccttttagtcttgctgaactagaatgagggatttgtgtagtcgaaagtcaagctgatcattgtcaagtttcgtggaagtggaacctgaaggaaggttaggtggagactgcagagagggttagcgtcctgccttaccacaaggtaagtctagaagagggtggggaagggagttcagaattcttcattcatggagtgtacctgccttggtcatccttttatcttccagtcagaggggtcatcagtcaagagctggccaggctgggtgtggtggc

SEQ ID NO: 73759 - DNA, 601 bp, Human
gaacttacataaaacactactgtgcacgcacatgtcacctcaagtcccgtggctctgaaagtccagtagaagtgacagccagacatcccagtcctccctgtagggttttctcagaactgttcctttaaggtctcaggctgctggaagggagggctgatagcagaaaaagtggggacactgggaactccaaagggaagacgcgcatggcctgaaaccgagttctttcgctttctggagcctggtctccctatgtggagggtcatgctggcatggctggcaatggttaattcaccgatggccrtggagtcccaagttggccatattattgcggtaaaagatacattaacccagatgaccttgccgggggccagaatagagcccgtgaggaaggagagcaaggcaggatcggccgggaggcgagagggattttgttgaggagcaaggtcttccacaggaactgcgacttggaaagtattcaccaagggctgtgccatgcgaaaccctctttaaaggaaccgcatcgctacgcctaacgggcatttcttttttaatgtaatggttcagagctattgtctaccacgcctcgcgtgcacacgcacac

SEQ ID NO: 73760 - DNA, 601 bp, Human
gccatggagtcccaagttggccatattattgcggtaaaagatacattaacccagatgaccttgccgggggccagaatagagcccgtgaggaaggagagcaaggcaggatcggccgggaggcgagagggattttgttgaggagcaaggtcttccacaggaactgcgacttggaaagtattcaccaagggctgtgccatgcgaaaccctctttaaaggaaccgcatcgctacgcctaacgggcatttcttttttaatgtaatggttcagagctattgtctaccacgcctcgcgtgcacacgcrcacacacgcaagttccctcagtcagccgagaatcctgccatctcttttagataacaaaagctcttaggccttatgctttgggtaggatttgtcttccatggacaggtattcagttggaaacaagtatatagtcactgcctctatggtatggagatactccgatttagtccctctgcctcttggggaaaaaaaaaaaaaattgtaaacatccccttcagcagcttctcaagtccctgtacagtggaggaacattacacgtgaacttcctggattcaatggattcttctttgcaagaaaaaa

SEQ ID NO: 73761 - DNA, 601 bp, Human
gacttggaaagtattcaccaagggctgtgccatgcgaaaccctctttaaaggaaccgcatcgctacgcctaacgggcatttcttttttaatgtaatggttcagagctattgtctaccacgcctcgcgtgcacacgcacacacacgcaagttccctcagtcagccgagaatcctgccatctcttttagataacaaaagctcttaggccttatgctttgggtaggatttgtcttccatggacaggtattcagttggaaacaagtatatagtcactgcctctatggtatggagatactccgatktagtccctctgcctcttggggaaaaaaaaaaaaaattgtaaacatccccttcagcagcttctcaagtccctgtacagtggaggaacattacacgtgaacttcctggattcaatggattcttctttgcaagaaaaaaaacaaaacaaaaaaacagagaaagaagaaaatatcaatttagattgttaggtccaacgtttcactcagtgagtgagcacagggggtgacggaggatggctggaatgtggggttgaagctgctgttctgggtctcagctcctgcccatgtaccgtggagtgagca

SEQ ID NO: 73762 - DNA, 601 bp, Human
tttcaggccgggctcagtggcttatgcctgtaatcccagtacttcgggaggccaaggcgggcagatacctgaggtcaggagttcaagaccagcctggccaatctggtgaaatcccatctcaactataaatacaaaaatcagctgggcgtggtggcacgtgcctataatcccagctgctcgggaggctgaggaaggagaattgcttgaacccgagaggtggaggttgcagtgagccaagattgtgccattgcactccagcctgggcgacagagcaacactctgtctcaaaaaaaaaaaaaamaaaaaaaaaaaccagaaaagaaaagaaacattataccttaacttttcgcacctagtgagtgataacctatgaggataatgctgccacatggtccttgagggaagaacttggggaagagccgaacagggatgaggcaggtgagccccatgtgatttatcgtcattcattcagctcaacaggtcggacagggtaagggtaagggatgtaaccaggagatgccacaggaacgtctgagaggtgttagcaagtcccagaggccagcgcccgactccatttcagcctcgttcagggtggcacgga

SEQ ID NO: 73763 - DNA, 601 bp, Human; identical to SEQ ID NO: 23249

SEQ ID NO: 73764 - DNA, 601 bp, Human; identical to SEQ ID NO: 23250

SEQ ID NO: 73765 - DNA, 601 bp, Human; identical to SEQ ID NO: 23251

SEQ ID NO: 73766 - DNA, 601 bp, Human
agggtggcttcaggagaaagaggtatctctggagaagaggatgtactttggaaagaaggggaatttttaggggctgcctggactaacggtaatacagtagggtctttcttggtggtgagtcctgcttgggctggagagaaaggggctccttcaagagaggcaggtacagtttggaggtctttttgtgttggaaatttaaccaatactgaactggggagatttttgaggtcttcagggtctggcagaggaggagagactggtatcctcagagtggttgctacttgagtagaaggctctttgsgagccacaggtgccataaccaaggcagcaggggaagttggttctatgttacttatgggacctgatgacattggaggagaaacacaagtagctacctcaaaggtagtagtaggtgctgcagcaattgtacaggggttagtcaccacaagtggggtggttccaacagaagaaacgggcatttgggccactaaaggataatgataagtggcattaggagagcttttgagaatgagagaggttgtaggagataatgaagaagaggtagctacatttaaggagccagaagggctgcaggttatgc

SEQ ID NO: 73767 - DNA, 601 bp, Human
cacacggcaaaccaaggcaaatacccttgttgttcttcgtaacaggttgcttggcagagggggttgggacagggattccagcagatttaggggtgggcatgttgacgaggaccgactggaaaggcactcccccagagattggttccgggggaatcagaggcggcagctcatcctcatcagcaggggcaaggggtttagagggtgattccaacaccagcccaggagaggacggcagaaattgctgtttaggaggcagagtgggaactggggagggagcaagaggcagagagactggtggggwgggtgctgcagagacagatgctgattcaggtttaggaaggaccttctcaaaggcagctgctgttagaggggtggacgccttagactcaggaggagccaaggggccctttggggaatgagaagcatctttgccttttgctgtctttgaagagtctttctgaacagggagtagaggggctggagccactgtggaaaggggtcctttagaaccattcttagctgagggatctgggcatataggaggtgaagtagcagaactctttttggtctgtggacctttccgagtgggagctgtgatgat

SEQ ID NO: 73768 - DNA, 601 bp, Human
actgtaactgctttctttccctcaaggtctttgtttcttggcacaggcaaataatgacccatatgactctaaaattttacccaatagtccaattatccctgtaaagttctgtcagaaggtgcccccagatacacttaagtgaaaaaaccaaaatcacaccgtggaggcacaacaggttgggtggttttcccctcaacttttaaactgggttggaggaagtcaaaagcagacacgtacacatattcagcctcattttcaaaccattcaccccagcaatgtgatctaatcaatataattagargattctcaatgatgatgacctatatctctagtttttccaaacataattcacataaatttctttcaattcaaaggccaagcatcagtaaagactactgaggaaaaaaagcatacacctgcaccattttcaggctaggaaaaacagatttctacatttttatgaaaagggagtccctgggcaactggtcattactaagtctaataatggaaaaataaatacaaatagttcaattctccaataattttaccaaatctcaggcccagggacaaggttagttagtgatgtggtagggattagagc

SEQ ID NO: 73769 - DNA, 601 bp, Human
ctccttcctcaacctgctcctctttattctcccctagaaccctccttccttcttcagggctaccttctgctggagttcacccttcctaagactcaggagttcctaagattcaaaaccgtgtatttatggggacagtggctgtcatctgggacctatggtctcactgttgtagccagggatatatagggggcagggtcaggggcaggtggtgttctgtggatagtgcaaggtcagcagggactagtgcagagagaaacctgaggaccaagaggttacctggggagatgaggaaggggccctmctggtatgaggcactttgaggagaaagctgcctgtcttcactcccagaagtgacacagcagtgtgacacagtctactccctactcccaaataggaattagcaagagttaaggccaggtgcagtggctcatgcctgtaatcccagcactttgggaggccaaggaaggcagatcacttgaggtcaggagttcaagaccagcctgggcaatgtggtgaaacgctgtctctacaaaaatacaaaaattagctgggtatggtggcatgcacctgtagtcccagctacttggagggctgaggtggg

SEQ ID NO: 73770 - DNA, 601 bp, Human
ttgcttgagcccaggagtttgacgctgcagtgagcgagattgtgccactcgtaacagagcgagaccctgtctcaccaaaaaaaaaaaaaaaggccaagctcggatcacctgaggtcaggagttcgagaccagcctgaccaacatggaaaaaccacatctctactaaaaatacaaaattagccaggtgtagtggcacatgcctgtaatcccagctacttgggaggctgcggcaggagaattgcttgaacccgggaggtggaggttgtggtgagccaagatcgcactattgtactccagcctrggcaacaagagcgtaactccgtctcaaattttaaaaaaaagaaaaaaagaaaggaaagaaagaaggaagaattaaaacagttaaagagtctttaatgcctgaaggaggagaggagattgagattattttgccctgttgtctctctcatttacataatctgctctgtcacagtggattcgagaagtgacaggctatgtcctcgtggccatgaatgaattctctactctaccattgcccaacctccgcgtggtgcgagggacccaggtctacgatgggaagtttgccatcttcgtcatgttg

SEQ ID NO: 73771 - DNA, 601 bp, Human
taacagagcgagaccctgtctcaccaaaaaaaaaaaaaaaggccaagctcggatcacctgaggtcaggagttcgagaccagcctgaccaacatggaaaaaccacatctctactaaaaatacaaaattagccaggtgtagtggcacatgcctgtaatcccagctacttgggaggctgcggcaggagaattgcttgaacccgggaggtggaggttgtggtgagccaagatcgcactattgtactccagcctgggcaacaagagcgtaactccgtctcaaattttaaaaaaaagaaaaaaagamaggaaagaaagaaggaagaattaaaacagttaaagagtctttaatgcctgaaggaggagaggagattgagattattttgccctgttgtctctctcatttacataatctgctctgtcacagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcag

SEQ ID NO: 73772 - DNA, 601 bp, Human
ccttaaccctgtcacttctttccctacctcagagattctgtcagggggtgtttatattgagaagaacgataagctttgtcacatggacacaattgactggagggacatcgtgagggaccgagatgctgagatagtggtgaaggacaatggcagaagctgtaagtggccgtgatcaagattgctccccagtcccaccaaaccagagtgactcccttctttccatcatccttacattcctgatctgaacccgcctccccagtgaacaaacacctcaggtccctgactcagcagcccaccaggrcagaccattccagtctcctggaatctaaaccacagaggaggtgtttcaagaaaaggagcaggccgagcatggtggctcatgcctataatcctggcactttgggaagccaaggtgggaggatcgcttgagcccaggagtccaagaccagcctgagtaacatagcaaaaaatctacaaaaaattaaaaaaatcagacaggcgtagtggctcgcacctgtaatcccggctactcaggaggctgaggcagaggattgcttgagcccaggaggctgcagctgcagtgagctgtgattgtgccatt

SEQ ID NO: 73773 - DNA, 601 bp, Human
aaaaatctgtctccaggctgggcccggtggctcatgcctataatcccagcactttgggaggccgaggtgggcggattacgaggtcagatcgagaccatcctggctaacatggtgaaatgccatctctactaaaaacacaaaaattagctgggtgtggtggtgcacatgcctgtaatcccagctactcaggaggctgaggcacgagaatcacttgaacccaggaggcggaaattgcagtgaaccgagattacaccaccgcactccagcctggcgacagagcgagactctttctcaaaaaaaraaaagaaaagaaaagaaaattctgtctccccatgacttttagctgttttcactcattctgctccttggagcaaaaagaacaaagggactttctagtctataggacagcatttaaaatgtgtgtgtgtgtgtaaaaaaaacccactatgaccacctgttttttttttcctttaattttttattttgacataattttagatctacactaaagttgcaagaatggtataaaattccccatatactttttttttttttttaagacaaagtctcactctgttccccaggctagagtgcagtggtg

SEQ ID NO: 73774 - DNA, 588 bp, Human
cgagattacaccaccgcactccagcctggcgacagagcgagactctttctcaaaaaaaaaaaagaaaagaaaagaaaattctgtctccccatgacttttagctgttttcactcattctgctccttggagcaaaaagaacaaagggactttctagtctataggacagcatttaaaatgtgtgtgtgtgtgtaaaaaaaacccactatgaccacctgttttttttttcctttaattttttattttgacataattttagatctacactaaagttgcaagaatggtataaaattccccatatactttttttttttttttaagacaaagtctcactctgttccccaggctagagtgcagtggtgcaatcttggctcactgcaacctccgcctcctctgcctcccgggttcaagcaattctcctgcctcagtctcctgagtagctggaattataggtgtgtgccatcatgcccggctaatttttgtatttttagtagagacagggtttcaccatgtaggccaggctatctcgaactcctgacctcaagtgagccacccgccccagctaaacaaaggtttgtaacccctacgggc

SEQ ID NO: 73775 - DNA, 601 bp, Human
gaagcctgtgtcataggcattctttagtaaaatacaaggcactgtctcatacagcagtgcctcaaaaccaaagggtttcagagtttcacgaggaaaaggcaaaaggagggggattccctctcagtggatctgactagcactgagcaaatttcttgactaacatgaatcctttgaatagttaatgttcccttagtagtctctcctctcatcctgtctccttattctcagccggggcttctcattgttgatcatgaagaacttgaatgtcacatctctgggcttccgatccctgaaggaaatyagtgctgggcgtatctatataagtgccaataggcagctctgctaccaccactctttgaactggaccaaggtgcttcgggggcctacggaagagcgactagacatcaagcataatcggccgcgcagagactgcggtgagggaaagggtctgctaggtggtgagaatagggagtcagggaggagagggctgaaaggactattctgccctagacgtgggagtagggttgagggatggaaccaaggagaagggggctgttaggctggaagcagtaacgaggaagaataatgaagagagggcttg

SEQ ID NO: 73776 - DNA, 601 bp, Human
caagaatcactcccagctggccgggcgcagtggctcacacctgtaatcccagcactgtgggaggccgaggtgggtggatcacctgaggtcgggagttcgagaccagcctgaccaatatggagaaaccctgtctctaccaaaaatttaaaattagcccggcgtggtggcgcatgcctgtaatcccagctacgcgggaggctgaggcaggagaatttcttgaacccaggaggcagaggttgcggtgagctgagattgcatcattgtactccagcctgggcaacaagagtgaaactctgtctcaaaaaaaaaaaaaagaatcactcccagctgtgtagcgaaggattggagaaagggaaaatcagtaacagcacaaaattacaccacagttttgggaacctggaataacctcagttcaagggagtttcacagaagaggggcttggggagagctagtgagctggaggtggaggccatgtcttgggatcagctctgggctccaggatgggatgccacggtaagttctgaaacaagcttttatatgttaggctgttgaaattgagcctctgctgtccaagctctcatttaaggtggtgactttcttc

SEQ ID NO: 73777 - DNA, 601 bp, Human
aaaagaaggcagtgagggccgggcgagttggctcacacctgtaatcccagcactttgggaggccagagagagtggatcacctgaggttaggagtttgagaccagcctggccaacatggtgaaaccccgtctctacccaaaatacaaaaattagctgggtgtggtggtgcacacctgtaatcacagctactcaggaggctgagacaggagaatcgcttgaacccgggaggcagaggttgcagtgagctgagattgtaccactgcactccagcctgggtgacagagcaagaccctgtctcttaaaaaaaaaaaaaaaggccaggtgcggtggctcacgcctgtaatcctagcactttgggaggccgaggtgggcggatcatgaggtcaggagttcgagaccagcctgaccaacatggcaaaaccctgtctgtactaaaaatacaaaaactagctgcacatgatggcaggtgcctgtaatcccagctactcgggaggctgaggcaggagaatcacttgaacagggaagcagaggctgcagtgagccaagataatgccactgcactccagcctgggcgacaagaacaagactccacctcaaaaaa

SEQ ID NO: 73778 - DNA, 601 bp, Human
cctgtctcttaaaaaaaaaaaaaaaggccaggtgcggtggctcacgcctgtaatcctagcactttgggaggccgaggtgggcggatcatgaggtcaggagttcgagaccagcctgaccaacatggcaaaaccctgtctgtactaaaaatacaaaaactagctgcacatgatggcaggtgcctgtaatcccagctactcgggaggctgaggcaggagaatcacttgaacagggaagcagaggctgcagtgagccaagataatgccactgcactccagcctgggcgacaagaacaagactccmcctcaaaaaaaaaaaaaaaaaaaaaaaaggcagtgaacaacccaatatccttctaaacaaatctctcttctttcctcatcatgtaaatttccttgcattattttctgtttattttcttccttaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggtgcaggagccggagcccacggcc

SEQ ID NO: 73779 - DNA, 601 bp, Human
ggggtttctctgtgttggtcgggctggtctcaaactccagacctcaggtgatctgcctgcctcggcatcccaaagtgctgggattacagacgtgagccactgtgcctggcctagtgtggttttcatttattttattttatttatttatttatttttttgagacggagtctcactctttcgcccaggccggacgcagtggcactatcttggctcagtgcaagctccgcctccagggttcacaccattctcctgcctcagcctcccgggtagctgggactacaggcacccaccaccacgcccrgctaattttttgtatttttagtagagacggggtttcaccatgttagccaggatggtttcgatctcctgaccttgtgatctgcccacctcagcctcccaaagtgctggcattacgggcgtgagccaccgcgcccggccttttttttttttcaagacagagttttgttcttgtcaaccagactggagtgcagtggtgcgatcttggctcactgcaacctctgcctcctgggttcaagtgattctcctgcctcagcctcctgagtagctgggactataggcatgagccaccacgcctggctac

SEQ ID NO: 73780 - DNA, 601 bp, Human; identical to SEQ ID NO: 19190

SEQ ID NO: 73781 - DNA, 601 bp, Human; identical to SEQ ID NO: 19191

SEQ ID NO: 73782 - DNA, 601 bp, Human; identical to SEQ ID NO: 19192

SEQ ID NO: 73783 - DNA, 601 bp, Human; identical to SEQ ID NO: 19193

SEQ ID NO: 73784 - DNA, 601 bp, Human; identical to SEQ ID NO: 19194

SEQ ID NO: 73785 - DNA, 601 bp, Human
caagattgcaccactgcactccagcctgggcgacagaatgagattccatctcaaaaaaaaaaaaaaaaaaaaaaaaaaaaagatttagatcatgttccccttcaacctctggcttttcagactgaaggatccttgaagcctggctttatgtagaagctcccatctcctttaatataacagtacagtggtgcagtaggctgtcttcaaatcagcaatatgttttattgtcttttatcttggttgtaaccaagagcttaaagaccattagcctatacatatgtaatgtgcatttatccccccrgtgcattaccttacaattgtccgtattcctctctcaattcatcaaaaaatatttgttaagcacctagtgggtacccagcaccatgctaggtgctgtggggaacacagaagaaatggaagacagagtctctgcccgctgtgctcgtatctagaagtggctgcatcacaaggttgggggatgaccgcagtgtctaccccctaccccgtgagtggcttgggatacctttgctacatgtcagtggcaccccagacattcaccccctcccagacccacccagccttggggatctgcaaagccatg

SEQ ID NO: 73786 - DNA, 601 bp, Human
cttggctcactgcagctttgacctctcaggttcaagccattctctgcctcagcccctcaaggagctgggactacaggagtgtgccatcatgccagctaattttttgtagagatgggattttgccatgttgcccaggcagatctcaaactcctgagctcaagtaatccgcctgcctcagccttccaaaatgccgggattaacaggcatgagccaccataaccagcctaatggtaattttcaaatacacactagagtagagtgaatagtacaaggatcaccatccagctttaacaaacattaytatttccacaatcttatttcatctatctccctaattcatttattttgcatttatgtgtgtgtttgttatttatatttgattgtgctaaagcatttaaagatcagtgttgatgttaagtatttattacagcatgatccctgctggctctgaagcttttttttttctttttttttttttctttttttgagatggagtcttgctctgtcacccaggctggagtgcagtgacacgatctcggctcactgcaaactctgcctcccgagttgaagggattctcctgcctcagcctcccgactagct

SEQ ID NO: 73787 - DNA, 601 bp, Human
gagcttctacagggcctgggtgttcagttcaacaggttcccctgtgacctctggttgtccattggagacatcgggtttggcacccttgaggacagacagtctctcagaaatactcttgagccgggggaagagaagaaagtcgtacaggaggctgcccagaccccctccaatgattgggcctacccagtacacctgtagaaagagaaaaggaatactcaggcttggggaggggacagagcagcaacgctgctctttttccagccaccttagtggaaaacaagatattgtacacttgatatcyacaataaactcaccatttattttctgattcatcaaattactcctttatcccacaccttagcatgtgtatattctatttgttatcaatttgcactagtttgtatgttgctttcaaaaaaattttatacattgtggtaaaacacatataaaatttaccatattaaatatttttggacaggcgcagtggcttatgcctgtaatcccagcactttgggaggctgagacgggcggatcacaagacgggcggatcacaaggtcagccatttgagaacagcctgaccaacagggagaaaccccatct

SEQ ID NO: 73788 - DNA, 601 bp, Human
ttagctgctatgatgattactaatattatcattagattcaaggacaattccagttacctttcctgcagatcctgaaccggctgggggctccagagaggaacagtagggaagaatgtctgtcctgaacatctgtcccttctgcagcccccattttcctctccgccctggcgcacccagcctcagccctgcttcctgtggacgtcaggcagtgatgctcttgccctcaggcctagataaaggtagggtaggcaaggcccagccactgagctcacagaaggcagcaccaggcatccagactggygggggcacaaggtatggtgcccagcatacaacactgctttgtacatggctatgaaggaaatgtttgtgaaatttaactgaatttttttaaaagattaggcaatggacagtagatatctccagctccagctttacctgccctcttgttctctcctccaaggtagcggggactcatctctggagaaggagttcctcggggccccagtggggccctcggtgagcacccccaacagccagcactcttctcctagccgctcactcagtggtaagtgtaacctcctaccacctcctggcagtaggc

SEQ ID NO: 73789 - DNA, 601 bp, Human
atagggccccctgcctctctcacccatcctctgggcagcaaggcttcatgggaaatttgggagacaccttgatggggtattttacatccaccatatggatgtaaaatccatctacttggagcaaaaggaataggagcaatgttcttggctgttaacggtcacccttggcctggcgcggtggctcacgcctgtaatcccagcactttgggaggccaagatgggcggatcacgaggtcaggagatcgagaccatcctggccaaaatggtgaaaccctgtctctactaaaaatacaaaaaaaamaaaaattagccgggcatggtggcaggcacctgtagtcccagctacttgggaggctgaggctggagaatggcgtgaacccgggaggcggagcttgcagtgagctgagatcgcgccattgcactctagcctgggcgactgagcaacactcagtctcaaaaaaaaaaaaaaaaaaaaaaaaagtcacccttccctgacttttgtttgttttttgttttttcaagacggtgtctcacactgttgcccaggctggagtgtagtggtgcaattttggctccctgcagtcttgatctcctgagctca

SEQ ID NO: 73790 - DNA, 601 bp, Human
tcttggctgttaacggtcacccttggcctggcgcggtggctcacgcctgtaatcccagcactttgggaggccaagatgggcggatcacgaggtcaggagatcgagaccatcctggccaaaatggtgaaaccctgtctctactaaaaatacaaaaaaaaaaaaaattagccgggcatggtggcaggcacctgtagtcccagctacttgggaggctgaggctggagaatggcgtgaacccgggaggcggagcttgcagtgagctgagatcgcgccattgcactctagcctgggcgactgagcracactcagtctcaaaaaaaaaaaaaaaaaaaaaaaaagtcacccttccctgacttttgtttgttttttgttttttcaagacggtgtctcacactgttgcccaggctggagtgtagtggtgcaattttggctccctgcagtcttgatctcctgagctcaagccatcctcccacctcagcttcctgagtagctggaaggatactgccacacccagctaatttttctatttttttgtagagacaggatctccctatgctgcccaggcttgtcttgaactcttgatctcaagcaatcggcccac

SEQ ID NO: 73791 - DNA, 601 bp, Human
tttgggtggatagggaccatggtgttcatttcatccctaaaatacaagagtttacagagcctgagtaaaatccagtagattgatttagtcaaggcccagctttggcatggcaaggttaggggtgaatagtaattaccagcttcctagagataccttctcctgtctccctgctcaatagcagcaagatacatcaaatatacaatacgttgtttctctccacttttttctctcctctcacaaatatctcttaagagttatctttaaatgaagtaccactctgttttccaattttctttcttckgtagaaacaagacctttataacctgttccttattacaagcacataaacaaacaaacccaaatttggtgttctcttttttttactcttctttattttcttctctgttcttttattctttttctcttttcagaattactctatcagtgatgggctttctagacctctcttggtatctcagcgtagagagacagagagacaaaataatcagtaaaccaggctagggctggaggtcaaaatacaagtaaaggtcaatgaaaactgccccctccccacattggcagatctaagggctctcatttc

SEQ ID NO: 73792 - DNA, 601 bp, Human
tcagagagaggaaataagtatgtggttccccctatccccagcactagtcatgagctctctaaggacctggagctttatggagagtaataaaatgaagtattaaaaatcaatgggctgggattgagtccttctctaagattatagcctagagtcagggagcagtcccacaaaggacctgaccctgcgaaagtaaatgccacgtagtaaataatgttacacccagccccacaggtaaaaaaacaaagaagtaatcctgaggagagtgtaggaattctccaaacccagccctgctgagttcctsttctccacaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggct

SEQ ID NO: 73793 - DNA, 601 bp, Human
ttaccagcacactagtgagacactcacccgccttggcaggacacagtcagctcaaatgcatccccctcaccggacggcacagcctgcaggatctcggcactttcaataccctctgcagagttgcaagcttatcaaattaggattcctctacctggcctccccaaaagcccagagacagaaaagccccagggctgctccaccaatcccatccctgtgctttcaaatgaggactctggcatttgggtattcttcctatctaggtgagtaattcctcccaaggtgtgcttccactgaccagccmtaggtagcacacagctgcctccatcagccaccaaagtaggcaagactcacggacaatgtccagggtgacggaaaaggaaccatatcgatacagaacacaatccagggggacttgtctcttcaccagccttaaggtggctgtaccatccagcagggggcccagggaacctggcaggagaggatcaaggaggcaagatcaagagacagatgactcatctggaggcagaggccaagcaggcattttttcaggttgaaccagagttactggattctggagtcacaggcttggaatcagataaga

SEQ ID NO: 73794 - DNA, 601 bp, Human
acaaaggtagcttgtctgtgcttctccaaagaagggaacacacccatatcccagtctgcttagccttgatcctagcttcctccccttctcctcacctccagggtttaccctctcttatttctgtggtaacctctgtccattcctccctcaccccgtaagctttcctgcctgaggaccatgccaccccaggcctgggggatctgcccttcttgcaggtagaaaactcagttcaccccaggccaggcacggtggctcatgcctgtaatcccagcactttgggaggccaaggtaggcagatcaygaggtcaggagtttgagaccagcctggccaacatggcgaaaccctgtctttactaaaaatacaaaaattagccaggtgtggtggcaggtgcctgaaatcccagctactcgggaagctgaagcaggagaatcgcttgaaactggaaggtggaggttgcagtgagctgagattatgccactatactccagcctgggcaaaaagggtgaaactccgtctcaaaaaaaaaaagaaaactcagtttacccaaactgcccccactcttcatattattaacaacagtcattaatatcaattattgca

SEQ ID NO: 73795 - DNA, 601 bp, Human
tacacacaccccaaaacacatacattgaaagtgcctcatctgaataaaatgacttgtgtttcccctttgggatctgctaagtaagtggtacacttccttcttttataccttcactccttaaatgacgtagattctcccaagaagcaacagaaaaaccagcatcaggctctgagtatttatttcagttaatagtagtctcccagggaagactgggggaaatataggtgtttctgtcaactccaggaaaatcacagcatcatatgagagtactcagacctgctgcccactgaggagggggctrttctcaccaatgggacaagagcagaagatgcggggtagacgcagccagtgactgctgctatgtggcaactggggtacggagaagtcttgcttcataagtctgcgcctgatattgggagaaggggtaaactggttagcaatggacaaaggtagcttgtctgtgcttctccaaagaagggaacacacccatatcccagtctgcttagccttgatcctagcttcctccccttctcctcacctccagggtttaccctctcttatttctgtggtaacctctgtccattcctccctcaccccgtaa

SEQ ID NO: 73796 - DNA, 601 bp, Human
gccactgctttccagaccgaaggcagggtccgccttgcctgttactttggctgcttcttccacttttcgaacatgggcctccaccaaggccgtgggtacctcttccttcattttggagaactcctctgcaagacccagaaagaatgaggctgggagcggcacagtggaacagttctggcaatccctgcaaaagcttactcacaagcccatgtcttcatctaagctagtatggagcctagacaggtgcctgagctgaggcccgcacagacaaggccagcagggcagccaaacttgagaggaktcacagtctgagtaactagcccttcaaaagcaaactaagaaggccaggtggaaccacccacccccattacctagggctgactttgcagcagcagaggcgactcggggatcgacgacagaggccaggaaggcaacagtgctcataacagggttgcccgactgactgaaggggatgggttggtaggccagggggcctagggaggcctctgagtcctccaggtatgggtcttcaatgggaagacgaagaaaatgcaagatgcactcgtcctgtgtgcggcttcccacatgctcggacactttg

SEQ ID NO: 73797 - DNA, 601 bp, Human
ttctttgtctacttcaaaagcccagatttctgtgctgttagaaagttgggtcaaactatgaagtatctggggaagatggtgagtagagaaaaagatacagaggtgcagtagcccacgcctgtaatcccagcactttgggaggctgagacaggaggatcacttgagcccgggagttcgagggtgcagtgagccatgatcttcccactgcactccagcctgggcaacagaatgagaccctgtctccaaaaaaaaaaaagacaaagattgccaaagcagaggagtggagtaccctcctccccamatatttttaatggtctgctagccttcttagtccctcatagattggagcctattggattttcccttactgtacttcctccttttctgcgtctctaccaatatattttatcactacatttcttttttttttttttttttttttgagacggagtctcactgcaacctccacctcccaggttcaagagattctcctgcctcagcctcccaagtagctgggactacaggcgtgcgccaccacgcccagctaatttttgtatttttagtagagacagggttttaccatgttggccaggatggtctc

SEQ ID NO: 73798 - DNA, 601 bp, Human
ctgcaacctccacctcccaggttcaagagattctcctgcctcagcctcccaagtagctgggactacaggcgtgcgccaccacgcccagctaatttttgtatttttagtagagacagggttttaccatgttggccaggatggtctcaatctcttgacctcatgatccgcccacctcggcctcccaaagtgctgggattacaggcgtgagccaccacacccggccatcactacatttcttaattacaaaagttaatatgtacatattttaaaatatggaaggtgtacagcagtttaagaagtrtaaatcctcccacacataccttattcatatttcatttaggaaggtcaaggatcagagacagcaaatcagactaatcttgctttgctttgggggatgtgtcacaaaaggcaattgtgttttcatgttctcatcaaactctagtcttattctttctacagttttcccttctgggatgatactctgttatttattgtgttcctttcacagttcattttgtcttctaccaagtccgacaagcagagggctgtactgtgtgttattcaccttgagtacacacaaacacacacaccccaagttgtg

SEQ ID NO: 73799 - DNA, 601 bp, Human
gggtagaagaagcaagcgtatagtttgctccctaatcctaaagcatttcagattggaaggtaaccaaagtgtgagacaatgaacttataataaggaaatgcagcagccctcttggaggaaggataccataaaaccctacatggtatactcccacttccgttttgggaaagatttagccattgactcaacagtaactgaactgaataaggagctacccaggtgaacaaagtatgtgtacatttctgggcaaggttgtagcttctgttcagggacagtgggtaccttttcagagtgtctcctggttctgtggtgttatggctcctttttttaaacttgtgtttctcaagtcaggaattaatagatagtggcccaaagcttttgaccgttcaacatcaactgaaaattcagcgaactttgtttttagctatagttgcctcagtgtttgggtgggagggccacatattgggtgtgattaggccatctgaggcatagtaacgggtgacaggaaaagcagttagcccatgcgagttgcaatagtaccttgtgggcaagatcccaagggggccctccatccaagggagatcacagaggagccagggag

SEQ ID NO: 73800 - DNA, 601 bp, Human
gatagtggcccaaagcttttgaccgttcaacatcaactgaaaattcagcgaactttgtttttagctatagttgcctcagtgtttgggtgggagggccacatattgggtgtgattaggccatctgaggcatagtaacgggtgacaggaaaagcagttagcccatgcgagttgcaatagtaccttgtgggcaagatcccaagggggccctccatccaagggagatcacagaggagccagggagagaattgattctgaggcctattaaaaatattcccaaatggggccgtgtgcggtggcatgygcctgtaatcccagcactttgggaggctgaggcgggtggatcacgaggtcaggagattgagaccatcctggctaacacggtgaaaccccgtctctactaaacaaaatacaaaaaattagctgggcgtggtggtgggcgcctgtagtcccccagcttctcgggaggctgaagcaggagaatggcgtgaacctgggaggcagagcttgcagtgagccgagatcgcgtcactgcactccagcctgggcgactgagcaagactccgtctcaggaaaaaaaaaaaagaacccaaatggaattgag

SEQ ID NO: 73801 - DNA, 601 bp, Human
gcctgggcgactgagcaagactccgtctcaggaaaaaaaaaaaagaacccaaatggaattgagtaagatctgtccagatggtacagaaagggaggagttgattgggggagagaagtagaattacttagccttaatttagggagcatttaatgagcacctactagggatcaggcagcatgctgtgctctgaagattttaagataaactcccacttttaaagaagttcatagtttagcagagcagacagacacaatttatatactgtgataatgtgatacatactattatagaaatacagtctttttttttttttttgagacggattcttgctttgctgtccaggctggagtacagtggtgcaatctgtgctcactgcaacctccgcctcccgggctcaagcaattctcatgtctcagcctcctgggtaactgggattacaagcctgtgccaacatgcccagctaatttttgtatttttagtagagacggggtttcaccatattggccaggctggtctcgaactcctaacctccagtgatccatctgccttggcctctcaaagtgctgggattacaggtgtgcgccaccacacctggccagaa

SEQ ID NO: 73802 - DNA, 601 bp, Human
tcgagccaacttatcggcctgctccttctgcaccttcctcttggcctccatgtcacatttgttccctagcaagaggtgctccaccccagctgaggcattctccatgatgcttttcatccagttctgaatattctcgaaagatttctcatccgtgatgtcgtatgctaggataatgcccatggctccacggtagtaggcagtagttattgtcttgaaccgctcttggccagctgtgtcccagacttgtagtttgatcttcttcccctctatatccacagtgcggatcttgaaatcaattccratggtggagatgtaagtgttgttgaagttgtcctctgcaaagcgaatgatcagacaagtcttgcccacccccgagtccccgatcagcagcaacttgaagaggtggtcgtaggctttggccatggcggacaccgggggagccggggaagggatggggctatttatttatttttgagacggaatcgctctgttgtccaggctggagtgcagtcgtgtgatctcggctcactgctacctctgcctcccaggttcaagcaattctcgtgcctcagcctcctgagtagctgggattacaggcacg

SEQ ID NO: 73803 - DNA, 601 bp, Human
gcttttcatccagttctgaatattctcgaaagatttctcatccgtgatgtcgtatgctaggataatgcccatggctccacggtagtaggcagtagttattgtcttgaaccgctcttggccagctgtgtcccagacttgtagtttgatcttcttcccctctatatccacagtgcggatcttgaaatcaattccgatggtggagatgtaagtgttgttgaagttgtcctctgcaaagcgaatgatcagacaagtcttgcccacccccgagtccccgatcagcagcaacttgaagaggtggtcrtaggctttggccatggcggacaccgggggagccggggaagggatggggctatttatttatttttgagacggaatcgctctgttgtccaggctggagtgcagtcgtgtgatctcggctcactgctacctctgcctcccaggttcaagcaattctcgtgcctcagcctcctgagtagctgggattacaggcacgcaccaccacacccagctaatttttgtatttttagtagagacaggttttcaccacgttggccaggctggtctcaaactcctgacctcaggtgatctgcccatctcgccc

SEQ ID NO: 73804 - DNA, 601 bp, Human
gtgtcagccaccacacctggctaatttttgtgtttttaatagagacggggtttcaccatgttcgccagactggtgttgaattcctgaccttaggtgatccgcccacctcagcctcccaaagtgctgggatttcaggcatgagtcactgcacccggcagagctgcacttctaagggaagttaaatctgatttcttctcttctgagctaaaaaggttgaaaggaagagaaacctgccccatctcccttttttttgtctcgggtttgaaggtaataatcatcataccacttgactggtttaccaaaaaaaaaaaaaaattagtatttttgtgggaaaaaatgagaatagaaaataaataattgaatcttatatgtattatttcatttctgtaccacagaatttttgagagtctagctattatattttttaaatgatacccttataaacatgataagattaaagatcaaagcttagaggtggctcaacaattgctgtgaacagggaggaaggcaggacatattctttctttttcagaggtgggatctcactatgttgcccaggctggtctcaaactcctgggctcaagtgatcctcctgccttgg

SEQ ID NO: 73805 - DNA, 601 bp, Human
ccccagagctcaagtgatatgtttagccatgagaattcagtccattctaactcccacattttcctgtattgtagagtagtaacattgaggcttaatattctaccccttggatcacatgctttgaaatacataaaaatgtaagggagtaagttgaaaaaaccagtaactttttctattgtttcttgagagtatagcatatatatgtcacctgaaggaaacttgatcagcttatcatctgtccttttttttttattatggtgtcacctgtcttctcttttatttattttttattttgagagayggagtcttgctctgttgcccaggctggagtacagtggcataatctcagctcactgcaacctccgccctctgggttcaagcgattctcctgcctcagcttcccaagtagctgggactacaggcatgtggcgctacacccagctaatttttgtattttttagtagagacggggtttcactatatgttggccaggctggtctcaaactcctgacctctcaaacaccagagtgagactctctctaaaaatggaaaataaattttaaaatgttataattaaagatactcatttaaattgaataaa

SEQ ID NO: 73806 - DNA, 601 bp, Human
ttaatatttatttagcacttagtatctatcaaatacttaaaatactttagttatttatatgcattatctcatttaatccttacaacacccttatgaagtaggtgcttataaggctattatctcattttacagatgaggaaatgaatgcacacatatatttagtgacttgctcaaggttcatagctagtaagtagagctgaaaaacaaacgtggagaattggactccagagcctttattcctctgaattgcctcctgtatgattttctgtctttacgatctagtaagtggggttactgaaawtttttaaccccagtttaactccagtcccactaattgtggtgacaaaataatgatgtttccccacatatgccatagagtatgatgtctgtgaagtcactaggatctgctttggaaaagcgaaagagtaatttgaacaagcaaagtacaactctcaagcaatgcttaggtttgggagagaggtttttgcatgctctgcctatgctaacttccctttgaatttcatagttcctttccgctcagagtcaggatgatgaaatgtattcagatttagacgattagaatctcaaagtcccaactctt

SEQ ID NO: 73807 - DNA, 601 bp, Human
cctctgaattgcctcctgtatgattttctgtctttacgatctagtaagtggggttactgaaaatttttaaccccagtttaactccagtcccactaattgtggtgacaaaataatgatgtttccccacatatgccatagagtatgatgtctgtgaagtcactaggatctgctttggaaaagcgaaagagtaatttgaacaagcaaagtacaactctcaagcaatgcttaggtttgggagagaggtttttgcatgctctgcctatgctaacttccctttgaatttcatagttcctttccgctyagagtcaggatgatgaaatgtattcagatttagacgattagaatctcaaagtcccaactcttctctctgttccctgccccaccagcagctttcttagccctcttagaagatagaggagctgattcagtctattctttcatcaaatactgattgcttgcagacttaacgccctataccatcctctggagacttctgcatgtctttagaaggtatacctttctctgcctctaatttggagggctacagctgttaggcccctttggtgtggagggtaatctaatccctaggcaccagcaagac

SEQ ID NO: 73808 - DNA, 601 bp, Human
atgccatagagtatgatgtctgtgaagtcactaggatctgctttggaaaagcgaaagagtaatttgaacaagcaaagtacaactctcaagcaatgcttaggtttgggagagaggtttttgcatgctctgcctatgctaacttccctttgaatttcatagttcctttccgctcagagtcaggatgatgaaatgtattcagatttagacgattagaatctcaaagtcccaactcttctctctgttccctgccccaccagcagctttcttagccctcttagaagatagaggagctgattcagtstattctttcatcaaatactgattgcttgcagacttaacgccctataccatcctctggagacttctgcatgtctttagaaggtatacctttctctgcctctaatttggagggctacagctgttaggcccctttggtgtggagggtaatctaatccctaggcaccagcaagacagctgcaagttgagagtaggtcaagcttactgattcttgatagactttcagatttggaaagatggcagaaacaaagtgaaaaaagagttgttaatgaaacaaagagttgataatgaatgtgatctgttg

SEQ ID NO: 73809 - DNA, 601 bp, Human
gatggcagaaacaaagtgaaaaaagagttgttaatgaaacaaagagttgataatgaatgtgatctgttggttgtatttctctctttaccttcaaccaaaaatgagaaaggatagattttgtggcaatgggaccctggttagatctttagaaatgtcttatcagggagaccggtcatatataaaggatacagcagcaactacccttctgcccttaggagtggtgactcttatcccacacccctagagtgaatctctcattttgacaaagagctaaggaaaaatgaaaagaaggccaggcacrgtggctcatgcctgtaatatcagcactttggaaggccaaggcgggcagatcacctgaggtcaggacttcttagactagtctgaccaacatggagaaactccgtctctactaaaaatacaaaattagccaggcgtggtggtgcatgcctgtaatcccagctactcgggagactgaggtgggagaattgcttgaacccgggaggcagaggttgtggtgagccaagattgtgccattgcactccagcctgggcaacaagagtgacgtctcaaaaaaaaagaagaaaaggaaaagaagagcaca

SEQ ID NO: 73810 - DNA, 601 bp, Human
ccggtgggtggatctggatattcttcaggccagctaaaggttgatcactttgtgtgactcaaacaaaaaactttgaagacctggtggggaattactggggaattaaaaactctcagttttcagtctctctatttcggctcccttggcagttagagattatgtggtagggcagactccagaagcagttcttattttgctcttcccaactcttaccactgaggatcagctgcctgggaccttctcagagctaagtcctcatagaagcaaggagatgaagaggttctatccttctctgaaaagsgattgcagcttcaatggacgtatgtttaattttattcacttttttttcttgcaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagca

SEQ ID NO: 73811 - DNA, 601 bp, Human; identical to SEQ ID NO: 26141

SEQ ID NO: 73812 - DNA, 601 bp, Human; identical to SEQ ID NO: 26142

SEQ ID NO: 73813 - DNA, 601 bp, Human; identical to SEQ ID NO: 26143

SEQ ID NO: 73814 - DNA, 601 bp, Human; identical to SEQ ID NO: 26144

SEQ ID NO: 73815 - DNA, 601 bp, Human; identical to SEQ ID NO: 26145

SEQ ID NO: 73816 - DNA, 601 bp, Human; identical to SEQ ID NO: 26146

SEQ ID NO: 73817 - DNA, 601 bp, Human; identical to SEQ ID NO: 26147

SEQ ID NO: 73818 - DNA, 601 bp, Human; identical to SEQ ID NO: 26148

SEQ ID NO: 73819 - DNA, 601 bp, Human
taatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaact

SEQ ID NO: 73820 - DNA, 601 bp, Human
gtggaaaggactatagaattgtttaacagaacaacatgataaagacttgggttgcatcaaaatcatctcacagagatcaggacacgctgattctgcaatctggggaagggtggcatcaagacagccaattctggagcagctgagaagagaatgtggcccaggagtgtttctggatccctggaataccaccaggaggtagaataccatcctttctatcttggccccagagtgtaggtgacaatacctttggactggcaagttcccagaggacaagaaaatgacttctttagagcaaggatttcttgacaccttttgggacccatcatgttccattttttttaaacactaaaagaaagattgctttccccgccaaataacagcatgaacattatcttaaaaggcaaagacattaatttctatgaagccaggcacgagacacttttgggtgtcacaataagaatgacaatacgttctgatgttgagcacagaaggagggtgcatcagtgaaaattatgacagacagcatgacggtgctgagaggcaagctacggatccaagcccgcgactgctcagccaggatctctgttccctatgggagcag

SEQ ID NO: 73821 - DNA, 601 bp, Human
acagcagaccttcaaggagaaagctaaaaagcctcttgaaaattaacccccagttcccccttttcaagaacttgaatcttgtgctcattctgaaagtttccactgcggtggaggagcataataggcacttaaagaaactgggtattgtattgggatgaggagtggaaaggactatagaattgtttaacagaacaacatgataaagacttgggttgcatcaaaatcatctcacagagatcaggacacgctgattctgcaatctggggaagggtggcatcaagacagccaattctggagcagstgagaagagaatgtggcccaggagtgtttctggatccctggaataccaccaggaggtagaataccatcctttctatcttggccccagagtgtaggtgacaatacctttggactggcaagttcccagaggacaagaaaatgacttctttagagcaaggatttcttgacaccttttgggacccatcatgttccattttttttaaacactaaaagaaagattgctttccccgccaaataacagcatgaacattatcttaaaaggcaaagacattaatttctatgaagccaggcacgagacact

SEQ ID NO: 73822 - DNA, 601 bp, Human
tccctaaacaaaagtactgggcgtgtaaagagcaaaactgcctactccacagcagatcacagcagaccttcaaggagaaagctaaaaagcctcttgaaaattaacccccagttcccccttttcaagaacttgaatcttgtgctcattctgaaagtttccactgcggtggaggagcataataggcacttaaagaaactgggtattgtattgggatgaggagtggaaaggactatagaattgtttaacagaacaacatgataaagacttgggttgcatcaaaatcatctcacagagatcaggrcacgctgattctgcaatctggggaagggtggcatcaagacagccaattctggagcagctgagaagagaatgtggcccaggagtgtttctggatccctggaataccaccaggaggtagaataccatcctttctatcttggccccagagtgtaggtgacaatacctttggactggcaagttcccagaggacaagaaaatgacttctttagagcaaggatttcttgacaccttttgggacccatcatgttccattttttttaaacactaaaagaaagattgctttccccgccaaataacagca

SEQ ID NO: 73823 - DNA, 601 bp, Human
ttgtcttcagtgtttaccacataaattgcaaataggacattgagactttgttaagagaagtagattcacctgtttaacaaatagtacactctgaaacaaagaaatgcagttataaccagtgaagtactctattatcttccctaaacaaaagtactgggcgtgtaaagagcaaaactgcctactccacagcagatcacagcagaccttcaaggagaaagctaaaaagcctcttgaaaattaacccccagttcccccttttcaagaacttgaatcttgtgctcattctgaaagtttccactgyggtggaggagcataataggcacttaaagaaactgggtattgtattgggatgaggagtggaaaggactatagaattgtttaacagaacaacatgataaagacttgggttgcatcaaaatcatctcacagagatcaggacacgctgattctgcaatctggggaagggtggcatcaagacagccaattctggagcagctgagaagagaatgtggcccaggagtgtttctggatccctggaataccaccaggaggtagaataccatcctttctatcttggccccagagtgtaggtgacaatacc

SEQ ID NO: 73824 - DNA, 601 bp, Human
aaatgttcttcttccccctacctattgacatcctcctttatttctttgttgactttcagaattgagttgaacttcagaggtttttcaacttggagttcaggaacatctgaaattacattaatgcttgcaagtacattggtatgtacatggttttgagcagtctcctggctttcttacctttcgaaaggaggctgagatgccaaaaggttaaggaccattgtcttcagtgtttaccacataaattgcaaataggacattgagactttgttaagagaagtagattcacctgtttaacaaatastacactctgaaacaaagaaatgcagttataaccagtgaagtactctattatcttccctaaacaaaagtactgggcgtgtaaagagcaaaactgcctactccacagcagatcacagcagaccttcaaggagaaagctaaaaagcctcttgaaaattaacccccagttcccccttttcaagaacttgaatcttgtgctcattctgaaagtttccactgcggtggaggagcataataggcacttaaagaaactgggtattgtattgggatgaggagtggaaaggactatagaattgtttaaca

SEQ ID NO: 73825 - DNA, 601 bp, Human
cactttgggcagtatagtgagactctacaaaaaaatgaaaaaaaaaaaaaattagctgggcatggtggtgggcctgtaatcccagctacttgggaggctatagcaggaagatcacttgagcccaggagttcgaggcttcagtgagctacgtttgcgccactgtactccagcccgggtgacagagtaagaccctgtctctaaaaataaaaataaaataaaataaaacttgcccatgttaacatcacaaggaaatggcagagatgcgttatagactctagtagtttgactctagagcctacastttcaaccattatcttacaaatgacttatctttatgaaccaaacatatacatttgtggtgtcatttattttactctatcctatccatttgttaaatatttgctttaaaagtacgtaaattggctgggtgtggtggctcacgcctataatcccagcactttgggaggctgaggtgggtggatcacctgaggtcaggagtttgagaccagcctggccaacatggtgaaaccccgtctcaactaaaaatagagaaaaattagctgggcatggtggcgcacacctgtagttccaaatacctggg

SEQ ID NO: 73826 - DNA, 601 bp, Human
ttgttctaagcaccgtatatgtatcaattcacttaagccttgcagcagtcctatgaaatagatttgtaatctccattttatagatgaggcacagaggggttaaaaaaaacttgcccatggctgggcatggtggctcatacctgcaaccctggcactttgggcagtatagtgagactctacaaaaaaatgaaaaaaaaaaaaaattagctgggcatggtggtgggcctgtaatcccagctacttgggaggctatagcaggaagatcacttgagcccaggagttcgaggcttcagtgagctaygtttgcgccactgtactccagcccgggtgacagagtaagaccctgtctctaaaaataaaaataaaataaaataaaacttgcccatgttaacatcacaaggaaatggcagagatgcgttatagactctagtagtttgactctagagcctacactttcaaccattatcttacaaatgacttatctttatgaaccaaacatatacatttgtggtgtcatttattttactctatcctatccatttgttaaatatttgctttaaaagtacgtaaattggctgggtgtggtggctcacgcctataa

SEQ ID NO: 73827 - DNA, 601 bp, Human
aactccagcttcattttaacttgctgtaaaaccttggagaaggaaaatgacaaggctagtgcctgagctgctaactttgaacacctctgtacctgttattgttctaagcaccgtatatgtatcaattcacttaagccttgcagcagtcctatgaaatagatttgtaatctccattttatagatgaggcacagaggggttaaaaaaaacttgcccatggctgggcatggtggctcatacctgcaaccctggcactttgggcagtatagtgagactctacaaaaaaatgaaaaaaaaaaaaaattagctgggcatggtggtgggcctgtaatcccagctacttgggaggctatagcaggaagatcacttgagcccaggagttcgaggcttcagtgagctacgtttgcgccactgtactccagcccgggtgacagagtaagaccctgtctctaaaaataaaaataaaataaaataaaacttgcccatgttaacatcacaaggaaatggcagagatgcgttatagactctagtagtttgactctagagcctacactttcaaccattatcttacaaatgacttatctttatgaaccaaacatatac

SEQ ID NO: 73828 - DNA, 601 bp, Human
cataataatgtcagtgtacagatactgacctaactacaactgcaatacagatggggagactgcctggacgggaagtggttgtgaaggtacgaatgcttcatttccacctgaaagaccccaacttgaaaatcaacaaggaacaatatgataagcagaatatttacagatatggggagtacataaccaaaagatcggctaaaagaattgagcaggaaatagggagaggtgggctggagggccactgtatttcacaaaggctttgagaacccctgactctttagaccacaggcatcccaatgtygataaaggaaaaatacatttaaaactataaccaaggctggcgtggtggctcatgctggtaatcccagcactttgggaggccaaggtggacagatcacctgaggtcaggggtttgagaccagcctgaccaacgtggtgaaacccccatctctactaaaaatacaaaattagctgggtgtggtggtgcatgcctgtaatcccagctacttgggaggctgaggcaggagagtcacttgaacccgggaggcagaggttgcagcaagcttagattgcaccattgcactccagcctgggaaacaag

SEQ ID NO: 73829 - DNA, 601 bp, Human
aacacgggaacaaagaagatcctgctaacttccaaaaagaaaaaacaaaggaatggcaactgacttctctgcagcaagcccagaagctaggtgccaatagagcagtggcttcagcatttccaggggaaatcacttccatgctagaaccctacacccagcctggctatcaatcatgttttaggtaaaataaatacgctttcagatgggcaagatccccctagaaatatttcctttgcaatatttttttcagaaacaattggaagatttgctctgcccaaagagtaaagcaaagaggaataaagatgcaggagcaggaaacggggcacccaatcgacaggggtgaaagaaccccttgggtcgacagtgaagaaagacgccaagatgggcagtgtaggaagcaagagcccccacttcagagggaagcaggcagaaggttttgggagagatcgcctcaagaagatgaacttgatagactagttgatgtgtgttgaaaggagattcactggacagggaaagggcttggagatacattatcattagtatcattgacataaaaaagtcaagcaaacagatattaagacaaatattaactccagagaaa

SEQ ID NO: 73830 - DNA, 601 bp, Human
aatcccacaaggacaaaggaaacaagaagaggatgacagcaacaaggtttcagaagccagaaagctgatgaatgatcagtgcctaacagcatgagagaaaaacaaatgctaagacatcatggaaatactggaaggtgaccgagtgtacactgttacggaatcacccaaaggttcgggccttagtgaccttgcgcacttacaggagtgggggcaggaaagcgggttatgaaaacaggagcgctggttgaagtctcttcaagaagcagttattgagaatccctctcccctcggccaagggagygtcacagtttcccctccattccaaggtttcatgtcaagagaggacagagttacaggtgcctagactgggggcagtctgcacagttggggcactggcagcacacagagaatagggagcttcggggaaggatcccacagcccagcccttctctcccactcagccgtagaactctggcagcgggactcaccccctctgaacagtggactgggggagctttctctggggaatctcacttaactttaaagaaaagatctaaagaccttgacacgaaagattccccaacaaaaggggagcagcctg

SEQ ID NO: 73831 - DNA, 601 bp, Human
gaaatgaaatgcttatgttctagttaaagatgcgtattgatgatgatatttctgaaatctactacaacaaaagcagagatcttcttttttttttttttttttaaagcataatcccacaaggacaaaggaaacaagaagaggatgacagcaacaaggtttcagaagccagaaagctgatgaatgatcagtgcctaacagcatgagagaaaaacaaatgctaagacatcatggaaatactggaaggtgaccgagtgtacactgttacggaatcacccaaaggttcgggccttagtgaccttgsgcacttacaggagtgggggcaggaaagcgggttatgaaaacaggagcgctggttgaagtctcttcaagaagcagttattgagaatccctctcccctcggccaagggagtgtcacagtttcccctccattccaaggtttcatgtcaagagaggacagagttacaggtgcctagactgggggcagtctgcacagttggggcactggcagcacacagagaatagggagcttcggggaaggatcccacagcccagcccttctctcccactcagccgtagaactctggcagcgggactcaccccc

SEQ ID NO: 73832 - DNA, 601 bp, Human
agtaaactactggggaatgtgagatggttgacacaatctggtgacaagcaaggtgtttgaaaagataacagataacaggagttaaaagtgtcggaagtcgggccgggcgtggtggctcacacctgtcatcccagtactttgggaggctgaggcgggcggatcacctgagatcaggagttcaagattagcctggccaacatggcaagaccccctctctactaaaaatacaaaaattagccgggtgtggtggcgggcgcctgcagtcccagctacttacgaggccagggcaggagaatcgctygaactcaggaggcagaggttgtagtgagccaagactgtgccagtgcactccagcctgggcgacagagtgagactcagcctcaaaaaaaaaaaaaaaaaaaaagtgatggaagtcatggagaagccggagtggagtcaccccagaaggaaatgaaatgcttatgttctagttaaagatgcgtattgatgatgatatttctgaaatctactacaacaaaagcagagatcttcttttttttttttttttttaaagcataatcccacaaggacaaaggaaacaagaagaggatgacagcaacaa

SEQ ID NO: 73833 - DNA, 601 bp, Human
acacacacacacacacacacacacacaaataatgatttaaatcagggtcccaaatagtcaaagtaaactactggggaatgtgagatggttgacacaatctggtgacaagcaaggtgtttgaaaagataacagataacaggagttaaaagtgtcggaagtcgggccgggcgtggtggctcacacctgtcatcccagtactttgggaggctgaggcgggcggatcacctgagatcaggagttcaagattagcctggccaacatggcaagaccccctctctactaaaaatacaaaaattagccrggtgtggtggcgggcgcctgcagtcccagctacttacgaggccagggcaggagaatcgctcgaactcaggaggcagaggttgtagtgagccaagactgtgccagtgcactccagcctgggcgacagagtgagactcagcctcaaaaaaaaaaaaaaaaaaaaagtgatggaagtcatggagaagccggagtggagtcaccccagaaggaaatgaaatgcttatgttctagttaaagatgcgtattgatgatgatatttctgaaatctactacaacaaaagcagagatcttcttttttttt

SEQ ID NO: 73834 - DNA, 601 bp, Human
atcctcccccgcggcagctttgtagctcatttttaatgacaccaacatctttactgcagaatcaatttcatcctgagagaggaaataaaagggatggctaaaagtattactaatagctgatatgtgctgaatgcctattctgtggcaggcactgtgttaaatgcttttacacgtgttaccttagttagtgtcacaaccctacaaggcaggtattgttgtcactgtccttttccagctcaagaatctgagactcagagaggtagaggagcttacccatagaatcacagcaagtcattggctygaaaacacttcatttttatctgttattctagtgctaccatgaacactttgggacagtagcagtgacacaatatacactgtcatttatgacaaagttcatatgctaaagatttctcaaacaccactgatgccagagaacgtgtgtgacaagctcctttaattgagattcctggagttctgcattggaactagtttttacataccacacaggttgagatgaatatttacgttaacttaaccaatgatgccactaaggatagtaagagcaactaaaacagataaaagcaaggacaaaaaatgt

SEQ ID NO: 73835 - DNA, 601 bp, Human
tgggtccacaaaatcctcttcagcttctgtggcatctgggccatgattactggtaggtgctgggttccctggaggacagtcagccttgtaatcctcccccgcggcagctttgtagctcatttttaatgacaccaacatctttactgcagaatcaatttcatcctgagagaggaaataaaagggatggctaaaagtattactaatagctgatatgtgctgaatgcctattctgtggcaggcactgtgttaaatgcttttacacgtgttaccttagttagtgtcacaaccctacaaggcaggyattgttgtcactgtccttttccagctcaagaatctgagactcagagaggtagaggagcttacccatagaatcacagcaagtcattggctcgaaaacacttcatttttatctgttattctagtgctaccatgaacactttgggacagtagcagtgacacaatatacactgtcatttatgacaaagttcatatgctaaagatttctcaaacaccactgatgccagagaacgtgtgtgacaagctcctttaattgagattcctggagttctgcattggaactagtttttacataccacacagg

SEQ ID NO: 73836 - DNA, 601 bp, Human
aggaaataaattacaacacaaaatgctgttttgcctgagactgggttctgatgggaaacatattcagaatgcagtccagctagcaacttttgacaacaaaatataaacatatacatatataaataggtatatatatatatatttgtttattaaggtaaaatttatattcattgacaaccatgatttctcacattctttatttgttgaactgaattaatgtcggtcttcaagtgaattttccctcattgatagtctatactgaaatcatggaaaatggctttgacttagatgaaaacatttyagttctgtttcttctctgataattagcaatgatctcagagtaaagacttcaatggaatggcaacagtctttcctgagcaggaaggccctcaaggaagggcatgacagtaagaacttgcccgatgtgagaagtcactgctcttaagctgacttccagccttctaggtccatagtcagtatcactggaggtgaaacctaagtaatctatgattgacttgtagccactaaatgttataaatggccatttcaatagacctttcccaagttctgaagtgctcaaaaaaagggaaaaccttctatt

SEQ ID NO: 73837 - DNA, 601 bp, Human
ctaaaggtccttacccccaacatgaagtaaaaggtctttggattaaaacaacagctgagatcaacacaaccaacaaaacaggaaataaattacaacacaaaatgctgttttgcctgagactgggttctgatgggaaacatattcagaatgcagtccagctagcaacttttgacaacaaaatataaacatatacatatataaataggtatatatatatatatttgtttattaaggtaaaatttatattcattgacaaccatgatttctcacattctttatttgttgaactgaattaatgtckgtcttcaagtgaattttccctcattgatagtctatactgaaatcatggaaaatggctttgacttagatgaaaacatttcagttctgtttcttctctgataattagcaatgatctcagagtaaagacttcaatggaatggcaacagtctttcctgagcaggaaggccctcaaggaagggcatgacagtaagaacttgcccgatgtgagaagtcactgctcttaagctgacttccagccttctaggtccatagtcagtatcactggaggtgaaacctaagtaatctatgattgacttgtagc

SEQ ID NO: 73838 - DNA, 601 bp, Human
ttggtattgtttatgagcaagtcaatacaataggaggaagagggtttggaatttcaggaagcctactgtttgtcatgtgggaaatgctgatcttggacatattattctcttttgttttcatgacattttataatttctttacagcctgtaatctgggaagaatctcacctgctattaatatgattcccaccttgtgaggtgggcagtctacaaatgaaaaaactaagagcctgagggtgatggacaagcatgatcccacagtgggttactgacaggacagaggatggatctcagtcttacsacagctggccatcacttttcccacagtaccaggtggcttatgaagagagtgtcttacgatttttttgaactaaaagaagaggacaggtgagaaggcctgtggtgaagagcccctgacctgtgtgagaagaagatgcctctgcgcaggaagtggtgtggtctttggccggtggctctctctattcggtttattagctctttgtcaattttactacttccaaaccgaactggaaaaaaagaaaagatgactttcttaggtggcaggaggtttagtgatcagatattactgaaatgaagatga

SEQ ID NO: 73839 - DNA, 601 bp, Human
aaggaaaattttttattatattccacccagaaagtgggttgagcaaggcctggagttctttgcaggtagaatttgaagtgtttgggcagactgctgggctctgtcctggggttgttctcctgtaaccgtgaagtgccagtagaacagaacaaccctacatcagatcataaattccatggacacagcttcaaaaagggggctgcctcagcccagataactgtaggttgggagaggcagaaactcttttggaacctgcccatatcttgacgttatctgcgtggaatttacggcctaaggtacrgataatctgttccatgcattctctgttggtttgtctgttggtattgtttatgagcaagtcaatacaataggaggaagagggtttggaatttcaggaagcctactgtttgtcatgtgggaaatgctgatcttggacatattattctcttttgttttcatgacattttataatttctttacagcctgtaatctgggaagaatctcacctgctattaatatgattcccaccttgtgaggtgggcagtctacaaatgaaaaaactaagagcctgagggtgatggacaagcatgatcccacagtg

SEQ ID NO: 73840 - DNA, 601 bp, Human
tttcacaaaaaatttttacaacttctggcataaatgggttaatgggtagaagtttccttttggggtgatgaaatgttttggaattagatagtcttgatggtctcacaaccttgtgaatatactaaaacccacttaactgtacatttaaaaaaataagttttatagtatgtgaattaaggaaaattttttattatattccacccagaaagtgggttgagcaaggcctggagttctttgcaggtagaatttgaagtgtttgggcagactgctgggctctgtcctggggttgttctcctgtaascgtgaagtgccagtagaacagaacaaccctacatcagatcataaattccatggacacagcttcaaaaagggggctgcctcagcccagataactgtaggttgggagaggcagaaactcttttggaacctgcccatatcttgacgttatctgcgtggaatttacggcctaaggtacagataatctgttccatgcattctctgttggtttgtctgttggtattgtttatgagcaagtcaatacaataggaggaagagggtttggaatttcaggaagcctactgtttgtcatgtgggaaatgct

SEQ ID NO: 73841 - DNA, 601 bp, Human
tgctaaacttgtgggagttattgatatcttactgctcaaggtgattgccaaggtctgatttttcacaaaaaatttttacaacttctggcataaatgggttaatgggtagaagtttccttttggggtgatgaaatgttttggaattagatagtcttgatggtctcacaaccttgtgaatatactaaaacccacttaactgtacatttaaaaaaataagttttatagtatgtgaattaaggaaaattttttattatattccacccagaaagtgggttgagcaaggcctggagttctttgcagrtagaatttgaagtgtttgggcagactgctgggctctgtcctggggttgttctcctgtaaccgtgaagtgccagtagaacagaacaaccctacatcagatcataaattccatggacacagcttcaaaaagggggctgcctcagcccagataactgtaggttgggagaggcagaaactcttttggaacctgcccatatcttgacgttatctgcgtggaatttacggcctaaggtacagataatctgttccatgcattctctgttggtttgtctgttggtattgtttatgagcaagtcaatac

SEQ ID NO: 73842 - DNA, 601 bp, Human
tatataagccattaattctatttcgaggtatatgcccaagagaattgaaaacatatatccacccaaaaacttgtatacaaatggtcagagcagcattgttgataaccaaaaagtgaaaataactcaaacgtccatcaactaatgaatgaataaacaaaatgtgaggtatatccattcaatggaatattatttggcaataaaaaggaatccagtatggatacatgctacaacatggaggaaccttgaaaatgttatgccaagtaaaagaagccagacacaaaaggccacatgttacatgatyccatttatataaaatgcctaaatctagatatagagaaagcagactaatggttgccagtggggagggagaaatgggggatgactgttaacccatttatgcctacctactgttccaaaattggaatgctaaacttgtgggagttattgatatcttactgctcaaggtgattgccaaggtctgatttttcacaaaaaatttttacaacttctggcataaatgggttaatgggtagaagtttccttttggggtgatgaaatgttttggaattagatagtcttgatggtctcacaaccttgtgaa

SEQ ID NO: 73843 - DNA, 601 bp, Human
ataaactcagcaaaatttcaggatataagattaatacacaaacatcaattgtattttttttttttttgagagggagttttgctctttttgcccgggctggagtgcaatggcacgatctcgggtcactgccacctctgcctcctgggttcaagtgattctcctgccttagcctcttgggtagctgggattacaggcgcccaccaccatgcctgcccaattttgtatttttagtagagatgtggtttcaccatgttggtcaggctggtctcgaactcctgacctcaagtgatccacccgcctyggcctcccaaagtgttgggattacaggtgtaagccaccgtgcccggccatcagttgtatttctatatagtagcaatgaacaatcaaaatgagattaagaaaatgccatttagaatagcattaaaaagataaaattctaatgaataaatctaagcaaagaagtgcaaaacctatacactgaaaattacaaaacatcaatgaaagaaatcaaagaagtgaaaagacatcccatgttcatggattagatgaattaatattttaagatggcaatactccacaaatgaatctacagattcagtgc

SEQ ID NO: 73844 - DNA, 601 bp, Human
gggaacccagttacctgcccaccacttgaagcttgactgtgcatagtagatctcatttaatccccaattttacagatgacaaaattagacagaggggcagtttgaaatttgagaatgggcaaatgactcaggtcctatgctttcctaagccaagaggctacagtattactatactgcagttaataaataagtcacaaaggcagtgagaagaaccatgccatgctaagataaaaaatgctgactacaaaccaacaaaattagtaaactttgaaccaaagtgactgggtgtgtgtgtgtgtgggggggggggtgtggaataaaagagaagactcaaacggccaaaatcaggaatataagaaggggtattactactgaccttataggaataaaaaggattactacataagggaatactatgaataactgtataccaatacattagataaccttgatgaaatagacaaattcctagaaacaaactactgaaacgaacccaagaagaaatagaaaatatacacagatctggaacaaacaaaaagactgaattagtaatcaaaaaacttcctacaaagaaaagcccaaaaccccattttcactggta

SEQ ID NO: 73845 - DNA, 601 bp, Human
atagtaggcacctgccactatgcccagctaattttttgtgtttttaatagagacggggtttcaccatgttggccaggctggtctcaaactcctgacctcgtgatttgcctgcctcggcctcccaaagtgctgggattacaggtgtgagccactgcgcctggccgggaatttgtatttttaaaaagctccgtgaggagttccaatgttcagcagggtgggaaaccaacgctcgaggatgaatgtcctttgtttctgggtaaagtgtccccaaatacaagaggaataactaccttttccagakgtctggataggagaatctagagaacagtattctgaaagtgacttctccttatattccccaagccaagggtcaacattgcttatctctggacagatacaattgtgggtgttctggtttttgggcttagttttcattttttttccccatgaaatgctcacatactgcttttgaaataaggaaagaaaataacccataattttggaaggaaagaatccttctttggttctcacaactaaccatatgggcttacagaagagaaaaaaatgtaactgtgccatgagctgcttttcttgtgtttat

SEQ ID NO: 73846 - DNA, 601 bp, Human
catagtaggcacctgccactatgcccagctaattttttgtgtttttaatagagacggggtttcaccatgttggccaggctggtctcaaactcctgacctcgtgatttgcctgcctcggcctcccaaagtgctgggattacaggtgtgagccactgcgcctggccgggaatttgtatttttaaaaagctccgtgaggagttccaatgttcagcagggtgggaaaccaacgctcgaggatgaatgtcctttgtttctgggtaaagtgtccccaaatacaagaggaataactaccttttccagrggtctggataggagaatctagagaacagtattctgaaagtgacttctccttatattccccaagccaagggtcaacattgcttatctctggacagatacaattgtgggtgttctggtttttgggcttagttttcattttttttccccatgaaatgctcacatactgcttttgaaataaggaaagaaaataacccataattttggaaggaaagaatccttctttggttctcacaactaaccatatgggcttacagaagagaaaaaaatgtaactgtgccatgagctgcttttcttgtgttta

SEQ ID NO: 73847 - DNA, 601 bp, Human
aaaggaaaaaggagaagaggaagagtgtgattttctgagaaaaatatcaaggcactaatgcacttttggaaatggaaaatatagacagagacgaaacaacatggataataactagaatttgttacctttggtgcttatgatataaatatagacaggaaacttctactgaaatggtttctcctgtgagtgttttaaaagacaagatgtgtaggtttggaataatgtgtttaaaagatggatccagctatgcagttactgggactcctggaatccctccaaacatcagtgccgacatactgtkagcttggtacacttccctggggataccaggccaacaccatatgatccttgctcagaatcacccagccccgaggactctcagaccaataccaggcaaactgcatgggaccagacagtcctggcttagcagggaaagtaagaattgtcctctgggagttcagaggtcaagtgcccagttggagatctatctgggcccctcagccagcttgggactaggtatcttcatctgcaagtcactcaagagtcatccccctccctaccaggctgcttccaatcacagctgcctgcgccccacctccag

SEQ ID NO: 73848 - DNA, 601 bp, Human
tcagcaaatgaactagcatgatcttgtcagttctaaacatggtttataagcaacattctcaattcactaagagagtaagaaaagccataagatccaatacttactttgtgaaaataaatggaatgaggtgacctacatgcattgcttcagaagaggggccccggcccgtgtacagataaaatggcttcttattttcataggcatcaagaacctgattcatatctctaaaggaaaaaggagaagaggaagagtgtgattttctgagaaaaatatcaaggcactaatgcacttttggaaatgraaaatatagacagagacgaaacaacatggataataactagaatttgttacctttggtgcttatgatataaatatagacaggaaacttctactgaaatggtttctcctgtgagtgttttaaaagacaagatgtgtaggtttggaataatgtgtttaaaagatggatccagctatgcagttactgggactcctggaatccctccaaacatcagtgccgacatactgtgagcttggtacacttccctggggataccaggccaacaccatatgatccttgctcagaatcacccagccccgagga

SEQ ID NO: 73849 - DNA, 601 bp, Human
aggcaggacttcctggcacagctgaggatgaagatctgagatgccatcatgctgtggctgagcccatattttaaatttctgtaaatgtaattatggagacaataatcgagtctttaagatactgatatcacttaatcctttctatgtacatacacagcttttcactttcaaaattattggtaaataaaaccaataaaccagctcatagcatttttttttcctttttgagatggagtctcgctctgttgcccaggctggagtgcaatggcgtgatctcaactcactgtaacctccacctccygggttcaagcgattctcctgcttcagccacctgagtagctgggcttataggtgcgtgccaccacacccaactaatttttgtattttcaatagagatggggtttcaccatgttggtcaggctggtcttgaactcctgacctcgtgacccgcccacctcggcctcccaaagtgctgggattacaggtgtgagccaccatggctggccactcatagcatttaataaaggaagaagaacatttactaggccttaagaccatttcagttgtttcgaatttagctgtggtcatgacaacttgacat

SEQ ID NO: 73850 - DNA, 601 bp, Human
ctgatggtgagctaacatgggagggcctgctcagagcccagcctgggctgcaggagcatagcaatgaacccactcctcctggggaatcactttaggggaggagtaacacgtctttggggagtggagtaacatgccttaggggagtaccatgccttaggagagaccacgccttaggggagtactatgacttagaagagtatctcaccttaggggagtaccacaactcaggtgctcaagaaatatttgttgagctagatagtatccttcttgtgatggttgaccaaagtcttatttttctaayacatttcttggtaatcatttgggatgaaacttgaaggattttcagaatgaaatattttggtttattaaatggctgattaaaagaactagactgaggaaactgtgtaaccactgagtcttttctctgtgaggaaaaggtgcgttgaaaaggaggaagacataactctggaagactgactatccttggcaagaaactgcaaggcaggacttcctggcacagctgaggatgaagatctgagatgccatcatgctgtggctgagcccatattttaaatttctgtaaatgtaattatggagacaa

SEQ ID NO: 73851 - DNA, 601 bp, Human
ttttttttgagacagagtctcactctgttgcccaggctggaatgcagtggcatgatctcggctcactgcaacctccgcctcccaggttcaagcgattcttctgcctcagcctcccaagtagctgcaactacaggagcacgccaccacacccggctaatttttgtgtttttagtagagatggggtttcaccatattggccaggctggtctcgaactcctgacctcctgaccttgtgatccacccacctcagcctcccaaagtgctgggattacaggcatgagccaccgcgcctggctgccastactcagttttaaggtcttataagagggaacgttctggggatgcggctctaagcaagtcctcctgtgctcactgctcacctgcccctttagtgtccctcttatcctgcctcggcatggtccctgatggtgagctaacatgggagggcctgctcagagcccagcctgggctgcaggagcatagcaatgaacccactcctcctggggaatcactttaggggaggagtaacacgtctttggggagtggagtaacatgccttaggggagtaccatgccttaggagagaccacgccttaggggag

SEQ ID NO: 73852 - DNA, 601 bp, Human
cccactcagcacaatggaaacaacagagagcaagagcacagccaacagcagcactgcctggaaagatgcggcctttgtcctcctgccaagcaagccaagaacaccgcaggcagggagggtccctcctgggcaccgcagcaggactcacagccagtaaggacagcagctgtctgtcacctggggagatgggctgcagcaaagactccatgcgcccttgggattgaggcacctgggacaccctaacccctacaaggagggaaagtctccagtacccccaaactgtggcaggactgtagcttcrcggcgtctgactggtatttctgagttagagcacgctgccctttcttagaagactggtcattacttgctgcaagctgctgccactgtgctggctgcagggtgaatgcaggtgctgcaccgtgagcacgtgtgatcctcccctcaagggacggctgtccccctgcacagctgggacggacccatcacgcaaagcagccatgccagtgccggcacatggaggcttctcactggctgcagtgaacacacctaactgtatatcacatgtggctgaaccaccagttaccccagggagggcacctgc

SEQ ID NO: 73853 - DNA, 601 bp, Human
ttggaactccaaagtcatccttagatttttctttcttctaaaccttaagacgggtgacaagagagggacagactcacatcctgaagtgcagcttcacccaacccagagaagctgctcaatgcattacactagctagtcagattccaggacaacgatgacccacccacgcctgggcatcctacttaaagagacagttgcaaacgctaacatctcagagatatttaaaccaggcatgtgtctcctccagaactctgctcctttttgaagggtgcagggagtggtccacagcagcagtgggccycttaccaatgcagtcgctgtcagtgaagccgaaaatgcctttcacttggttgaaggtaacatgcttttgaatcttcaccacatttttgtagaaacctgagctcatcctgcaaagacaacgagaatgaaatcccaaacggagggcggccttcactgaaggcaaagtcacagttattaaaattggatgccaatgagtagtggcatgggccagactcggggccacattgtggtcaacacgtaagcactgggaaggtgccaggaagtcatctgtaggcaaagatacctgcatcaggcaaagcag

SEQ ID NO: 73854 - DNA, 601 bp, Human
agcgcagaggtttccgggccctgggcacgcggctggcccagcgtgaccctgacgctgtggagcacacgccgctgtggctctggctccaagcagggtgaacgctcctcacggagagccccggcagcgcatcccagggagctggctcggctggcagctgactgaaggcctcaagggcctgctatgcctgaagccacgcaccaaacatcaagtagaggaggggatcagaaggcccagccacaagtctcaaggaccaaaagtctaaaagtctacgaagccaatgcatctgaaagacacatggaamtttatggagagggccatgaaggcatgcacgtgggaggcaaaccatttgcacatctgctggggtggagccatggaaggagagcagggcaggggtgggaaggctccagaagacctcgtgtcaagcccctcatcttacatgtggggacactgaggcccagggagacaaagactcaaaggccctctcatgggcagcagacccagctgtccttcttcatcacccctgggttccatccaaggccaccctacactgactggggtcccaccagagctgttggaactccaaagtcatccttagattttt

SEQ ID NO: 73855 - DNA, 601 bp, Human
gagcgcagaggtttccgggccctgggcacgcggctggcccagcgtgaccctgacgctgtggagcacacgccgctgtggctctggctccaagcagggtgaacgctcctcacggagagccccggcagcgcatcccagggagctggctcggctggcagctgactgaaggcctcaagggcctgctatgcctgaagccacgcaccaaacatcaagtagaggaggggatcagaaggcccagccacaagtctcaaggaccaaaagtctaaaagtctacgaagccaatgcatctgaaagacacatggamatttatggagagggccatgaaggcatgcacgtgggaggcaaaccatttgcacatctgctggggtggagccatggaaggagagcagggcaggggtgggaaggctccagaagacctcgtgtcaagcccctcatcttacatgtggggacactgaggcccagggagacaaagactcaaaggccctctcatgggcagcagacccagctgtccttcttcatcacccctgggttccatccaaggccaccctacactgactggggtcccaccagagctgttggaactccaaagtcatccttagatttt

SEQ ID NO: 73856 - DNA, 601 bp, Human
tgagcgcagaggtttccgggccctgggcacgcggctggcccagcgtgaccctgacgctgtggagcacacgccgctgtggctctggctccaagcagggtgaacgctcctcacggagagccccggcagcgcatcccagggagctggctcggctggcagctgactgaaggcctcaagggcctgctatgcctgaagccacgcaccaaacatcaagtagaggaggggatcagaaggcccagccacaagtctcaaggaccaaaagtctaaaagtctacgaagccaatgcatctgaaagacacatggmaatttatggagagggccatgaaggcatgcacgtgggaggcaaaccatttgcacatctgctggggtggagccatggaaggagagcagggcaggggtgggaaggctccagaagacctcgtgtcaagcccctcatcttacatgtggggacactgaggcccagggagacaaagactcaaaggccctctcatgggcagcagacccagctgtccttcttcatcacccctgggttccatccaaggccaccctacactgactggggtcccaccagagctgttggaactccaaagtcatccttagattt

SEQ ID NO: 73857 - DNA, 601 bp, Human
ttgcttagacctgcagaagcagaacttttgacctctctatggcccgacaggtggtgccacgccagcccccaccaagtggcggtacccagacccttgggtgagcgcagaggtttccgggccctgggcacgcggctggcccagcgtgaccctgacgctgtggagcacacgccgctgtggctctggctccaagcagggtgaacgctcctcacggagagccccggcagcgcatcccagggagctggctcggctggcagctgactgaaggcctcaagggcctgctatgcctgaagccacgcaccaracatcaagtagaggaggggatcagaaggcccagccacaagtctcaaggaccaaaagtctaaaagtctacgaagccaatgcatctgaaagacacatggaaatttatggagagggccatgaaggcatgcacgtgggaggcaaaccatttgcacatctgctggggtggagccatggaaggagagcagggcaggggtgggaaggctccagaagacctcgtgtcaagcccctcatcttacatgtggggacactgaggcccagggagacaaagactcaaaggccctctcatgggcagcagacccag

SEQ ID NO: 73858 - DNA, 601 bp, Human
tgcgtaccacacccagctgatttttgtatttttagtagagatgaggtttcatcatgttggccagcatggtctcaatctcttgacctcgtgatctgcccacctcggcctcccaaagtgctgggattacaggcgtgagccacggcgcccggccttccttgcctttttcattgtaatgactatccatgttgttactaagtatattctatcctgtcaatgtatcatatcatttaaccattctctagccaccttccacctttaattatcagaagttatgatggcttccctcttccctcttccctcwccccacggtctccctctccctctctttccacggtctccctctgatgcggagccaaagctggactgtactgctgccatctcggctcactgcaacctccctgcctcattctcctgcctcagcctgccgagtgcctgcaattgcaggcgcgcgccgccacgcctgactggttttcggatttttttggtggagacggggtttcgctgtgttggccgggctggtctccagctcctaaccgcgagtgatcagccagcctcggcctcctgaggtgccgggattgcagacggagtctggttcacttag

SEQ ID NO: 73859 - DNA, 601 bp, Human
aacaggttttctcccattataaaacaatcattaaaataaatctaaaaaatacagaaaagtagaaagaacaagctgtacagttgcaatgtgtctgatttcatccattttctttatatattttactctatgcatttttgttgtgattacactatatttggtctttccttggctttttcttttccttttttttttctcagaaggagtctcgctttgttgccaggctggagtgtggtggctcgatctcagctcaccgctacctctgcctcctggggttcaagtgattctcctgcctcaggctccygagtagctgggactacaggtgcgtaccacacccagctgatttttgtatttttagtagagatgaggtttcatcatgttggccagcatggtctcaatctcttgacctcgtgatctgcccacctcggcctcccaaagtgctgggattacaggcgtgagccacggcgcccggccttccttgcctttttcattgtaatgactatccatgttgttactaagtatattctatcctgtcaatgtatcatatcatttaaccattctctagccaccttccacctttaattatcagaagttatgatggctt

SEQ ID NO: 73860 - DNA, 601 bp, Human
tgattcatgtgggaaggacaggctgccttgagttctgcagggagcaaagttggcaatcctggagttcagcattgctacggtggctgggtggctgaggcccaaagcactgcgcagtggtgtgtgtgtgcgtgtgccccccagggcatgtttctgatcccgctggctgccctctgcctgggccactgctcaccttggttttgatctgcttggccgtgtcggtgaggaagatggaggagttggggtcgctggcactcattttggtctgggcgccctgcagggctgggaagaaggtggagtgcarcagggctggtttaggatagccgatcctgggggcgacgtcccttgtcattctaaagtaaggatcctgtggggagagtaaggaccctgatgagggcggccagaaaacatgccagctttcagccatgagcagtccctgtgagcatcttcccagaaggctctcatgcttccaaccaaagaaattcactccctcctccccttcatcttttccttttttttttttaaattttacttccagttctgggatacatgtacagaacacgcaggtttgttacataggtatacatgtgccatggtggtttgc

SEQ ID NO: 73861 - DNA, 601 bp, Human
gcattcccactgcaatcttctagcctgcaaacacacacttgattccaaagaaaatgtcaactgctttgtgtaacagtgaggcaattatatatacactggctgttgaggaaccaggcaacagaactggggccatgcaaaataaggaagctcaaactaacttctccttttagtttctctagtgatttgtcaaatgtttgctgaatgcctgctgcatgcatccctcctggggccagcaggactgtcccgtggatggacgtttctccgttctatgtctctcagtgagaacgctctctgggagaaraccagctcataacccctgcttggtaatggctgctcagggccaggagagcagtgctgctgattcctggtggtggaaacttggtcaagtggctgggcttctctaagcctcatcatctcatctttaaagggaatagcaccaccacctcccagtgagaatgaaacatgagaaaacataaataaggcaccgggtccagccgctggaacacagctgatgatgagaaatatacacaaatcttttccattatttaataacatccacactaattataactttaaggaaattgccatgactttgcctgca

SEQ ID NO: 73862 - DNA, 601 bp, Human
gcctctgtttttcctgacctcatgctaactgctcacctcgagggctctactggtccctaagtgaatgataaatgtcccagatccataaacaagtttttcttttttcttttctttttttttttttttgagctggagtctcactctgttgcccaggctggagaacagtggtgcgatctcggctcactgcaacccctgtcttccagggtcaaacaattctcctgcctcagcctcccgagtagctgggattataggtgcctgccaccaagcctggttaatttttgtatttttagtagagacaggrgtttcaccatgttggccacgctggtctcgaactcctgacctcaggtgatccacctgcctcggcctctcaaagtgctggaattataggtgtgagctatcgcacctggccataaacaactttttccaaacaacttctcagaagcaaaataaaacagtggacttttccaatggcgcttccctccccactctgcaccctgtgctccggaagttttggccagaagtgaaagggaaagaaaagtcttcaattataccagcttccaactgagtggggagagttggtggagggcatgtcttaggaagt

SEQ ID NO: 73863 - DNA, 601 bp, Human
gccctgcctgaacctgttatttttaggaggctggagcagatgtgccctctcttttctagtgtggagattctgattttggagctgaagtcgggcacggggatttagagtgagggcctgggcgggccctgttctgccccacaagaagcctgcaggcccagtgaccgtctgtaggcctctgtttttcctgacctcatgctaactgctcacctcgagggctctactggtccctaagtgaatgataaatgtcccagatccataaacaagtttttcttttttcttttctttttttttttttttgagytggagtctcactctgttgcccaggctggagaacagtggtgcgatctcggctcactgcaacccctgtcttccagggtcaaacaattctcctgcctcagcctcccgagtagctgggattataggtgcctgccaccaagcctggttaatttttgtatttttagtagagacaggagtttcaccatgttggccacgctggtctcgaactcctgacctcaggtgatccacctgcctcggcctctcaaagtgctggaattataggtgtgagctatcgcacctggccataaacaactttttccaaaca

SEQ ID NO: 73864 - DNA, 601 bp, Human
ccagcactttgggaggccaaggcgggcagattacgaggtcaggagatcaagaccatcctggctaacacggtgaaaccccgtctctaccaaaatacaaaaaattagctgggcgtggtggtgggcgcctgtaggcccagctactcgggagccttgaggcaggagaatggcgtgaacctgggaggcagagcttgcagtgagccgagattgtgccactgcactccagcctgggcgacagagtgagactccgtctcaaaaaaaaaaaaaaaaaaaggaaaaaaaaagttatagaatgaaaaactayggaaaataccaataaacaggaggaagaaaaaaaccacctagtagtggtgtctcctagcatctaagtgcctgatagagtcactgctatgtggtggccatagccctccctgctgggccttggggaagaagcttcagtgtcaggaagaaagtctgagaacacaggtcctggcttccaggggcagtttgaagaggatattgaaaggccagttcccagaactttatctgagaggagaacaaggaaactggtgtctgctgcatgtttttcaagatgtgctggcgtcaccaccacctgcacactccc

SEQ ID NO: 73865 - DNA, 601 bp, Human
caaaaggagcagatgagtgttggggcaaaggcgcctgtctccattttggcagggcattgctgagaggctgggcagggaaagcagcagtcacgcgagaggctcaggcaaggcccatgcgaggggctggcgcagtggctcacgcctgtaatcccagcactttgggaggccaaggcgggcagattacgaggtcaggagatcaagaccatcctggctaacacggtgaaaccccgtctctaccaaaatacaaaaaattagctgggcgtggtggtgggcgcctgtaggcccagctactcgggagccytgaggcaggagaatggcgtgaacctgggaggcagagcttgcagtgagccgagattgtgccactgcactccagcctgggcgacagagtgagactccgtctcaaaaaaaaaaaaaaaaaaaggaaaaaaaaagttatagaatgaaaaactatggaaaataccaataaacaggaggaagaaaaaaaccacctagtagtggtgtctcctagcatctaagtgcctgatagagtcactgctatgtggtggccatagccctccctgctgggccttggggaagaagcttcagtgtcaggaagaaagtc

SEQ ID NO: 73866 - DNA, 601 bp, Human
agcagagtcctaactagataagttgggattgtgcaaaaggagcagatgagtgttggggcaaaggcgcctgtctccattttggcagggcattgctgagaggctgggcagggaaagcagcagtcacgcgagaggctcaggcaaggcccatgcgaggggctggcgcagtggctcacgcctgtaatcccagcactttgggaggccaaggcgggcagattacgaggtcaggagatcaagaccatcctggctaacacggtgaaaccccgtctctaccaaaatacaaaaaattagctgggcgtggtgrtgggcgcctgtaggcccagctactcgggagccttgaggcaggagaatggcgtgaacctgggaggcagagcttgcagtgagccgagattgtgccactgcactccagcctgggcgacagagtgagactccgtctcaaaaaaaaaaaaaaaaaaaggaaaaaaaaagttatagaatgaaaaactatggaaaataccaataaacaggaggaagaaaaaaaccacctagtagtggtgtctcctagcatctaagtgcctgatagagtcactgctatgtggtggccatagccctccctgctgggcct

SEQ ID NO: 73867 - DNA, 601 bp, Human
tgaaactacaaaattagctgggcgtggtgtcatgtgcctgtaatcccagctatttgggaggttgaggcaggagaatcgcttgaacccgggaggcggaggttgtggtgagccgagattgtgccattgcactccagcctgggcaacaagagtgaaactccatcacacacacacacacacacacatacacacacacacacacacagaattctagagcagagtcctaactagataagttgggattgtgcaaaaggagcagatgagtgttggggcaaaggcgcctgtctccattttggcagggcaytgctgagaggctgggcagggaaagcagcagtcacgcgagaggctcaggcaaggcccatgcgaggggctggcgcagtggctcacgcctgtaatcccagcactttgggaggccaaggcgggcagattacgaggtcaggagatcaagaccatcctggctaacacggtgaaaccccgtctctaccaaaatacaaaaaattagctgggcgtggtggtgggcgcctgtaggcccagctactcgggagccttgaggcaggagaatggcgtgaacctgggaggcagagcttgcagtgagccgagattg

SEQ ID NO: 73868 - DNA, 601 bp, Human
cacaatgacttttaggaattgttaaagataatcacggggtaattaaggctaataaaagccagaacaaataggtgaaactccttcaacattctttcagtgagcatctgagaaaatgtcaccctaattttttttttttagataggatctccagtctgttgcccaggctggagtgcagtggtgtgatcatggctcactgcagccttgacctcctggtctcaggttaccttcctgcctcagcctcctgagtagctaggagtataggtgtgtgccaccagcctggctaattttttggtattttttstagagaccaggttttgtcgtgtagtccagtctggtcttgaactcctgggctcaagtgatctgcctgccttggcctcccgaagtgctgggattacaggtgtgagtcactgtgctcagccccttaacttttttttttgtcaccatgcccggctaattttgtatttttagtagagacagggtttcaccatgttggccaggctggtcttgaactcccaacctcaggtgattcgcctgccttggcctcccaaagtgctggaactgcaggcatgagccactgtgcccagtcttaacttttttttaa

SEQ ID NO: 73869 - DNA, 601 bp, Human
taagtcatcctcagagtaagggagatggcaggaagggcagcctctcttagggataggtactgcagtgttaatggggacaggaaagcagtggccagccccacacagaaagcataacaagaaggcacagggtaaggcagtaagggaaggcaaacccacgagaagtgctgtgcagggagaggggcctgcaggcaggtcttcacttacaaacaggcaacactgtcagagctgaaaaactcagaaacacaatgacttttaggaattgttaaagataatcacggggtaattaaggctaataaaagcyagaacaaataggtgaaactccttcaacattctttcagtgagcatctgagaaaatgtcaccctaattttttttttttagataggatctccagtctgttgcccaggctggagtgcagtggtgtgatcatggctcactgcagccttgacctcctggtctcaggttaccttcctgcctcagcctcctgagtagctaggagtataggtgtgtgccaccagcctggctaattttttggtattttttgtagagaccaggttttgtcgtgtagtccagtctggtcttgaactcctgggctcaagtgat

SEQ ID NO: 73870 - DNA, 601 bp, Human
tcctctctgccaaaaaaaaaaaaaaaaaggaattagctggtgtggtgacgtgcgcctgtagtcctagcgactcgggaggctgaggtggaaggatcgctcagactcaggagtttgaggttatagtggactgtgattgcatcactgcacgccagcctcggcgacagagcaagaccttgtttctaaaataataaaaactaaaaaaataaataaataaaagaaaaaggatgagtaagtcatcctcagagtaagggagatggcaggaagggcagcctctcttagggataggtactgcagtgttaayggggacaggaaagcagtggccagccccacacagaaagcataacaagaaggcacagggtaaggcagtaagggaaggcaaacccacgagaagtgctgtgcagggagaggggcctgcaggcaggtcttcacttacaaacaggcaacactgtcagagctgaaaaactcagaaacacaatgacttttaggaattgttaaagataatcacggggtaattaaggctaataaaagccagaacaaataggtgaaactccttcaacattctttcagtgagcatctgagaaaatgtcaccctaattttttt

SEQ ID NO: 73871 - DNA, 601 bp, Human
ctactgtggggctcactgcaggagaggtgggggcagatgagctttgaaccccccatcctcggagacacaggagaatagagttgggaaagccaaggcactgattgaactgaaacctgggacagacaagttcctcaggtaacaagcgtcagaaaaaggatgggtaaggccagacatggtagcttgtgccagtaatctcagcattttgggaggctgaggggggaggatcgattgaggccaggaggtcaagaccagtctgggtaacttagtgagccctcctctctgccaaaaaaaaaaaaaaaaaggaattagctggtgtggtgacgtgcgcctgtagtcctagcgactcgggaggctgaggtggaaggatcgctcagactcaggagtttgaggttatagtggactgtgattgcatcactgcacgccagcctcggcgacagagcaagaccttgtttctaaaataataaaaactaaaaaaataaataaataaaagaaaaaggatgagtaagtcatcctcagagtaagggagatggcaggaagggcagcctctcttagggataggtactgcagtgttaatggggacaggaaagcagtggccagcccc

SEQ ID NO: 73872 - DNA, 601 bp, Human
gtcaggtacatgaaagacacgtccacatcacagttgcccccaaactgcctgtgctcctcgatggtgtctctccctccagaaaacgcatgcttattgacctgcaccagaagaggacacagacacgctcctcagtcctgctcatcctgtgcctggacactggctagaagcccaagtgtggaagtcagaggtgtgagtgctgtcagattctggaccagggaaaggccaaggcgcacagccggtcgggggcgcacagccagtgggggacccactgctgttcttcctgtgaggcttgggtgtgagstactgtggggctcactgcaggagaggtgggggcagatgagctttgaaccccccatcctcggagacacaggagaatagagttgggaaagccaaggcactgattgaactgaaacctgggacagacaagttcctcaggtaacaagcgtcagaaaaaggatgggtaaggccagacatggtagcttgtgccagtaatctcagcattttgggaggctgaggggggaggatcgattgaggccaggaggtcaagaccagtctgggtaacttagtgagccctcctctctgccaaaaaaaaaaaaaaaaa

SEQ ID NO: 73873 - DNA, 601 bp, Human
gggtggcaggaggcggctgtgggcccttggggttccctgctcaccttcctgatctgctcgagcttgtcgtcgtcctcgaggaagaaggtcaggtacatgaaagacacgtccacatcacagttgcccccaaactgcctgtgctcctcgatggtgtctctccctccagaaaacgcatgcttattgacctgcaccagaagaggacacagacacgctcctcagtcctgctcatcctgtgcctggacactggctagaagcccaagtgtggaagtcagaggtgtgagtgctgtcagattctggaccmgggaaaggccaaggcgcacagccggtcgggggcgcacagccagtgggggacccactgctgttcttcctgtgaggcttgggtgtgagctactgtggggctcactgcaggagaggtgggggcagatgagctttgaaccccccatcctcggagacacaggagaatagagttgggaaagccaaggcactgattgaactgaaacctgggacagacaagttcctcaggtaacaagcgtcagaaaaaggatgggtaaggccagacatggtagcttgtgccagtaatctcagcattttgggaggctga

SEQ ID NO: 73874 - DNA, 601 bp, Human
actgcactccagcctgggtgacagagcaggactctgtctcaaaaaaaaaaaaaaaagaaagaaatgagggtcttgctatgtcgcccaggctggatttgaactcctgggctcaagggatcctcctgtctcagcttcccaagtagcaggggctacagatgtgtgccaccatgccctgcatatgaacacttaaaatagttcatgcccgcataataatccaccctgtaacaattctaatttaacgtttcctctgttgtactgagtctgtgttgaactttttgctattatcatttttaacatcttygtgtggaaagctttctcttactcaggattatttccttggaaaaaatctaagaatgagaaaacctgaggagaagctctgaacatttttgggctctttgtacccagtaccaaactgcttcctgaggctgtgctgataaacactctgctcacttgagtgtgccttgaagcatctgcttcataatcactgaaaatagtcaatggcaacacaaaagcccctactaattctatactcaactgtcttagctttgatcacgttaacttacatttctctgatgactaataaagcaagactgttttgggt

SEQ ID NO: 73875 - DNA, 601 bp, Human
ttaaaagaaatgagggtcttggctggacgcggtggtcacagctgtaatccaagcactttgggaggccaaggcgggtggatcacgaggtcgggaggtcgagaccatcttgaataagacggtaaaaccctgtctctactaaaaatacaaaaaaattagccgggcatggtggcgggtgcctgtagtcccagctactcgggaggctgaggcaggagaatggtgtgaacccgggaggcagagcttgcagtgagccgagattgcgccactgcactccagcctgggtgacagagcaggactctgtctaaaaaaaaaaaaaaaaagaaagaaatgagggtcttgctatgtcgcccaggctggatttgaactcctgggctcaagggatcctcctgtctcagcttcccaagtagcaggggctacagatgtgtgccaccatgccctgcatatgaacacttaaaatagttcatgcccgcataataatccaccctgtaacaattctaatttaacgtttcctctgttgtactgagtctgtgttgaactttttgctattatcatttttaacatctttgtgtggaaagctttctcttactcaggattatttccttgg

SEQ ID NO: 73876 - DNA, 601 bp, Human
ttttcttcacatttctttccctgtgcatttcatttaaacatagttaactcctccctgagttttcatttggtatccttttttcactatcataggcatattttcctgtgtcactaaaacttttttttttttaaaagaaatgagggtcttggctggacgcggtggtcacagctgtaatccaagcactttgggaggccaaggcgggtggatcacgaggtcgggaggtcgagaccatcttgaataagacggtaaaaccctgtctctactaaaaatacaaaaaaattagccgggcatggtggcgggygcctgtagtcccagctactcgggaggctgaggcaggagaatggtgtgaacccgggaggcagagcttgcagtgagccgagattgcgccactgcactccagcctgggtgacagagcaggactctgtctcaaaaaaaaaaaaaaaagaaagaaatgagggtcttgctatgtcgcccaggctggatttgaactcctgggctcaagggatcctcctgtctcagcttcccaagtagcaggggctacagatgtgtgccaccatgccctgcatatgaacacttaaaatagttcatgcccgcataataa

SEQ ID NO: 73877 - DNA, 601 bp, Human
aaaatctaataggaaggtgctaacaggcgctgtcctgcatccagggtgccttgtagaattcatagcagtttgagtttagcagaaactatgtttaaatgaaacatgaatactttagtacttaatggttatcaaaagataatttccatgtattttggtagctcaagagattacatactgatcatgttggaactaaaagtcatggttttggccgggcgcggtggctcacgcctgtaatcccagcactttgggaggctgaggccggtggatcacttgaagtctggagttcgagaccagctggccrtcatagtgaaaccccatctctactaaaaatataaaaattagccaggcgtgatggcgggagcccgtaatcccagctactcgggaggctgaggcaggagaatcgcttgaacccaggaggcagaggttaacagtgagccgagattgcaccactacactccagcctgggtgacagagcgagactctgtctcaaaagggggggggggcatttttttttgttaataccaatgagtaagggatgggggttttagttattgatgaatttgcagaattcagaatacgatttgaaataagatatttaggt

SEQ ID NO: 73878 - DNA, 601 bp, Human
ttcactaaaatagccccttagtttggaatgaactgtgaagtaacagttttgcataagccccaagctgagttacttgaagtccttataaaaatagttgtacatacagggtattccccgagggtctagttacttcttagaccctcttggtttaaaaagcaaaaagatcaggctgggtgcagtggctcacacctgtagtcccagaactttgggaggccaaggcaggaggatcgcttaagcccaggagttcgagatgaaccttggcaatatagtgagaccccgtctctgcaaaaaaacaaaaaamcccacaaaaattagccagtcatggtagcacatgcctgtagtcactctcagctacttggtagattgaggtgggaggatctcctgagcctgggaaatcgaggctgcaagtcagcggtgattacaccactgtactccagcctaggtgacagtgagacactgtcaaaaaaaaaaaaaaaaattggccgggcgcggtggctgacgcctgtaatcccagcactttgggaggccgaggcgggtgggtcacgagctcaggagatcgagaccatcctgcctaacacggtaaaaccctgtctctactaaa

SEQ ID NO: 73879 - DNA, 601 bp, Human
cttcccgggttcataccattctcctgcctcagcctcccaggtagctgggactacaggcgcccaccaccacgcctggctaattttttttctttgtattttttagtagagatggggtttcaccgtattaaccaggatggtctcaatctcctgacctcgtgatccgcccgccttggcctcccaaagtgctgggattataggcatgagctactgtacccagcctactcaatttcttaaagcaagagtcttccattttaacatgacctggcaaatgagatattaggaactcttgagaaaaaaaaawttttttgagacgggtttttgctatgttgttgaaactggagtgcactggctattcacaggtgtgatcattgtgcgctacagccttgaactcctgggctcaagcggttctctggccttagcctccctagtagctgggactagaggtgtgtgccattccacccagcttgagtaaaattctttttttttttttttttttttttattgaaacggtgtctcgctctgtcacccaggctggagtgcactggcgcgatctcggctcactgcaagctctgcctcccgggttcacaccattctccttcct

SEQ ID NO: 73880 - DNA, 601 bp, Human
agctactgtacccagcctactcaatttcttaaagcaagagtcttccattttaacatgacctggcaaatgagatattaggaactcttgagaaaaaaaaaattttttgagacgggtttttgctatgttgttgaaactggagtgcactggctattcacaggtgtgatcattgtgcgctacagccttgaactcctgggctcaagcggttctctggccttagcctccctagtagctgggactagaggtgtgtgccattccacccagcttgagtaaaattctttttttttttttttttttttttatwgaaacggtgtctcgctctgtcacccaggctggagtgcactggcgcgatctcggctcactgcaagctctgcctcccgggttcacaccattctccttcctcagcctcccgagtagctgggactacaggcgcccaccaccatacctggctaatttttttgtatttttggtagagacgggtttcaccgtgttagccaggatggtcttgatctcctgacctcatgatcggcccgccttggtctcccaaagtgctaggattacaggcgttagccatcacgcccagccaagtaaaattcttaatagc

SEQ ID NO: 73881 - DNA, 601 bp, Human
ctggtttatccaggtgggtaccaaatgtaatcacacaagtgtccttgtattcacaggaaggcagtgggagattgactgccaaagaggaagtaggagaggtgtgagaggttggagtccagtgaagagaaggggtcaaggaatgtaggcagccttcagaagctagaatatgtgagggaccagattctccactaaagctgccagaaggaacccacacaacgactttatagctctgaaactgattctcactgctggcctctagaactataagagaataaattcctgttgtttcaaaccaccaaaytggtggtagtttgttacagtggtaataggaaactaatacatgtgctagcatcccctgtatagcttcattctgcaggaacttggcaagtccctgttatgtgcaaggcacaagacctactgttcccccttaaacctaggagaggggggaagtggaataaaggggctttttttgcacactactcaatttcccagacatgatggttggcatttaacatgttaccttgttttagccttataagatcagtggtatccttcctccctccctccctttgtcccttcctcccctcccctccctttgctt

SEQ ID NO: 73882 - DNA, 601 bp, Human
atttgggttttggagagtggactgggcttaggtaggtcatgagaggaaggcaagagggtaaattgtattgagtaccttttactagacactgagaaaaccactttgcttggagcgtggagggcaggtgagactccatctttttacttctctggacttgtagagtgcttctagcctttccatttatttagttccttaattatatctttttgactggaaattggagtctacaaactcagtcttatgctttgctcctcaaactagacttggagtgattattgctttggtaacatagaagaacacygagcagctgggagattgggatgggccagcggcttatttatacaatacctttaaccttctgaatagtaccatatgcagaaatagaaacttttaaatgtgagttaattgtccttccacatatatgactagtgttggctagattttgtttttccacacattctatcttaggccaagttagtcttggtctagttgttttaggtcattgcatttagccagagtgtgagtgagcactgtagtcacctaatcgacagttttgggtagaagttcctaacatgatggttgcccacatcaccttaccccc

SEQ ID NO: 73883 - DNA, 601 bp, Human
ctctgtcgcccaggctggagtgcagtggtgcaatttcagcttactgcaaactctacctcccaggttcaagcggttcttttgcctcagtctcccgagtggctgggattaaaggcacacgccaccacacctgctaaattttgtatttttagtcaagatggatttttgccatgttggccgggctggtctcgaactcctgaccttaggtgatcagcccaccttggcctcccaaaatgctaagattacaggtgcgagccaccatgcctagcctattttatttatttatttatttatttttttttttgagtcgaagtctcacagtgtcgcccgggctagagtgcagtggtgtgatcttggctcactgcaacctccgcctcctgggttcaagcaattctcctgcctcagcctcccaagttagctgggattacaagcgcccgccaccacgcccagctaattttttttttttttttttttttttttttttttttggtatttttagtagtgacgggatttcactatgttggccaggctggtctcaaactactgacctcgtgatccacccaccttggcctcccaaagtgctaggattacagatgtgagccac

SEQ ID NO: 73884 - DNA, 601 bp, Human
agaggaatggaatgttgttatatgttacaacaggtgggtcttaaaaacattatgcttagtgaaataaaccaggcatggatggcaaatactgtatgattcaactggtatgaggtacctgaaataggcaaattcatagagacagaaagtagaattgaggttagcaggtgctgaggggaagtgaaagttcttgcataatgggtatagagttttttgcgggaatgaagaaaatattttgggtatagatagtggtgatggttacacattctgaatgtattaaatggcactgaactgtacacttacrtatggttaaaatgagaagtattatggtaatgtatattttaccacaattttttttttttttacgaaaaccgtggaaatatagaggttggatttggccaactggctgtactagttgattcctgatataggtcataaagtcttgtcagcgtctactttaggcttctttcatatatttttttggtttctgattctgaattattttagtgaccatcctgagggttcttgatattcttcagtgttggtagtgtatgccacttgcacttgatatgtcgctaagttctctttagacagagctagttgt

SEQ ID NO: 73885 - DNA, 601 bp, Human
gaaataaaccaggcatggatggcaaatactgtatgattcaactggtatgaggtacctgaaataggcaaattcatagagacagaaagtagaattgaggttagcaggtgctgaggggaagtgaaagttcttgcataatgggtatagagttttttgcgggaatgaagaaaatattttgggtatagatagtggtgatggttacacattctgaatgtattaaatggcactgaactgtacacttacatatggttaaaatgagaagtattatggtaatgtatattttaccacaattttttttttttttacgaaaaccgtggaaatatagaggttggatttggccaactggctgtactagttgattcctgatataggtcataaagtcttgtcagcgtctactttaggcttctttcatatatttttttggtttctgattctgaattattttagtgaccatcctgagggttcttgatattcttcagtgttggtagtgtatgccacttgcacttgatatgtcgctaagttctctttagacagagctagttgtctccctacctgtggatatacctcttcagtctcctttgcaaagtattcctcagtctttcaa

SEQ ID NO: 73886 - DNA, 601 bp, Human
tataggtcataaagtcttgtcagcgtctactttaggcttctttcatatatttttttggtttctgattctgaattattttagtgaccatcctgagggttcttgatattcttcagtgttggtagtgtatgccacttgcacttgatatgtcgctaagttctctttagacagagctagttgtctccctacctgtggatatacctcttcagtctcctttgcaaagtattcctcagtctttcaatattagaattgctcagatttgggttctgagccccactcaagaagtatttcctcatttgacttmcctcactagactgtaagttccttgagagcagatactttgtttctagcttttattcccagtgcccagaacaatgccaggcacataggaggccctcaatatgtgtagaactaatgataataatcatttagcctgtgattcctttatgccatgagttcagtcttctgtctcagcacacttgagacatgccctctggggtagactgcatgtttgtgtctctcccagattcatgtgttgaaatcttaacccccaatgtgatggtattagagggtaggtcctttggaaggtaatttaggtctgagg

SEQ ID NO: 73887 - DNA, 601 bp, Human
ggtggaattagagtcatgtaaagtttacaattgtattcagtgcttttcattgctgagagtgattgaacttgataatgaccacttgaatcaaatggaacctacgttctatcttgatcttcctctcatactccagctttgctctgaggtcagaaagctgtgtgctaagcagttatatgtagtttttggtggttgtagatttcgttttggtttggttgttggtcttgatttttaacactggtggaaaggtaattcaaggtaaaagttgaagccagtttcacttctgaaatattttattttactrcttttggtgagacagacaatttgagaagcaaaaacttgcagttagccttgaaaatttcggagtacctatttctaatttaggcatcaaaggtagaagaagacttgtttttggcctctgggcacttctgctctaccttaagaggcaagacccgccaggcactgtggctcccagcactttgggaggccaaggcgggtggatcacgaggtcaagagatcgagaccatcctggccaacatggtgaaaccctgtttctactaaaaatacaaacgattagctgggcatggtggtgtgtgcctgtagt

SEQ ID NO: 73888 - DNA, 601 bp, Human
ctggtggaaaggtaattcaaggtaaaagttgaagccagtttcacttctgaaatattttattttactacttttggtgagacagacaatttgagaagcaaaaacttgcagttagccttgaaaatttcggagtacctatttctaatttaggcatcaaaggtagaagaagacttgtttttggcctctgggcacttctgctctaccttaagaggcaagacccgccaggcactgtggctcccagcactttgggaggccaaggcgggtggatcacgaggtcaagagatcgagaccatcctggccaacrtggtgaaaccctgtttctactaaaaatacaaacgattagctgggcatggtggtgtgtgcctgtagtcccagctaatcgggaggtggaggcaggagaatcacttgaacctgggaggcggaggttgcagtgagctgagattgtgccactgcactctagcctgggtgacagagcgagactccgtctcaaaaaaaaaaaagaggcaagaccaacaaaaattcaaactggaatgattgagtctgtcagggaataatctaggagctcaaagaaaaggtaggaatcaagactgaactgataaaatga

SEQ ID NO: 73889 - DNA, 601 bp, Human
tggctaagtttttgtattttagtagagacagggtatcattgtattagccaggatggtctcgatctcctgacctcgtgatccacctgcctcggcctcccaaagtgctgggattacaggtgtgagccaccgtgcctggtccttttttttttttttttttttttttttttggaggcagagtcttgctctagactgaagttgcagtgacgcagtgacgtggtcacggctcactacagcctcgacctcctgggctcaagtgattgtcttgcctcagcttcccaagtagctgggactacaggcatgyaccccatgcctggctaattttaatttttttgtggagatggggtctctccctttattgcccaggctggtctaggaacttctgggcttaagtgatcctcctgtcttgatctcccagagtgctgggattacaggcatgagccactgcacctggcctattttttgtaacctgttggatatgagatgatagtaagacatacaaatagagatgtcgtacatttctttgaacatatgcttatttatttttattttttgctttgtttttttgagacagactctcactctgtcactcaggctggagggc

SEQ ID NO: 73890 - DNA, 601 bp, Human
tccaaagtgctgggattataggcatgaaccactggtgctgggccgaacatatatttgttgagggccagctatgtgcagattttgaacaaggctctgtaaatgcacgggatcaaaactgaccaacctccatgtccatatgcagcttacagtctagtgggaggatgacaaaaatcacacagctataattacaaattttagtcaatggaaattgcatgaataaacaccttgaggttagggtagatgggccatgatacaactggggagctaaagggccaaaatagaggagtgaagagggaggagkctggagaggtagcaagagactagctaagaggtgaaggctatgaaatcagatttgaatcagcaccactgaattggtagttgccaggaaatgtgtgtggtgtgagtgaaaagccgaaatctaggctgggtgtggtggctcatgcctgtaatacgaggactttaggaggccaaggcaggaggatcgcttgagtgcatgtgttccagaccagcctgggtaacattgtgagaccctgtctctacaataaataaaaataattagctgggtgtggtggcacctgcctgtagtcccagctactcagga

SEQ ID NO: 73891 - DNA, 601 bp, Human
cttttaagttaaatgaactaataaactctggagcagaaagcctaatgcctttccatacctgaggttggttggaacctggaatagctcaggaaatttcggcaagggcaggatcaagaagaaagaaatccttttgatcttgcacattctaagaacagagtgggttgctttttttttttcttttgagagcagagtggtagaggtggagaccgttcagtgtcctggcttccttcttggccctgccgaaaacaaggtgggcagttcctgccacctggagctcgtttccccacctgtcaaatgggcrttaagaattccattgtggtttgatacatggaggttctcactgtgttgcccaggctggagtgcagtagcatgatgatagctcactacagcctcaagcaatcctcctgccacacctcccgagtagctggaactacaggtgtgtgccaccatgcctggctaatttttttattttattttattttattttttgtagagatggagtctcactatgttgcccaggctggcctcaaactcctggcctcaagtgatcctcctgcctcggtctctcaaattgttgggatgacaggtatgagccactgca

SEQ ID NO: 73892 - DNA, 601 bp, Human
aatccttttgatcttgcacattctaagaacagagtgggttgctttttttttttcttttgagagcagagtggtagaggtggagaccgttcagtgtcctggcttccttcttggccctgccgaaaacaaggtgggcagttcctgccacctggagctcgtttccccacctgtcaaatgggcgttaagaattccattgtggtttgatacatggaggttctcactgtgttgcccaggctggagtgcagtagcatgatgatagctcactacagcctcaagcaatcctcctgccacacctcccgagtasctggaactacaggtgtgtgccaccatgcctggctaatttttttattttattttattttattttttgtagagatggagtctcactatgttgcccaggctggcctcaaactcctggcctcaagtgatcctcctgcctcggtctctcaaattgttgggatgacaggtatgagccactgcacatggcccaagagtttttgtttgttagttttgttttttgagatggattttcactcatctcccaggctggagtgcagtggtatgacctcggctcactgcaacccccacctcctgggttcaagcg

SEQ ID NO: 73893 - DNA, 601 bp, Human
tctcctacctcagccccccaagtagctgggattacaggtgcatgccaccatgcctggctgatttttgtgtttttagtagagacggagtttcaccatgttggccagcctggtctcgaactcctgacctaaagtgatccacccaccttggcttcccaaaatgattatagacgtgagccactgcacccagctggccctagagttttgatagagatggagggtttactgggaattagggcgcttccagggaaatgactggagttgaggtaaactggaaccagatcattaagggcgatgaatcctrggccaggctgtgcagacatttctcatatgcagtgggcagctactgcagactttgagctggggagaaggggctgtgtgagtagagcgttaacttgggagaagtcctttgcagctgtctgtgcaggctagattcatacaggcacaggaaatgagagaggtcagttgaacaagagttaatgaaggcctgagttagaattgtggcagtcagataacaaaggaataaatgtgatagaaattacaagagaccagctgggctctgtggctcaagcctgtaacctcaacactttgggaagctgaggtg

SEQ ID NO: 73894 - DNA, 601 bp, Human
cagcatctcaaaccaaatactgactactctgagccccaaaccagaacactgaagctttttttttttttttttttgagatggagtctcactctgtcgcccaggctggagtgcagtggcacgacctcggctcactgcagcctcttccacccgggttcaagtgatctcatgcctcagcctcccaagtagctgggattacaggcgcctgccaccgtacccggctaatttttgtatttttcatagagacaaggtttcaccatcttggccaggctggtcttgaactcctaacctcatgatccacccrcctcggcctcccaaagggctgggattacaggtgtgagccaccgtgcctggccttttgaaactttaaattacaattgtgattctcccgtgtccacatggctggggaggcctcagaatcatggcaggaggcaaaaggcatttcttacttggtggcggcaagagaaaaatgaggtagaagcaaaagtggaaacccctgataaacccatctcagatctcgtgagacttactatcatgagaataacatgggaaagattggtccccatgattcagttacctccccccgggtcccacctacaacatg

SEQ ID NO: 73895 - DNA, 601 bp, Human
gtcccacctacaacatgtgggaatcctgggagatagaattcaagttgagatttgggtgaggacgcagcgaaaccatgtcagagggtaagaggtcccagtggcagagtaaaagcatcattcagacaaatagaaggagactcaggaggtacgagagagaggaataaaacctctttggattatacattgtgaaggagttgcagtggaggggcggagggctgaaggaaaggttttgaagagagagggaatctatgggtggtgagcagtaaagccattaggtgttggtgacccttggcactgctcmccctccttggagcattggagcagctgatctaaaagtttgtccccagtcttctgagcagaaaatccagggacacatgttactgttgggaaggtaacatggctaccttagaccatactccttaagaaagggaccacccacagagactggcacccgggtaccagatagccatccaaaacaccagggctgaagaacccaaaagtttcagtaagataggccatcaagtggaaagaatgatagacctgaatgagacttttcttcagtagcaggggataattagagacaataaaacaatgctttgag

SEQ ID NO: 73896 - DNA, 601 bp, Human
gttttaaactcttgggggccagaccacatcttcgctaattacggcccatagaacttgtcctgctggcctccagtcttcgcccccagcactcacagtggcattagagccgcagctgttggcttaaggtagaatgtaagctgcttttctgtctcctctgtgcactggggtgatggggtgctggactggacttgaaactgtccaaagagtatttcaggctcatgctgcactcagcctagactgcctagtaaatcagttacatacgcacatgggcaaaatataagccataatgactttaattggraagtctgacattgggaaggtggacagtctatggatgactttttttcccgaaatgtctgttcagtaaacattttgaaaagtggtcagtgagtggtccagtgagttctgtttcctgtaaagtgaccacctttgtatgtgtttcactaaataaagttagacctttgaaaacctttggtctagaaagattagaatggttaggccaatcccaaatgggtatttttgttgctgttcactacttaccctgagactttcacaatattaatgtatagatgaaatgtgataatggagatgaaaatacctc

SEQ ID NO: 73897 - DNA, 601 bp, Human
aagtatatttttgaaaaatgacttttttcattgttggcattcaaataaaatcttaaaagtaccaacgtatactgctgcatttgccactctgtgtgaaggaggatgatttgccaaggagcttaagagtggctgcatttaaatcttccacttactccttaagtccaagggtatttgtccaaatgcattttaaactctcattctaaaattaaatatatttctaaatactagcacacattttgaaaatgacattttaagaaaaaataataccacttataataacaaaccaagagttgggtaaatsgtacctgagactgttctctttactttgggggcgtatttgaaaatttccatgataaaatatcttttaaaaaattaagtggccaggcgcggtggctcatgcctgtaatcccagcactttgcgaggctgaggcaggtggatcacgaggtcaggagatcgagaccatcctggctagcacggtaaaaccccgtctctactaaaaatacaaaaaaattagcctggtgtggtggcaggcgcctgtagtcccagctactcaggaggctgaggcaggagaatggcctgaacctgggaggcggggcttgc

SEQ ID NO: 73898 - DNA, 601 bp, Human
tagccatcttcacactcaacacagaatgtttccaaggagtcctaggcaggtggattgcttgagctcaggagttgagaatagtctgggcaacatggtgaaaccacatctctacaaaaacaaaataaaacaatgtttcagtagaattttcaaagaataagtgttcactcttaattgggaacattaaaacttaaaaaaaaaaaataggctgggcgcggtggctcacgcctgtaatccccgcactttgggaggccaaggcgggcggatcacgaggtcaggagatcgagaccatcctggctaacamggtaagaaaccccgtctctgctaaaaatacaaaatattagccgggcgtagtggcggacacctgtagtcccaactactcgggaggctgaggcaggagaatggcatgaacctgggaggcagagcttgcagtgagctgagattgcgccactgcactccagcctgggcgacagagcgagactctgcctcaaaaaataaataaataaattaaattaaattaaaaataaataatgtttgagtggaatagagacctttcatatcaatcactgttattttccaaactgatgtaacctcaaggtggcgc

SEQ ID NO: 73899 - DNA, 601 bp, Human
tttttttttttttgagacggtatttccttcttgccgcctaggctggagtgcagtggcacgatcccggctcacggcaacctccgcctctctggctgaagcaattctcctccctcagcctcctcctaagtagctgggattacaggcatctgccaccacacccggctaatttttgtatttttagtagagatggggtttcaccatgttggccaacatagtgtcaaactcctggcctcaagtgatccatctacctcggcctcccaaagtgctgggattacaggtgtgagccactacgcccagctayggttttttaaattattattttatttatttttttaaatccaatacagagtttcgttctgtcacttaggctggaatgcagtgacacagtcatggcttactgcagccttgaccttctgggctcaagtgatcttactgccttcggcttcccgagtggttgggactatcgacacacaccaccatgcctggctgattttgggggattttttgtttgtttgttcatttgtttttgatagagacagggttttgtccatgttgcccaggcttaatttttttattttttgtagagacagagtctcactgt

SEQ ID NO: 73900 - DNA, 601 bp, Human
tctcccttctgcctgtgagctgtctagtgacttgtgctgtccttctgtcatgctgtcttatcatttccccattcactccattactgggcaacaactgcagaagaaattgttgaggacatgcttctcgagcgccacacatccatctgcctttcccgccctgcactggtatcaatttgcctgcttcttccttttcctagtgtctcacaaaataaatttcttctgtagttgccattccttggagaccctcttgcttctttctctgtcaagaaggggaaagaggcaaagagagaagagggaacastaggcgatggagaatgacagtccattgttgcagcacagaatatggggccaccaaaggtagtggtggactaccgtcattttaactccatttgcttagcagtgcttctgttacttcattttgggggacatagtcgggtgaggtggctgtggtagagctggaagccagggtgttgggttctattcccagtttggctactactagtagtgtgaccttgggcaagtctacttaaagacatctctaagcctcagtttcctcatctgtaaaactagggtttgcattgaatgatgactttttcagctg

SEQ ID NO: 73901 - DNA, 601 bp, Human
tctcctggggagtcgcttagaagggttgccggggctctggacatccttgtctatactctgtggtactgggtacgcaatgtattggtgttgatggagtacactttatggcaggaggagaacaggattgaagagcatacctaaaactcaatttctacttcattcattacaggattgaagtaatttatttttggtagttaatagtataattactaactgataaagtttctagagtgtaagtataggtaatactttagcccataaataagtgaaagaactagcagtgcagctagtaaatctaacrtggttcttttttgacaactgacaccagaacccttaatcatttgtattttactgttggaaatgtttacagcagcactaggactctagcctgcatttaggaagacttgccattttgccaagtgttttaaacagttcgtgagggctctccttgggttttcggggttgtccaacctgcctgctgattctagactatatccacaaagttcacccagggcaggaatgaaaagtgtttggtaaaataaataggctgttctctagcaaagcagtgagctcctgactcccagggtctggtcagagttgc

SEQ ID NO: 73902 - DNA, 601 bp, Human
tacctaaaactcaatttctacttcattcattacaggattgaagtaatttatttttggtagttaatagtataattactaactgataaagtttctagagtgtaagtataggtaatactttagcccataaataagtgaaagaactagcagtgcagctagtaaatctaacgtggttcttttttgacaactgacaccagaacccttaatcatttgtattttactgttggaaatgtttacagcagcactaggactctagcctgcatttaggaagacttgccattttgccaagtgttttaaacagttygtgagggctctccttgggttttcggggttgtccaacctgcctgctgattctagactatatccacaaagttcacccagggcaggaatgaaaagtgtttggtaaaataaataggctgttctctagcaaagcagtgagctcctgactcccagggtctggtcagagttgctgagtgggttgatctctggtctttccttgacagtgcacgttcgaaggctgtgggaaacgcttttcactggacttcaatttgcgcacacatgtgcgaatccataccggagacaggccctatgtgtgccccttcga

SEQ ID NO: 73903 - DNA, 601 bp, Human
gcaagtctattttttttagatttatatcataattctccaattttgtatacatgtttaaatttccccaacacacatataaatggaaaacaaacttctgatagggagaaaatgagtgacagtgtcttagttttgaaaccacttgcaggcactagctatagaatcaggacaaatgtccagatcccttggtttatcataaattcaaatttgtttgaatataaatgactttgaagctagaaaacagaattttctctgaaatagaaaaaaaaatcagaacagctgacaaaatggccatttttcttayaggaaattattgttatgttgccaaagcttaaagaaaacatttgttttgctgggtaattgcatacaaatcaacaaagcatttctgtgcaatgagccattttcggagagtgactcccacatttctctgggttagaaaccctgcaagagtgagcatggcctttgatccagaaaaataaatcctgccacagtatgtgtgcctggaaatttttaggatcctgtcttccatttaagtctctcaaagccatttaggactaacttgcctgaatcaataatcctgtgtagacacaccctcagttataaa

SEQ ID NO: 73904 - DNA, 601 bp, Human
tataaggtgggaatgttgctattacccttttcagatgagaaaactgaagcacaaaaagtttttcttaattaacataccatttcaggcaagtctattttttttagatttatatcataattctccaattttgtatacatgtttaaatttccccaacacacatataaatggaaaacaaacttctgatagggagaaaatgagtgacagtgtcttagttttgaaaccacttgcaggcactagctatagaatcaggacaaatgtccagatcccttggtttatcataaattcaaatttgtttgaatakaaatgactttgaagctagaaaacagaattttctctgaaatagaaaaaaaaatcagaacagctgacaaaatggccatttttcttacaggaaattattgttatgttgccaaagcttaaagaaaacatttgttttgctgggtaattgcatacaaatcaacaaagcatttctgtgcaatgagccattttcggagagtgactcccacatttctctgggttagaaaccctgcaagagtgagcatggcctttgatccagaaaaataaatcctgccacagtatgtgtgcctggaaatttttaggatcc

SEQ ID NO: 73905 - DNA, 601 bp, Human
ttcccactataaaccttctcagagtgtattcttaagagcaaactattttcacctagttttataaatcagattttatatttaaaagcaagtcctactaaatcaagtacaaatcaaatttggaaaaataatttattctactttacatgttaagaaaagaaattagatggatcatgacctcattgcttttcccctaaaacacatgggttgcctaactagtttggttttattcgcagagtgaaagaaatcagtggctattctgactcatgtctagtgctaaataatctctgtatttataaagctrgtcctactagcttctagcaataatgccctttcaacttatttcaacaacaaagtttaaagcaaatttgttaaaaatagttctttcatgcttcctaatgaattttgcttaatgagtatatttctaagttcagagaaacagagaaacctaacttgctattaagcaattgcctctcacttttacctgataaacttgtgcttacagcattttgtcttaacatccacattaatatctaaccttgctaaactccaaagcaatcaaaaattaaagacctcttgtttataaataccacttgacttttct

SEQ ID NO: 73906 - DNA, 601 bp, Human
tgaatagcattcttaatatgaatcaaaactgattgactacagcatagtatggccatatctctagctattttttatattgaataccatttgtggatattctctcttcccactataaaccttctcagagtgtattcttaagagcaaactattttcacctagttttataaatcagattttatatttaaaagcaagtcctactaaatcaagtacaaatcaaatttggaaaaataatttattctactttacatgttaagaaaagaaattagatggatcatgacctcattgcttttcccctaaaacrcatgggttgcctaactagtttggttttattcgcagagtgaaagaaatcagtggctattctgactcatgtctagtgctaaataatctctgtatttataaagctggtcctactagcttctagcaataatgccctttcaacttatttcaacaacaaagtttaaagcaaatttgttaaaaatagttctttcatgcttcctaatgaattttgcttaatgagtatatttctaagttcagagaaacagagaaacctaacttgctattaagcaattgcctctcacttttacctgataaacttgtgctt

SEQ ID NO: 73907 - DNA, 601 bp, Human
cctagaaatttgaatagcattcttaatatgaatcaaaactgattgactacagcatagtatggccatatctctagctattttttatattgaataccatttgtggatattctctcttcccactataaaccttctcagagtgtattcttaagagcaaactattttcacctagttttataaatcagattttatatttaaaagcaagtcctactaaatcaagtacaaatcaaatttggaaaaataatttattctactttacatgttaagaaaagaaattagatggatcatgacctcattgcttttyccctaaaacacatgggttgcctaactagtttggttttattcgcagagtgaaagaaatcagtggctattctgactcatgtctagtgctaaataatctctgtatttataaagctggtcctactagcttctagcaataatgccctttcaacttatttcaacaacaaagtttaaagcaaatttgttaaaaatagttctttcatgcttcctaatgaattttgcttaatgagtatatttctaagttcagagaaacagagaaacctaacttgctattaagcaattgcctctcacttttacctgataa

SEQ ID NO: 73908 - DNA, 601 bp, Human
ctaatcacctctcgaaggccccacttcctactgccatcaccttagaaattaggatttcaacatgggaatttggatgggacacattcacaccacacaatacatctaagccaaaatttatcaattatttttgtgagacctaaatagaaatttatgtgaaaaggacctagaaatttgaatagcattcttaatatgaatcaaaactgattgactacagcatagtatggccatatctctagctattttttatattgaataccatttgtggatattctctcttcccactataaaccttctcagagtrtattcttaagagcaaactattttcacctagttttataaatcagattttatatttaaaagcaagtcctactaaatcaagtacaaatcaaatttggaaaaataatttattctactttacatgttaagaaaagaaattagatggatcatgacctcattgcttttcccctaaaacacatgggttgcctaactagtttggttttattcgcagagtgaaagaaatcagtggctattctgactcatgtctagtgctaaataatctctgtatttataaagctggtcctactagcttctagcaataatg

SEQ ID NO: 73909 - DNA, 601 bp, Human
ctctattataaagccactgaacccattcataaaggctttacctttgtgacctaatcacctctcgaaggccccacttcctactgccatcaccttagaaattaggatttcaacatgggaatttggatgggacacattcacaccacacaatacatctaagccaaaatttatcaattatttttgtgagacctaaatagaaatttatgtgaaaaggacctagaaatttgaatagcattcttaatatgaatcaaaactgattgactacagcatagtatggccatatctctagctattttttatattraataccatttgtggatattctctcttcccactataaaccttctcagagtgtattcttaagagcaaactattttcacctagttttataaatcagattttatatttaaaagcaagtcctactaaatcaagtacaaatcaaatttggaaaaataatttattctactttacatgttaagaaaagaaattagatggatcatgacctcattgcttttcccctaaaacacatgggttgcctaactagtttggttttattcgcagagtgaaagaaatcagtggctattctgactcatgtctagtgcta

SEQ ID NO: 73910 - DNA, 601 bp, Human
gcaggtcacaggtagattttaaaatgttctgattggcaattggttggaagagttattatcaataataaaaaattatttcctgtttacaatcagggcttgtggagaccaaggttttatcatgcagataaagcctctagatacgcaggcttcatagagaatggatataaatgtttcttatcagacttaaggtctgtgttgatgttaatgatggttggttattcctgaattccaaaagagaggagggtataaagaggcatgtccaacacctccttcccataacagcctaaacttgttttttagrctaactttggaaggctcttgaccaagaggaggtccattcagtgctgggagcagggggtgggagggttgaattttatttgtggcttagaggctgtatatactgattcataaactaccatctttctcactgtgtcttcacatggcagaaaatgcagtgaatctctcttagtcctctattataaagccactgaacccattcataaaggctttacctttgtgacctaatcacctctcgaaggccccacttcctactgccatcaccttagaaattaggatttcaacatgggaatttggatgggac

SEQ ID NO: 73911 - DNA, 601 bp, Human
acctctgaattagacaaaaataatttacctttgaataagaacactttagaccttaagaagaatctgcccatgactcttgaaactccacagagaaagaaagggtgagtgatgcctttgttctgagtgttttaaggggttcaagtcatttgatggcttctctagattttttttggtaccagacagtgaagggggaaggagaaatagtgtggaagaaaagaaaatgaaagaacaattgtgtttttaagacaggaagctgcaacagaaaccaagcgcataatttgtttgttttctttttttcagytatgaggaattttagcagcttcagaggtctggctgctcataatttggaattctcatttgaatttggccaagttgggtacagttggtcaaatctgatgggagaaacaccagaacaacaaaaaaccccaacaatatgattactgagcactctaatgctaaggagaaattaagactagccggctgtcaattctaatttttagtcattaaggagaatcgctgagataaaaaaaaaaacccaactcagctacttatctaggaatgagaccctggctcaagactgctgtttaccatcttacaggca

SEQ ID NO: 73912 - DNA, 601 bp, Human
ttcatcatgcaagattctttctcatataaaattacttttcttttaagctttcttaccaaaaatacctctttataactttctttacatctcttatttcctggtcctttttacctcattttatatataatccttaaataacctctgaattagacaaaaataatttacctttgaataagaacactttagaccttaagaagaatctgcccatgactcttgaaactccacagagaaagaaagggtgagtgatgcctttgttctgagtgttttaaggggttcaagtcatttgatggcttctctagattttttttggtaccagacagtgaagggggaaggagaaatagtgtggaagaaaagaaaatgaaagaacaattgtgtttttaagacaggaagctgcaacagaaaccaagcgcataatttgtttgttttctttttttcagttatgaggaattttagcagcttcagaggtctggctgctcataatttggaattctcatttgaatttggccaagttgggtacagttggtcaaatctgatgggagaaacaccagaacaacaaaaaaccccaacaatatgattactgagcactctaatgctaaggaga

SEQ ID NO: 73913 - DNA, 601 bp, Human
tgtttcttagtttcaactattaacttaaaaaggccagacaccatggctcatgcctgtaatcctagcactttgggagactaaggcagacagatcattttagtctaggtgttcgagaccagcctgggcaacatgtgacactccatctctataaataatacaaaataaataaataaataaataaaaaagcttggctttgtggtgcacacttgtagttccagctactcagaaggctgaggggaggatttcttgagcctgggaggttgagggtgcagtgaactgagattgtgccactgcactccarcctgggtgacagagtgaggccctgcctcaaaaaaaataaaataaaagtaaaaagttacaggagccaaacaaagttgaaggagagagttaccattccaggccttctcaaaagagaaaaaaactgaagcagtagggcacaggttctgagatatcaatctaaataattttaaaaagaaaaagattatagaattcaaaaattttaaagtccttgcattaagagtaactcaacatttttaataaatcttgttctaaccagttctttagtgttgcatgagtgtacttttaatatcaaagttcaatt

SEQ ID NO: 73914 - DNA, 601 bp, Human
ggcatctttggtagcttccttcagtctgaaaagcacttatttttcttttagccaagtgattagaggtctttaatataatttggtagtgaaatattacttctacatgacacatataaacatatagctataacagacatacagacaaaagcagatccaaaatatttttcatttgcctattttcaaaaattctgtttcttagtttcaactattaacttaaaaaggccagacaccatggctcatgcctgtaatcctagcactttgggagactaaggcagacagatcattttagtctaggtgttcragaccagcctgggcaacatgtgacactccatctctataaataatacaaaataaataaataaataaataaaaaagcttggctttgtggtgcacacttgtagttccagctactcagaaggctgaggggaggatttcttgagcctgggaggttgagggtgcagtgaactgagattgtgccactgcactccagcctgggtgacagagtgaggccctgcctcaaaaaaaataaaataaaagtaaaaagttacaggagccaaacaaagttgaaggagagagttaccattccaggccttctcaaaag

SEQ ID NO: 73915 - DNA, 601 bp, Human
ttatctttacttaaaataactcttagaaaaaaaaattctttagcaaaagctacatcattgtatttttataaattttaccaaaaacactatttactctcctactattttaactcttagtaacccagattcccattgaaaaaaataggagttatttaatttaacataacatgactttaagatgttaaactactggaggtaattttgagattaaatttaccagattagtcttacccaaaactactaaggtcatatgaattaaaaggcatctttggtagcttccttcagtctgaaaagcacttayttttcttttagccaagtgattagaggtctttaatataatttggtagtgaaatattacttctacatgacacatataaacatatagctataacagacatacagacaaaagcagatccaaaatatttttcatttgcctattttcaaaaattctgtttcttagtttcaactattaacttaaaaaggccagacaccatggctcatgcctgtaatcctagcactttgggagactaaggcagacagatcattttagtctaggtgttcgagaccagcctgggcaacatgtgacactccatctctataa

SEQ ID NO: 73916 - DNA, 601 bp, Human
atttagcaattacagataacaataaccaagggattgaatatttttgctttttttttttttattagtttgcatctccttatgcatttagagagctaactcctcgggagcataatccatctctaaattctaatgaattttatcttttgtaattgaatgtagctcagctgcatctccctaccataggtaaccacatggccaccctggagtcaaggtttctcctcactcatcttttaatttctctctttatccatttagttttatctatataatatttttatctttacttaaaataactcttagaaaaaaaaattctttagcaaaagctacatcattgtatttttataaattttaccaaaaacactatttactctcctactattttaactcttagtaacccagattcccattgaaaaaaataggagttatttaatttaacataacatgactttaagatgttaaactactggaggtaattttgagattaaatttaccagattagtcttacccaaaactactaaggtcatatgaattaaaaggcatctttggtagcttccttcagtctgaaaagcacttatttttcttttagccaagtgattagagg

SEQ ID NO: 73917 - DNA, 601 bp, Human
agcattcttgtacattcatttagcaattacagataacaataaccaagggattgaatatttttgctttttttttttttattagtttgcatctccttatgcatttagagagctaactcctcgggagcataatccatctctaaattctaatgaattttatcttttgtaattgaatgtagctcagctgcatctccctaccataggtaaccacatggccaccctggagtcaaggtttctcctcactcatcttttaatttctctctttatccatttagttttatctatataatatttttatctttayttaaaataactcttagaaaaaaaaattctttagcaaaagctacatcattgtatttttataaattttaccaaaaacactatttactctcctactattttaactcttagtaacccagattcccattgaaaaaaataggagttatttaatttaacataacatgactttaagatgttaaactactggaggtaattttgagattaaatttaccagattagtcttacccaaaactactaaggtcatatgaattaaaaggcatctttggtagcttccttcagtctgaaaagcacttatttttctttt

SEQ ID NO: 73918 - DNA, 601 bp, Human
ataccctctggttttaatagttacttggttttgcccttcccacatattgactatcttcttggtaaccacagctctcagaggtaacttttgttgctctggtttaatttttctttctgtgggtagcttggagtctagtggcttgagctgggacagacccacctctgggcctgatccagccttaaggatcaacccagcattcttgtacattcatttagcaattacagataacaataaccaagggattgaatatttttgctttttttttttttattagtttgcatctccttatgcatttagagarctaactcctcgggagcataatccatctctaaattctaatgaattttatcttttgtaattgaatgtagctcagctgcatctccctaccataggtaaccacatggccaccctggagtcaaggtttctcctcactcatcttttaatttctctctttatccatttagttttatctatataatatttttatctttacttaaaataactcttagaaaaaaaaattctttagcaaaagctacatcattgtatttttataaattttaccaaaaacactatttactctcctactattttaactcttagt

SEQ ID NO: 73919 - DNA, 601 bp, Human
agctgattatattgatctacaaaatggaacaattactttgcattataccctctggttttaatagttacttggttttgcccttcccacatattgactatcttcttggtaaccacagctctcagaggtaacttttgttgctctggtttaatttttctttctgtgggtagcttggagtctagtggcttgagctgggacagacccacctctgggcctgatccagccttaaggatcaacccagcattcttgtacattcatttagcaattacagataacaataaccaagggattgaatatttttgctttttttttttttattagtttgcatctccttatgcatttagagagctaactcctcgggagcataatccatctctaaattctaatgaattttatcttttgtaattgaatgtagctcagctgcatctccctaccataggtaaccacatggccaccctggagtcaaggtttctcctcactcatcttttaatttctctctttatccatttagttttatctatataatatttttatctttacttaaaataactcttagaaaaaaaaattctttagcaaaagctacatcattgtatttttataaatt

SEQ ID NO: 73920 - DNA, 601 bp, Human
aaggattctttccttaaagtagttaaggtttctcaagaagctgattatattgatctacaaaatggaacaattactttgcattataccctctggttttaatagttacttggttttgcccttcccacatattgactatcttcttggtaaccacagctctcagaggtaacttttgttgctctggtttaatttttctttctgtgggtagcttggagtctagtggcttgagctgggacagacccacctctgggcctgatccagccttaaggatcaacccagcattcttgtacattcatttagcaaytacagataacaataaccaagggattgaatatttttgctttttttttttttattagtttgcatctccttatgcatttagagagctaactcctcgggagcataatccatctctaaattctaatgaattttatcttttgtaattgaatgtagctcagctgcatctccctaccataggtaaccacatggccaccctggagtcaaggtttctcctcactcatcttttaatttctctctttatccatttagttttatctatataatatttttatctttacttaaaataactcttagaaaaaaaaat

SEQ ID NO: 73921 - DNA, 601 bp, Human
actgtgagtccattaaacccctttttctttataaattacccagtctcagggatatcttcctttgaaatagatacaaaacagtttgaaaggtggaggaatctatgggaaagagaagagaaatggggaaaggactcagtcttttttttaaataccaaatgactctggcctgaaccagaaatgcagttacaaatgagaataacttaaattatctgataattatagtatttacaacagaaggggagggagtcacctagtgcccctcttccaggctggacagacatcaatcctactgctaggctgratagatgcctattcaccttactacttgtaggggtctcaggcctctaggcagttatggattctcctggcgtgagcaggtagaggtggtgggattgcctgttttatgcagtgtcctaaccttggcccaccaccctgccctacaataccatgaggtctctggagctctttctgacttggaggccttccctctttctgtgctgaactaccattggcctttggagtattctgtacagtccaactgcacttagggcaggagggatttcccccacccagtttcccctgaactagtcccaagaccaaa

SEQ ID NO: 73922 - DNA, 601 bp, Human
caccatcccatgaaagcagccaggagaggggcactgtaccctgcaaagtcccaggggtggatcttcccaagtccatgggaacccacctcttgcatcagtgtgacctggatgtgagacacgcagtcaaaggagatcattttggagctttaaggtttgactgctcactggatttcaaacttgcatggggcctccatcttcttcattttggttaatttttcacatttggaatgggtttatttactcaatgcctgtatccccattgtatctaggaagtaactaacttgcttttgattttttttgmtggctcctaagttaggacttttgggttaatactgaaatgagttaagactttgggggactgttgcgaaggcatgattggttttgaaatgtgcggacatgagatttggcagcagccatgggcagaattatatggttgggctgtgtccccaccaaaatctcatctttaattgtagctcccataatccccatgtgtcatgggagggaacttgtgggaggtaattgaaacatgggggtgagtttttctgtgtttttctcatgatagtgaataagtctcacaagctctaatggttttataaaaggc

SEQ ID NO: 73923 - DNA, 601 bp, Human
caggcccagaggcctaggaggaaaaaaaatggttttcttgtccagtctttggacttggtgctctgggtcccagccatgggacccagaaggagccaatgtacactcaggccactgcttcagagggtgcaagtctcaagctttggttgggcctgcaggtgcataaaagtaaagaattgaggtttgggaacctctgcctagatttcagaggatgtatggaaacacctggatgtccaggcagaggtatgctgcagaggcaggaccctcatggagaacctctgctagggcagtgtggaagggaaaygtagggttgaagcccccacacagagtctccactggggaactgcctggtggagctgtgagaagagggccaccatcctccagatcccagaatggtagatccatcaacaacttgaaccatgcacttggaaaagccacagaacactcaacaccatcccatgaaagcagccaggagaggggcactgtaccctgcaaagtcccaggggtggatcttcccaagtccatgggaacccacctcttgcatcagtgtgacctggatgtgagacacgcagtcaaaggagatcattttggagctttaaggttt

SEQ ID NO: 73924 - DNA, 601 bp, Human
ttgaatggctttgaccaaaatgctgataatgatatggacaataaagtccagactgaggtgttctcagatggagatgaggaacttattgggaactggagcaaaggtgattcttgctatgctttagtaaaaagactggcagcattttgcccctgcactagagatcagtggaactttgaacttaagagacataatttaaggtatctggtggaagaaatttcaaactaaagctttcaagaagtgacttgggtgctcttaagagcattcagttttattaattcacaaagatatggtttgaaattgraacttatgtttaaaagggaagcaaagcatgaaagttaggaaaatttggagactgatgatgtgataaaaaaggaaaaacccattttctgaggagaaattcaagatggctgcagaaacttgcgtaagtaatgagaagccaaatgttaatcacccagacaatggggaaaatgtctcccggacatgtcagaagtctccacagtagcccctcccatcacaggcccagaggcctaggaggaaaaaaaatggttttcttgtccagtctttggacttggtgctctgggtcccagccatgggacccaga

SEQ ID NO: 73925 - DNA, 601 bp, Human
acaggcttgaagggctcggaagacaggaagatgtgggaaagtttgaaacttcctagagacttgttgaatggctttgaccaaaatgctgataatgatatggacaataaagtccagactgaggtgttctcagatggagatgaggaacttattgggaactggagcaaaggtgattcttgctatgctttagtaaaaagactggcagcattttgcccctgcactagagatcagtggaactttgaacttaagagacataatttaaggtatctggtggaagaaatttcaaactaaagctttcaagaastgacttgggtgctcttaagagcattcagttttattaattcacaaagatatggtttgaaattggaacttatgtttaaaagggaagcaaagcatgaaagttaggaaaatttggagactgatgatgtgataaaaaaggaaaaacccattttctgaggagaaattcaagatggctgcagaaacttgcgtaagtaatgagaagccaaatgttaatcacccagacaatggggaaaatgtctcccggacatgtcagaagtctccacagtagcccctcccatcacaggcccagaggcctaggaggaaa

SEQ ID NO: 73926 - DNA, 601 bp, Human
agtgttgtaaagacctttgtttcaaccccatcaattttcattttatttatttcatttcttataaaacgtccaaatattttaatcaccctctggggtgagtcctctgactcccttttgcctttctcattattctttgttaattaccccagtgttttattaagcatctgtaagacccatgaggacagcaaatttgatcagtctgtgattctgtggtagtaatgtcacctggagtgcccatgtagcacttaacctccaaatttaccatgtgatatggtttggctgtgtccccaccaaaatctcwtcttgaatagtagctcccataatccccacatgctgtgagagggacccactgggaagtaattggatcataggggtgggttttcccatgctgttctgtgatagtgaataagtctcacaagatctgatggttttataaagggcagttccctggcacatgctctcttgccaccatgtaagacatgcctttgctcctcctgcatcttccatcatgactgtgaggcttccccagccatgtggaactgtgagttcattaaacctctttttctttataaattacccagtctcaggtattttttcacag

SEQ ID NO: 73927 - DNA, 601 bp, Human
ctcattataacctttgccttttgctgtttcttcaatttccccaatctggggcaaatgcagaaaactgatatggggccctttaatgttggaggatcagtaggggttccctttggtccactcaacccttgatagtgttgtaaagacctttgtttcaaccccatcaattttcattttatttatttcatttcttataaaacgtccaaatattttaatcaccctctggggtgagtcctctgactcccttttgcctttctcattattctttgttaattaccccagtgttttattaagcatctgtaaracccatgaggacagcaaatttgatcagtctgtgattctgtggtagtaatgtcacctggagtgcccatgtagcacttaacctccaaatttaccatgtgatatggtttggctgtgtccccaccaaaatctcatcttgaatagtagctcccataatccccacatgctgtgagagggacccactgggaagtaattggatcataggggtgggttttcccatgctgttctgtgatagtgaataagtctcacaagatctgatggttttataaagggcagttccctggcacatgctctcttgccacca

SEQ ID NO: 73928 - DNA, 601 bp, Human
tgccccaggcaatttcagctccctcattataacctttgccttttgctgtttcttcaatttccccaatctggggcaaatgcagaaaactgatatggggccctttaatgttggaggatcagtaggggttccctttggtccactcaacccttgatagtgttgtaaagacctttgtttcaaccccatcaattttcattttatttatttcatttcttataaaacgtccaaatattttaatcaccctctggggtgagtcctctgactcccttttgcctttctcattattctttgttaattaccccartgttttattaagcatctgtaagacccatgaggacagcaaatttgatcagtctgtgattctgtggtagtaatgtcacctggagtgcccatgtagcacttaacctccaaatttaccatgtgatatggtttggctgtgtccccaccaaaatctcatcttgaatagtagctcccataatccccacatgctgtgagagggacccactgggaagtaattggatcataggggtgggttttcccatgctgttctgtgatagtgaataagtctcacaagatctgatggttttataaagggcagttccct

SEQ ID NO: 73929 - DNA, 601 bp, Human
ctagtctagtatttgtcattgggaagtgctcccagtcttttaccataagccctaataaatgctccacaaatggatatgaagtggagaatttgtccctactagcccttcagcttctaccctacattgtgtaggctcaggcaatcttactagtttccatttagtgtgtccaattaacattcctcaaagggcacatttacatgacttcagtttcatagtacttgataggagaaacatcccccaatcagatacaataccaattttcacaagatatttaggtgaagaagttaaaattaccttacataaaggctgtttagacatctcaaatttcataatcctatcaacctgtacatttttatgttctggtttgaggaacttttcttttctacccccagaccattttactttttctggtgaaaaatgatttgagttcccagcaagggattgagccaagggacttgggctcttttttcaatcttcatcttaatttgcctcagatttgccccaggcaatttcagctccctcattataacctttgccttttgctgtttcttcaatttccccaatctggggcaaatgcagaaaactgatatggggcccttta

SEQ ID NO: 73930 - DNA, 601 bp, Human
agatcctatgcaaacaatttttactttattatggaactctttggggtaccattatttcctttagcaaaggggtagcttcagttaacattccataacaaggcagtaaatgtccctcaactggaaattctctagtctagtatttgtcattgggaagtgctcccagtcttttaccataagccctaataaatgctccacaaatggatatgaagtggagaatttgtccctactagcccttcagcttctaccctacattgtgtaggctcaggcaatcttactagtttccatttagtgtgtccaattmacattcctcaaagggcacatttacatgacttcagtttcatagtacttgataggagaaacatcccccaatcagatacaataccaattttcacaagatatttaggtgaagaagttaaaattaccttacataaaggctgtttagacatctcaaatttcataatcctatcaacctgtacatttttatgttctggtttgaggaacttttcttttctacccccagaccattttactttttctggtgaaaaatgatttgagttcccagcaagggattgagccaagggacttgggctcttttttcaat

SEQ ID NO: 73931 - DNA, 601 bp, Human
aattgccattcacatgctaagcagttcttgttatatgagagctgtttaccaggcactgtagaatctagcagctccttacagagtcagagtcagccctaggggaaaaagaatgctctctgctcataagtatctcctctgcatcctcaggtagcaagatcctatgcaaacaatttttactttattatggaactctttggggtaccattatttcctttagcaaaggggtagcttcagttaacattccataacaaggcagtaaatgtccctcaactggaaattctctagtctagtatttgtcatygggaagtgctcccagtcttttaccataagccctaataaatgctccacaaatggatatgaagtggagaatttgtccctactagcccttcagcttctaccctacattgtgtaggctcaggcaatcttactagtttccatttagtgtgtccaattaacattcctcaaagggcacatttacatgacttcagtttcatagtacttgataggagaaacatcccccaatcagatacaataccaattttcacaagatatttaggtgaagaagttaaaattaccttacataaaggctgtttagacatct

SEQ ID NO: 73932 - DNA, 601 bp, Human
ttcaaaaacaaaagtcagggctgaaatccagtaacaagtgttaaatttttcctttgaaacaatttttctctctctctagccctccttttctattaaagagaaattatagtaagaccagtttgtgtgtaaaaataagttttaggcttattatacttggcctgattatttgcataaagtgcagcaagaaattgactgaccatataggctctttttaagttggctttgctggaaatttacctgcaaatatgttattctagtcaaagacttggtaaaataatcagtgtctccaattgtcctgttwtaaaacaaaagactcttactaaacttatgcaaataactatattgtcataaaaccagaatactcacggtttccaaatttgggagaacttggagagaaaggtaaatttgctcataaaaacatacttcacccaattgctctaaagaataaataatttaaaagaaaaagattctcttgactctttaaccagagcatcagccttccaaacaacatgtcctttgttcaccttgaattgccattcacatgctaagcagttcttgttatatgagagctgtttaccaggcactgtagaatctagcagct

SEQ ID NO: 73933 - DNA, 601 bp, Human
tccagcctgggtgacagagtaagaccctgagtgagtctcaaaaaaagaaataaataaatgaaaataaactttaaaaatacatatctatctatctgcacagctcataactgggagtcttatatccagaaggctttgtcacaaggtatctttatcctctcagtagttattttcttttaattctacaaatagcatgacattcttcatggttgggctggatgaaaagatgcctcataatagctcagagggcaaaaaactttgttttaccagctgtttaggcatcgtgtacccatccttggtttgratgatctgaactaattcacttcctcaaacctagcccttacaatctcacacacccacctcttccacaacagtccttaggcctagagggagggtgcttgtatagtcttaacagaagggcatttgcagtgaaaaacagatcgggctcagtgggatgacaaatgagagagatttgcatctctagtcttgagaataccatcattccagtttccttggaagtaaaccaaggagagataaataacattaatattttgacaatcaaaagagtatttgtgtgtcagaatggaaaatggaagctatctca

SEQ ID NO: 73934 - DNA, 601 bp, Human
ctcatccatgcttttaactaccacacgtatgatgaaacctctcatatgtatgaacagtttagctcagacaattgaaatcctgtttactctcctctagccttgtctacctccaacctctctttcacacgccacctccactaatttggatcataattttttgtcaaataaattaataaaatacatagttagcaaattttacttcttaaaacttttcagtaattcccataaacaaaaatctctgatttttaagatggtaaacaaagcctcatctgtatttcagtatcatctcctgttgcttgtycttagacacagtgttctacatgtagctgtgttaattaaccctgccattttataggtcagtgcttttgtataatattcctccagttttaatgcctttcttccctttgttcacctggtcaatatataattcattctcaagactcaggtattttattacttccattgtgaggcctcttttgcctctgtgctccccaggtaagccctaaccattcattcattctttatcttcccaccctactgtgtgcctaacttgattacaacctctattacagtgtactttatttatggatttagatgtcta

SEQ ID NO: 73935 - DNA, 601 bp, Human
ctatgcatgctgtctttaggaagttcatgctcatccatgcttttaactaccacacgtatgatgaaacctctcatatgtatgaacagtttagctcagacaattgaaatcctgtttactctcctctagccttgtctacctccaacctctctttcacacgccacctccactaatttggatcataattttttgtcaaataaattaataaaatacatagttagcaaattttacttcttaaaacttttcagtaattcccataaacaaaaatctctgatttttaagatggtaaacaaagcctcatctrtatttcagtatcatctcctgttgcttgtccttagacacagtgttctacatgtagctgtgttaattaaccctgccattttataggtcagtgcttttgtataatattcctccagttttaatgcctttcttccctttgttcacctggtcaatatataattcattctcaagactcaggtattttattacttccattgtgaggcctcttttgcctctgtgctccccaggtaagccctaaccattcattcattctttatcttcccaccctactgtgtgcctaacttgattacaacctctattacag

SEQ ID NO: 73936 - DNA, 601 bp, Human
ctgattcccaaatatcccaaatccacaagctatgtctgaattaccatcttacttcgtgactctcagtcatttgatactattgatctctcttttcttcctgaaattccctcccccatgcatacctatatctctgactaactgctcgattctttctctcttctttggtcaaccctttcaggcctctgtcttgtactccctacccttttgctatgcatgctgtctttaggaagttcatgctcatccatgcttttaactaccacacgtatgatgaaacctctcatatgtatgaacagtttagctyagacaattgaaatcctgtttactctcctctagccttgtctacctccaacctctctttcacacgccacctccactaatttggatcataattttttgtcaaataaattaataaaatacatagttagcaaattttacttcttaaaacttttcagtaattcccataaacaaaaatctctgatttttaagatggtaaacaaagcctcatctgtatttcagtatcatctcctgttgcttgtccttagacacagtgttctacatgtagctgtgttaattaaccctgccattttataggtcagtgctt

SEQ ID NO: 73937 - DNA, 601 bp, Human
ttcaagcaattttcccacctcaggctcccaagtagctggggctacaagtgtgtaccaccatgaccggttagcttttgtatttttagtacagacggggtttcaccatgttggccaggctggtctcgaactcctgacctcaggtgatccgcccaccttggcctcccaaagtactggaattaaaagcatgagccaccatgcccaggcttttctctctattttcaacctcacaccctttattgcttgtttccccactagcttattaatatatccaaggcatttcttgccttttgagaaaaaaacraaatgaaacaaaacaaaacaccttccctcagccttgatggttagctactctagctaccacaaagctgtttagaagaatggtctagactctagactgtttaaccttccatccaccctatagtctgctacaggctggtgtttcttgaaactacctccataaaaggtcataaacaacttcctgattcccaaatatcccaaatccacaagctatgtctgaattaccatcttacttcgtgactctcagtcatttgatactattgatctctcttttcttcctgaaattccctcccccatgcatacc

SEQ ID NO: 73938 - DNA, 601 bp, Human
gttcttgcttgcaattcttggtcagaaacattctgcattctcagcaatgagggaaatatccagaacaatctgagttatgtcctcattcttcccatagtaggatgctctgcaacccttgagctcagcaatcccagttgtgtctaaggcatataagcccaggacagagtattttcagggtttctcagctgcagtgtaaatggaggaccacacaaaaatgagactccatttattttgggaagctttcctgaaccttggagaatcagctcacctggaccattggcttctgtttatccttactgcytgcctaatatatatactataaatttccataggttttatcaatcatacttcctattattggtatagttccaggaaacagtgaggttgatgcaatccataacaacatcagggatgagttcacagatagaaccactgtgatcaccaggagctactatggttttactgaaaatatgaaaagttaaaattcatattttaaaattaaatttaaaaagatagcttttagtaagaggttttaaaacaggagcactgtatactggtaatagtatagttaggtagattaattactgcttcaaaatgaaca

SEQ ID NO: 73939 - DNA, 601 bp, Human; identical to SEQ ID NO: 31793

SEQ ID NO: 73940 - DNA, 601 bp, Human; identical to SEQ ID NO: 31794

SEQ ID NO: 73941 - DNA, 601 bp, Human; identical to SEQ ID NO: 31795

SEQ ID NO: 73942 - DNA, 601 bp, Human; identical to SEQ ID NO: 31796

SEQ ID NO: 73943 - DNA, 601 bp, Human; identical to SEQ ID NO: 31797

SEQ ID NO: 73944 - DNA, 601 bp, Human; identical to SEQ ID NO: 31798

SEQ ID NO: 73945 - DNA, 601 bp, Human; identical to SEQ ID NO: 31799

SEQ ID NO: 73946 - DNA, 601 bp, Human; identical to SEQ ID NO: 31800

SEQ ID NO: 73947 - DNA, 601 bp, Human; identical to SEQ ID NO: 31801

SEQ ID NO: 73948 - DNA, 601 bp, Human; identical to SEQ ID NO: 31802

SEQ ID NO: 73949 - DNA, 601 bp, Human; identical to SEQ ID NO: 31803

SEQ ID NO: 73950 - DNA, 601 bp, Human; identical to SEQ ID NO: 31804

SEQ ID NO: 73951 - DNA, 601 bp, Human; identical to SEQ ID NO: 31805

SEQ ID NO: 73952 - DNA, 601 bp, Human; identical to SEQ ID NO: 31806

SEQ ID NO: 73953 - DNA, 601 bp, Human; identical to SEQ ID NO: 31807

SEQ ID NO: 73954 - DNA, 601 bp, Human; identical to SEQ ID NO: 31808

SEQ ID NO: 73955 - DNA, 601 bp, Human; identical to SEQ ID NO: 31809

SEQ ID NO: 73956 - DNA, 601 bp, Human; identical to SEQ ID NO: 31810

SEQ ID NO: 73957 - DNA, 601 bp, Human; identical to SEQ ID NO: 31811

SEQ ID NO: 73958 - DNA, 601 bp, Human; identical to SEQ ID NO: 31812

SEQ ID NO: 73959 - DNA, 601 bp, Human; identical to SEQ ID NO: 31813

SEQ ID NO: 73960 - DNA, 601 bp, Human; identical to SEQ ID NO: 31814

SEQ ID NO: 73961 - DNA, 601 bp, Human; identical to SEQ ID NO: 31815

SEQ ID NO: 73962 - DNA, 601 bp, Human; identical to SEQ ID NO: 31816

SEQ ID NO: 73963 - DNA, 601 bp, Human; identical to SEQ ID NO: 31817

SEQ ID NO: 73964 - DNA, 601 bp, Human; identical to SEQ ID NO: 31818

SEQ ID NO: 73965 - DNA, 601 bp, Human; identical to SEQ ID NO: 31819

SEQ ID NO: 73966 - DNA, 601 bp, Human; identical to SEQ ID NO: 31820

SEQ ID NO: 73967 - DNA, 601 bp, Human; identical to SEQ ID NO: 31821

SEQ ID NO: 73968 - DNA, 601 bp, Human; identical to SEQ ID NO: 31822

SEQ ID NO: 73969 - DNA, 601 bp, Human; identical to SEQ ID NO: 31823

SEQ ID NO: 73970 - DNA, 601 bp, Human; identical to SEQ ID NO: 31824

SEQ ID NO: 73971 - DNA, 601 bp, Human; identical to SEQ ID NO: 31825

SEQ ID NO: 73972 - DNA, 601 bp, Human; identical to SEQ ID NO: 31826

SEQ ID NO: 73973 - DNA, 601 bp, Human; identical to SEQ ID NO: 31827

SEQ ID NO: 73974 - DNA, 601 bp, Human; identical to SEQ ID NO: 31828

SEQ ID NO: 73975 - DNA, 601 bp, Human; identical to SEQ ID NO: 31829

SEQ ID NO: 73976 - DNA, 601 bp, Human; identical to SEQ ID NO: 31830

SEQ ID NO: 73977 - DNA, 601 bp, Human; identical to SEQ ID NO: 31831

SEQ ID NO: 73978 - DNA, 601 bp, Human; identical to SEQ ID NO: 31832

SEQ ID NO: 73979 - DNA, 601 bp, Human; identical to SEQ ID NO: 31833

SEQ ID NO: 73980 - DNA, 601 bp, Human
agtctttcagcattgatgtctcacagtagccttgtaagagagccaagtatttattattatgcccattattattaaagaaaaatggagctcagaaagatcaagtgaccttagcgagatgggggcttctgacagctttgcactgctgtcctataggttgaaccctaggaaatggctgctaggcacccactctttacctatcaaaatggccattttatacggcctaccctaagatataaatgtgtctcttttgtcacaaaatgagaggtccactcatttaactctaagaaataaggaagaaaartagcgaggaataggagtgaaatgccagcagatgaacatgtgcattgctaactttaaaattttgtgaaatccaacaatgcttaatacaaaacccttaataaatggtacattagagcactgagttcttagatactgagtcctgagtgactttcttagaacaagctaccttaataaatgaccccaaaaaaatataaataaagaaaataattttgtacctcaagagaaccatatatccaggtatggcagccaaagaataaatgaaactgctcatcgctgacaagattaggaagtactggagcat

SEQ ID NO: 73981 - DNA, 601 bp, Human
acaagacttaacaccacaccaccattgttgtgaatataaaaacagatgcacacaaaaaattctaatattttacaaaggaaatacatatttaagacatctatctgtcatacttaagtgagcagctatggtgactggaagtagggaattgaatagaaataaataaataaatgaagtaaaataagagagaatccttgcactggcctatgatgataatgtgttatgacttgagcattgtgattaactgaactctactttagagctccaaaagaagaagaaaaagagagaaaaaatgcaaattatsttcaggattgtttactaggcacaaagactggtgtagttgaaagaagatttatttaatatacctaaatttgaaaactggctctgcaatttcctagttttagaaagtctttcagcattgatgtctcacagtagccttgtaagagagccaagtatttattattatgcccattattattaaagaaaaatggagctcagaaagatcaagtgaccttagcgagatgggggcttctgacagctttgcactgctgtcctataggttgaaccctaggaaatggctgctaggcacccactctttacctat

SEQ ID NO: 73982 - DNA, 601 bp, Human
aataggactggtgaatttatctatgcatctaccttatgaatcggaacaagacttaacaccacaccaccattgttgtgaatataaaaacagatgcacacaaaaaattctaatattttacaaaggaaatacatatttaagacatctatctgtcatacttaagtgagcagctatggtgactggaagtagggaattgaatagaaataaataaataaatgaagtaaaataagagagaatccttgcactggcctatgatgataatgtgttatgacttgagcattgtgattaactgaactctactttmgagctccaaaagaagaagaaaaagagagaaaaaatgcaaattatgttcaggattgtttactaggcacaaagactggtgtagttgaaagaagatttatttaatatacctaaatttgaaaactggctctgcaatttcctagttttagaaagtctttcagcattgatgtctcacagtagccttgtaagagagccaagtatttattattatgcccattattattaaagaaaaatggagctcagaaagatcaagtgaccttagcgagatgggggcttctgacagctttgcactgctgtcctatag

SEQ ID NO: 73983 - DNA, 601 bp, Human
atatatgtatatatgtgcatatataatttatatatttatatatagtacttaagaagcaatctaatggcacatcacctttatgaaaaatttttaagaactttaaggatacaaaggaatatttaagcaaatgacaggatattacatgttcaaaaatatttgatgtcagattttctccaagtaatctatggaatctacacaaactcagtcaaaattcttatgaagatataaagatccacagacagcaaaataagtttgagaaagaaagaataaaggaaaagtgaagatggcaggtgggtgaggmaaagttaccatatgagatattaacatttgcaaggccaaagtaattaaatcaaggtgacgctggtatgggaacaggcaaataaatctgtggagcagaataaggatgaaaaatagactcactaattataaaaacttgagatggtggcaccacaaatcaaaggaaaaaggacgtattatatacactatgattttggaaaacaactttattattcggagaaaaataacactggatatctatgtcccttaaaccacatataaaaatagatttgagatggcttaaaaaactatgcaaaaggtaaag

SEQ ID NO: 73984 - DNA, 601 bp, Human
tgtggctgtatgtacatatgtgtgtgtgcatatagagacatatatatgtatatatgtgcatatataatttatatatttatatatagtacttaagaagcaatctaatggcacatcacctttatgaaaaatttttaagaactttaaggatacaaaggaatatttaagcaaatgacaggatattacatgttcaaaaatatttgatgtcagattttctccaagtaatctatggaatctacacaaactcagtcaaaattcttatgaagatataaagatccacagacagcaaaataagtttgagaawgaaagaataaaggaaaagtgaagatggcaggtgggtgaggcaaagttaccatatgagatattaacatttgcaaggccaaagtaattaaatcaaggtgacgctggtatgggaacaggcaaataaatctgtggagcagaataaggatgaaaaatagactcactaattataaaaacttgagatggtggcaccacaaatcaaaggaaaaaggacgtattatatacactatgattttggaaaacaactttattattcggagaaaaataacactggatatctatgtcccttaaaccacatataaaa

SEQ ID NO: 73985 - DNA, 601 bp, Human
tgtgattttgtgattgacatctaaagtgggggcagtcttgtaggactgaaccgtttaacttttgccatctgatgcaaagtctatgcagatagcactagaattgcatggaacagtagaacacccagttggtgttgcagaattgaacagtgtaggaaaataatacacacatctggctatcagaagtgttctgtttgaatagagaaaccgtttgtttttctcagtgtgtgtgtgtgtatgtatgcgtgtgtgtatgtatctgtgtggctgtatgtacatatgtgtgtgtgcatatagagacatrtatatgtatatatgtgcatatataatttatatatttatatatagtacttaagaagcaatctaatggcacatcacctttatgaaaaatttttaagaactttaaggatacaaaggaatatttaagcaaatgacaggatattacatgttcaaaaatatttgatgtcagattttctccaagtaatctatggaatctacacaaactcagtcaaaattcttatgaagatataaagatccacagacagcaaaataagtttgagaaagaaagaataaaggaaaagtgaagatggcaggtgggtgaggc

SEQ ID NO: 73986 - DNA, 601 bp, Human
tctcagccccacactcagacctccaggagaatggagtgggatgtgtgtgctgaagatcaagctccctaaaagctcttgaactaggagatttgatgagcttctgagttggtaaacatatccacatgccaggagagtggcacaccccaactccaccctggtttccatttgtgtcttttataataaccttcataataaaccagtaaatgtaagaaaagtgtttcttccctgagttctgtgaaccattctagaaaatggaggcatcaaccttaatgcatcgtttgtcagtcagaagcccagggtaaaaaaaaaaaaaagcagcccagggtgtctggacttgtgattttgtgattgacatctaaagtgggggcagtcttgtaggactgaaccgtttaacttttgccatctgatgcaaagtctatgcagatagcactagaattgcatggaacagtagaacacccagttggtgttgcagaattgaacagtgtaggaaaataatacacacatctggctatcagaagtgttctgtttgaatagagaaaccgtttgtttttctcagtgtgtgtgtgtgtatgtatgcgtgtgtgtatgtatctgtgtggct

SEQ ID NO: 73987 - DNA, 601 bp, Human
aagcaggaggatcgcttgagccagggaggcggaggttgcagtgagccaagattgtgccactgcactccagcctggacaacagaatgagactccatctgagaaaaaaaagaaaaaatgaaagcaattgaactcatggagatagagagcagaagggttgttaccagaggctggaaagggtagcctgggtgtggtggggaagtagagatagttaataggtacgaaaaaatggaaagaatgaattaaacctactatttgatagtgtattagagtgactatagtggaaaataatttactcgtacaytttaaaataactaaaagagtataaatgaattgcttgtaacacaaaggataaatgcttgagggaatggataccccatctaccctaatatggttattacacactgcatgcctgtatcagaatatctcacataacccataaatatatacacctactatatacccataaaaatttaaaattaaaaaaactatatttatatatgattaattttttaaatctaatttttacttctgatttattttatgtataattttaattatatgctatgtaattataatctagatataaaatttatatttgtat

SEQ ID NO: 73988 - DNA, 601 bp, Human
ggacatggatgaaactggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaaaaaaagaatgagaccctttcatttgcaacaacatgaatggaactggaggtcataacgttaagtaaagtagggcaggcaccaaaagacaaactttgcatgtcctcacttacttgtgggagctaaaaatgagaacaggctgggcacgatagctcatgcctgtaatcccagcactttgggaggccaaagcagatggatcatctgagatcaggacttcaagaccagccgggccaacataataaaacactgtttctactaaaaatacaaaaattagtgggtgtggtggtgca

SEQ ID NO: 73989 - DNA, 601 bp, Human
caatgacattccccacagaaatagaaaaggtaatcctaatatggaaccacaaaagatccaggatagccaaagttatccaaagcaaaaagaacaaaactggaggaatcacattacttgacttcaatttatatcacagacctatagtaaccaaaacagcatggtactggcataaaaacagacacatagaccaatggagcagaatagagaactctgaaaaaaaatccattcatctatggtgaactcatttttgacaaagatgccaagaatgtacattggggaaaagacagtctcttcaataaayggtgcagggaaaatggaatttccataagcagaagagtgaaactagacccatatttcttgccatattcaaaaatcaatcaaaatcgatgaaagacttaaatctaagacctccaactaacaaactactgcaagaaaacattcaggaaactctccaggacattggactgaacaaagatttcttgagtaatacaccacaggcacagataactaatgaaaaaaaaatggataaatgggatcacatcaagttaagaagcttctgcacagcaaaggaaacaacaagatgaagagacaactcacagaa

SEQ ID NO: 73990 - DNA, 601 bp, Human
actcatgggatacagtgaaagcagtactaagaaggaagtttataactataaatgcctacatcaaaaaagaagaaaaacttcaaataaacaacccaatgggccaggcgtggtggctcacacctgtaatcccagcactttgggaggctgaggtgggtggatcacaaggtcaggagatcaagaccatcttggccaacatggtgaaatcccgtctctactaaaaatacaaaaattagctgggtgtggtggtgtgagactgtagtcccaacttctcaggaggctgaggcagaagaattgcttaaamccaggaggcagaggttgcagtgagccaagatcgcgccactgcactctaacttgagcgacagagtgagactccgtctcaaaaaaaaaagaaaagaaaaaaaaccaataatgcatattaaagaattagaaaagcaagagcaaaccaaacacaaaattagtagaagaaaagaaataataaagatcggagtagaaataaatgaaattgaaatgaagaaaacaatacaaaagatcaacaaaacaaaagaaatagttatttgaaaagaaaaacaaaactgatgaccctttagccaaaataactagg

SEQ ID NO: 73991 - DNA, 601 bp, Human
aatagaaaccaaaaaagagcaggagtagcattacttatatcagacaaaatagattttaagaaaaaaactgtaagaagagacgaagaagatcattatataaggataaaaggattaattaagcaagaggacataaaagttataaatatgtattcacccaacattgaagcacccagatatataaagcaaatattattatagctaaagagagagatagagcctaatacaataatagctgaagaattcacacctcactttcagcattggacagatcttccagaccaaaaaaaaaaataaataaatmaacaaagaaacattggatttcatccaaattataaaccaaatgaacctaataaatacttacagaacattttatccaatggctacagaatacaaatatgaatccagcacatggatcattctcaaggatagaccatatgttagctcacaaaccaagtcttaaaacatccaaaaaaaattgaaataatatcaagtatcttctctgaccataaggaaataaaactacaaatcaataacaagaggaaatttgaaaactatacaaacacgtggaaattgagcaatatgctcctgaatgaccagtggg

SEQ ID NO: 73992 - DNA, 601 bp, Human
atgccaatagaaaccaaaaaagagcaggagtagcattacttatatcagacaaaatagattttaagaaaaaaactgtaagaagagacgaagaagatcattatataaggataaaaggattaattaagcaagaggacataaaagttataaatatgtattcacccaacattgaagcacccagatatataaagcaaatattattatagctaaagagagagatagagcctaatacaataatagctgaagaattcacacctcactttcagcattggacagatcttccagaccaaaaaaaaaaataaawaaataaacaaagaaacattggatttcatccaaattataaaccaaatgaacctaataaatacttacagaacattttatccaatggctacagaatacaaatatgaatccagcacatggatcattctcaaggatagaccatatgttagctcacaaaccaagtcttaaaacatccaaaaaaaattgaaataatatcaagtatcttctctgaccataaggaaataaaactacaaatcaataacaagaggaaatttgaaaactatacaaacacgtggaaattgagcaatatgctcctgaatgacca

SEQ ID NO: 73993 - DNA, 601 bp, Human
ttccatgccaatagaaaccaaaaaagagcaggagtagcattacttatatcagacaaaatagattttaagaaaaaaactgtaagaagagacgaagaagatcattatataaggataaaaggattaattaagcaagaggacataaaagttataaatatgtattcacccaacattgaagcacccagatatataaagcaaatattattatagctaaagagagagatagagcctaatacaataatagctgaagaattcacacctcactttcagcattggacagatcttccagaccaaaaaaaaaaawaaataaataaacaaagaaacattggatttcatccaaattataaaccaaatgaacctaataaatacttacagaacattttatccaatggctacagaatacaaatatgaatccagcacatggatcattctcaaggatagaccatatgttagctcacaaaccaagtcttaaaacatccaaaaaaaattgaaataatatcaagtatcttctctgaccataaggaaataaaactacaaatcaataacaagaggaaatttgaaaactatacaaacacgtggaaattgagcaatatgctcctgaatg

SEQ ID NO: 73994 - DNA, 601 bp, Human
tgaaaaagatattccatgccaatagaaaccaaaaaagagcaggagtagcattacttatatcagacaaaatagattttaagaaaaaaactgtaagaagagacgaagaagatcattatataaggataaaaggattaattaagcaagaggacataaaagttataaatatgtattcacccaacattgaagcacccagatatataaagcaaatattattatagctaaagagagagatagagcctaatacaataatagctgaagaattcacacctcactttcagcattggacagatcttccagaccaaaaaaaaaaataaataaataaacaaagaaacattggatttcatccaaattataaaccaaatgaacctaataaatacttacagaacattttatccaatggctacagaatacaaatatgaatccagcacatggatcattctcaaggatagaccatatgttagctcacaaaccaagtcttaaaacatccaaaaaaaattgaaataatatcaagtatcttctctgaccataaggaaataaaactacaaatcaataacaagaggaaatttgaaaactatacaaacacgtggaaattgagcaatat

SEQ ID NO: 73995 - DNA, 601 bp, Human
aagaaaaggtagagaaagagataagagtagaaagattattcaaagggataatagcagagaacttcccaaacctagagaaaggtattgattccaagtgcaagaaggttatagaataccaagcagatttaacccaaagattacctcaaggaattcaataaaccccgcaaggtcatgtataaataaacaattctaaaagcagcaagagaaacgaagtgactaacatacaatggagcgccaatacaactggcagcagacttttcggtggaaaccttacaggccaagagagagtggcatgacatayttaaagtgctgaaggaaaaaaacttttacctttatatctggtgaaaatatcctccaaacataaagaagaaataaagattttcccagacaagcaaacactgagggatttcatcaataccagcccatgctataagaaatgctaaagggagtacttcaatcagaaaggaaaggatgttgatgagcaatgagaattcatctgaaggtacaaagatcactggaaatagtaagtaagcaaaaaaatgcagaatattataacactgtaactgtgatgtataaactactcttaactaggaagactaaa

SEQ ID NO: 73996 - DNA, 601 bp, Human
cactgaagagagcaggaaaaatggtcttgaattgccaacaccagccctcccatcccccagcagtggccacatggcatggagaaggaatctgagcacttgggagagggagaatgcagtgattctgagactttattaaatcctgtgctgccctgtcacagtggaaagcaaaaccaagctaaactcagctgattcttacccatggagggagcatttagactagctatcaccagaaagtaatcacccagccccacagttagaacttgagttccagcaagcctcgccaccatgggcaaacgtgctytccctaaataaacttgaaaggcagtctaggttgcaaggactacaactcctaggcaagttctagtgctgagctgggctcagagccaatggacttgggagtcacttccctactgagacaccagccagggaagctaaggaagtgcttgtgccacccttcacccaagcccaggcagcacagcttgtggctccaaaagagattccttccttctacttgaggagaggggagaaatgagtaaagaggactttgtcttgcatctgtgataccagctcagccacagtaggatagggcactggtaagggt

SEQ ID NO: 73997 - DNA, 601 bp, Human
ttagaagtctcagatgtgtaaggtttggaagtgaaaagacaaaacttgtcatatttgcacattgaaaaacctacatagaaaacctaacaaaatcaacaaattatgagaacaaataagaaaggatgctgtataaaaagtaaatttttaaaaacagcagcattcctctaaaccagcaataaccaactagaaaatataagagaacagtaccacacatatacatatatacctatctctacttatgcgtagagatgatagagataaatatggacacacacacacacacacacacacacacacacasacagacctatctgtccaaaatagtgcaataatttataagggaggggtagagcaaggagctaaatagaagtctccaccaatcatccctcctgaaggaacaccaaatttaacaactatctacatacaaaaaaaaaccaaaaaaaacctttgtaagaatgaaaaatcaggtgagcactcacaatacctggttttaacttcatatcacagaaagaggcactgaagagagcaggaaaaatggtcttgaattgccaacaccagccctcccatcccccagcagtggccacatggcatggagaaggaa

SEQ ID NO: 73998 - DNA, 601 bp, Human
gggaggctgaggcaggagaatcacttgaacctgggaggcagaggttgcaatgagctgaaattgcgccactgcactccagcctgggtgatagagctacactccatctcaaaaaaaaaaaattgtttttaataacacagaaactagatacactaaaaatctgcagtaagaataacaataaataaattttatatagttcttactaagattagaaaagaacaagaatactcactatcacaactacagttaaataaatcttggaggttttaatttatgctataagagaattttagaagtctcagakgtgtaaggtttggaagtgaaaagacaaaacttgtcatatttgcacattgaaaaacctacatagaaaacctaacaaaatcaacaaattatgagaacaaataagaaaggatgctgtataaaaagtaaatttttaaaaacagcagcattcctctaaaccagcaataaccaactagaaaatataagagaacagtaccacacatatacatatatacctatctctacttatgcgtagagatgatagagataaatatggacacacacacacacacacacacacacacacacacacagacctatctgt

SEQ ID NO: 73999 - DNA, 601 bp, Human
aggagcccatttctggtcactggcactttactcatcactttttcttattaatacctattttattggtcaggcgcagtggctcacccctgtaatcccagcacactgggaggccaaggcagacggatcacctgaggtcaggagctcgagaccagcctggtcaacatggtgaaaccctgtctctactaaaaatacaaaaaattagctgggtgtggtggtgggtgcctgtaatcccagctacctgggaggctgaggcaggagaatcacttgaacctgggaggcagaggttgcaatgagctgaaaytgcgccactgcactccagcctgggtgatagagctacactccatctcaaaaaaaaaaaattgtttttaataacacagaaactagatacactaaaaatctgcagtaagaataacaataaataaattttatatagttcttactaagattagaaaagaacaagaatactcactatcacaactacagttaaataaatcttggaggttttaatttatgctataagagaattttagaagtctcagatgtgtaaggtttggaagtgaaaagacaaaacttgtcatatttgcacattgaaaaacctaca

SEQ ID NO: 74000 - DNA, 601 bp, Human
tgtatgtaatcccacaccaagggacttctcttcagatttcatacacctgaaaagtaaataagtttgtaaataaaagaaaaataaagatttaaaactatcatattgtcttgaaaaggccagttgtaagctagtcacacataatgaacattcaaaattttactttcatgctcacttattggttattcagggctttattatccagctggcagcctacacaggagcccatttctggtcactggcactttactcatcactttttcttattaatacctattttattggtcaggcgcagtggctcacycctgtaatcccagcacactgggaggccaaggcagacggatcacctgaggtcaggagctcgagaccagcctggtcaacatggtgaaaccctgtctctactaaaaatacaaaaaattagctgggtgtggtggtgggtgcctgtaatcccagctacctgggaggctgaggcaggagaatcacttgaacctgggaggcagaggttgcaatgagctgaaattgcgccactgcactccagcctgggtgatagagctacactccatctcaaaaaaaaaaaattgtttttaataacacagaaactaga

SEQ ID NO: 74001 - DNA, 601 bp, Human; identical to SEQ ID NO: 31834

SEQ ID NO: 74002 - DNA, 601 bp, Human; identical to SEQ ID NO: 31835

SEQ ID NO: 74003 - DNA, 601 bp, Human; identical to SEQ ID NO: 31836

SEQ ID NO: 74004 - DNA, 601 bp, Human; identical to SEQ ID NO: 31837

SEQ ID NO: 74005 - DNA, 601 bp, Human; identical to SEQ ID NO: 31838

SEQ ID NO: 74006 - DNA, 601 bp, Human; identical to SEQ ID NO: 31839

SEQ ID NO: 74007 - DNA, 601 bp, Human; identical to SEQ ID NO: 31840

SEQ ID NO: 74008 - DNA, 601 bp, Human; identical to SEQ ID NO: 31841

SEQ ID NO: 74009 - DNA, 601 bp, Human; identical to SEQ ID NO: 73903

SEQ ID NO: 74010 - DNA, 601 bp, Human; identical to SEQ ID NO: 73904

SEQ ID NO: 74011 - DNA, 601 bp, Human; identical to SEQ ID NO: 73905

SEQ ID NO: 74012 - DNA, 601 bp, Human; identical to SEQ ID NO: 73906

SEQ ID NO: 74013 - DNA, 601 bp, Human; identical to SEQ ID NO: 73907

SEQ ID NO: 74014 - DNA, 601 bp, Human; identical to SEQ ID NO: 73908

SEQ ID NO: 74015 - DNA, 601 bp, Human; identical to SEQ ID NO: 73909

SEQ ID NO: 74016 - DNA, 601 bp, Human; identical to SEQ ID NO: 73910

SEQ ID NO: 74017 - DNA, 601 bp, Human; identical to SEQ ID NO: 73911

SEQ ID NO: 74018 - DNA, 601 bp, Human; identical to SEQ ID NO: 73912

SEQ ID NO: 74019 - DNA, 601 bp, Human; identical to SEQ ID NO: 73913

SEQ ID NO: 74020 - DNA, 601 bp, Human; identical to SEQ ID NO: 73914

SEQ ID NO: 74021 - DNA, 601 bp, Human; identical to SEQ ID NO: 73915

SEQ ID NO: 74022 - DNA, 601 bp, Human; identical to SEQ ID NO: 73916

SEQ ID NO: 74023 - DNA, 601 bp, Human; identical to SEQ ID NO: 73917

SEQ ID NO: 74024 - DNA, 601 bp, Human; identical to SEQ ID NO: 73918

SEQ ID NO: 74025 - DNA, 601 bp, Human; identical to SEQ ID NO: 73919

SEQ ID NO: 74026 - DNA, 601 bp, Human; identical to SEQ ID NO: 73920

SEQ ID NO: 74027 - DNA, 601 bp, Human; identical to SEQ ID NO: 73921

SEQ ID NO: 74028 - DNA, 601 bp, Human; identical to SEQ ID NO: 73922

SEQ ID NO: 74029 - DNA, 601 bp, Human; identical to SEQ ID NO: 73923

SEQ ID NO: 74030 - DNA, 601 bp, Human; identical to SEQ ID NO: 73924

SEQ ID NO: 74031 - DNA, 601 bp, Human; identical to SEQ ID NO: 73925

SEQ ID NO: 74032 - DNA, 601 bp, Human; identical to SEQ ID NO: 73926

SEQ ID NO: 74033 - DNA, 601 bp, Human; identical to SEQ ID NO: 73927

SEQ ID NO: 74034 - DNA, 601 bp, Human; identical to SEQ ID NO: 73928

SEQ ID NO: 74035 - DNA, 601 bp, Human; identical to SEQ ID NO: 73929

SEQ ID NO: 74036 - DNA, 601 bp, Human; identical to SEQ ID NO: 73930

SEQ ID NO: 74037 - DNA, 601 bp, Human; identical to SEQ ID NO: 73931

SEQ ID NO: 74038 - DNA, 601 bp, Human; identical to SEQ ID NO: 73932

SEQ ID NO: 74039 - DNA, 601 bp, Human; identical to SEQ ID NO: 73933

SEQ ID NO: 74040 - DNA, 601 bp, Human; identical to SEQ ID NO: 73934

SEQ ID NO: 74041 - DNA, 601 bp, Human; identical to SEQ ID NO: 73935

SEQ ID NO: 74042 - DNA, 601 bp, Human; identical to SEQ ID NO: 73936

SEQ ID NO: 74043 - DNA, 601 bp, Human; identical to SEQ ID NO: 73937

SEQ ID NO: 74044 - DNA, 601 bp, Human; identical to SEQ ID NO: 73938

SEQ ID NO: 74045 - DNA, 601 bp, Human; identical to SEQ ID NO: 31793

SEQ ID NO: 74046 - DNA, 601 bp, Human; identical to SEQ ID NO: 31794

SEQ ID NO: 74047 - DNA, 601 bp, Human; identical to SEQ ID NO: 31795

SEQ ID NO: 74048 - DNA, 601 bp, Human; identical to SEQ ID NO: 31796

SEQ ID NO: 74049 - DNA, 601 bp, Human; identical to SEQ ID NO: 31797

SEQ ID NO: 74050 - DNA, 601 bp, Human; identical to SEQ ID NO: 31798

SEQ ID NO: 74051 - DNA, 601 bp, Human; identical to SEQ ID NO: 31799

SEQ ID NO: 74052 - DNA, 601 bp, Human; identical to SEQ ID NO: 31800

SEQ ID NO: 74053 - DNA, 601 bp, Human; identical to SEQ ID NO: 31801

SEQ ID NO: 74054 - DNA, 601 bp, Human; identical to SEQ ID NO: 31802

SEQ ID NO: 74055 - DNA, 601 bp, Human; identical to SEQ ID NO: 31803

SEQ ID NO: 74056 - DNA, 601 bp, Human; identical to SEQ ID NO: 31804

SEQ ID NO: 74057 - DNA, 601 bp, Human; identical to SEQ ID NO: 31805

SEQ ID NO: 74058 - DNA, 601 bp, Human; identical to SEQ ID NO: 31806

SEQ ID NO: 74059 - DNA, 601 bp, Human; identical to SEQ ID NO: 31807

SEQ ID NO: 74060 - DNA, 601 bp, Human; identical to SEQ ID NO: 31808

SEQ ID NO: 74061 - DNA, 601 bp, Human; identical to SEQ ID NO: 31809

SEQ ID NO: 74062 - DNA, 601 bp, Human; identical to SEQ ID NO: 31810

SEQ ID NO: 74063 - DNA, 601 bp, Human; identical to SEQ ID NO: 31811

SEQ ID NO: 74064 - DNA, 601 bp, Human; identical to SEQ ID NO: 31812

SEQ ID NO: 74065 - DNA, 601 bp, Human; identical to SEQ ID NO: 31813

SEQ ID NO: 74066 - DNA, 601 bp, Human; identical to SEQ ID NO: 31814

SEQ ID NO: 74067 - DNA, 601 bp, Human; identical to SEQ ID NO: 31815

SEQ ID NO: 74068 - DNA, 601 bp, Human; identical to SEQ ID NO: 31816

SEQ ID NO: 74069 - DNA, 601 bp, Human; identical to SEQ ID NO: 31817

SEQ ID NO: 74070 - DNA, 601 bp, Human; identical to SEQ ID NO: 31818

SEQ ID NO: 74071 - DNA, 601 bp, Human; identical to SEQ ID NO: 31819

SEQ ID NO: 74072 - DNA, 601 bp, Human; identical to SEQ ID NO: 31820

SEQ ID NO: 74073 - DNA, 601 bp, Human; identical to SEQ ID NO: 31821

SEQ ID NO: 74074 - DNA, 601 bp, Human; identical to SEQ ID NO: 31822

SEQ ID NO: 74075 - DNA, 601 bp, Human; identical to SEQ ID NO: 31823

SEQ ID NO: 74076 - DNA, 601 bp, Human; identical to SEQ ID NO: 31824

SEQ ID NO: 74077 - DNA, 601 bp, Human; identical to SEQ ID NO: 31825

SEQ ID NO: 74078 - DNA, 601 bp, Human; identical to SEQ ID NO: 31826

SEQ ID NO: 74079 - DNA, 601 bp, Human; identical to SEQ ID NO: 31827

SEQ ID NO: 74080 - DNA, 601 bp, Human; identical to SEQ ID NO: 31828

SEQ ID NO: 74081 - DNA, 601 bp, Human; identical to SEQ ID NO: 31829

SEQ ID NO: 74082 - DNA, 601 bp, Human; identical to SEQ ID NO: 31830

SEQ ID NO: 74083 - DNA, 601 bp, Human; identical to SEQ ID NO: 31831

SEQ ID NO: 74084 - DNA, 601 bp, Human; identical to SEQ ID NO: 31832

SEQ ID NO: 74085 - DNA, 601 bp, Human; identical to SEQ ID NO: 31833

SEQ ID NO: 74086 - DNA, 601 bp, Human; identical to SEQ ID NO: 73980

SEQ ID NO: 74087 - DNA, 601 bp, Human; identical to SEQ ID NO: 73981

SEQ ID NO: 74088 - DNA, 601 bp, Human; identical to SEQ ID NO: 73982

SEQ ID NO: 74089 - DNA, 601 bp, Human; identical to SEQ ID NO: 73983

SEQ ID NO: 74090 - DNA, 601 bp, Human; identical to SEQ ID NO: 73984

SEQ ID NO: 74091 - DNA, 601 bp, Human; identical to SEQ ID NO: 73985

SEQ ID NO: 74092 - DNA, 601 bp, Human; identical to SEQ ID NO: 73986

SEQ ID NO: 74093 - DNA, 601 bp, Human; identical to SEQ ID NO: 73987

SEQ ID NO: 74094 - DNA, 601 bp, Human; identical to SEQ ID NO: 73988

SEQ ID NO: 74095 - DNA, 601 bp, Human; identical to SEQ ID NO: 73989

SEQ ID NO: 74096 - DNA, 601 bp, Human; identical to SEQ ID NO: 73990

SEQ ID NO: 74097 - DNA, 601 bp, Human; identical to SEQ ID NO: 73991

SEQ ID NO: 74098 - DNA, 601 bp, Human; identical to SEQ ID NO: 73992

SEQ ID NO: 74099 - DNA, 601 bp, Human; identical to SEQ ID NO: 73993

SEQ ID NO: 74100 - DNA, 601 bp, Human; identical to SEQ ID NO: 73994

SEQ ID NO: 74101 - DNA, 601 bp, Human; identical to SEQ ID NO: 73995

SEQ ID NO: 74102 - DNA, 601 bp, Human; identical to SEQ ID NO: 73996

SEQ ID NO: 74103 - DNA, 601 bp, Human; identical to SEQ ID NO: 73997

SEQ ID NO: 74104 - DNA, 601 bp, Human; identical to SEQ ID NO: 73998

SEQ ID NO: 74105 - DNA, 601 bp, Human; identical to SEQ ID NO: 73999

SEQ ID NO: 74106 - DNA, 601 bp, Human; identical to SEQ ID NO: 74000

SEQ ID NO: 74107 - DNA, 601 bp, Human; identical to SEQ ID NO: 31834

SEQ ID NO: 74108 - DNA, 601 bp, Human; identical to SEQ ID NO: 31835

SEQ ID NO: 74109 - DNA, 601 bp, Human; identical to SEQ ID NO: 31836

SEQ ID NO: 74110 - DNA, 601 bp, Human; identical to SEQ ID NO: 31837

SEQ ID NO: 74111 - DNA, 601 bp, Human; identical to SEQ ID NO: 31838

SEQ ID NO: 74112 - DNA, 601 bp, Human; identical to SEQ ID NO: 31839

SEQ ID NO: 74113 - DNA, 601 bp, Human; identical to SEQ ID NO: 31840

SEQ ID NO: 74114 - DNA, 601 bp, Human; identical to SEQ ID NO: 31841

SEQ ID NO: 74115 - DNA, 601 bp, Human; identical to SEQ ID NO: 26213

SEQ ID NO: 74116 - DNA, 601 bp, Human; identical to SEQ ID NO: 26214

SEQ ID NO: 74117 - DNA, 601 bp, Human; identical to SEQ ID NO: 26215

SEQ ID NO: 74118 - DNA, 601 bp, Human; identical to SEQ ID NO: 26216

SEQ ID NO: 74119 - DNA, 601 bp, Human; identical to SEQ ID NO: 26217

SEQ ID NO: 74120 - DNA, 601 bp, Human; identical to SEQ ID NO: 26218

SEQ ID NO: 74121 - DNA, 601 bp, Human; identical to SEQ ID NO: 26219

SEQ ID NO: 74122 - DNA, 601 bp, Human; identical to SEQ ID NO: 26220

SEQ ID NO: 74123 - DNA, 601 bp, Human; identical to SEQ ID NO: 26221

SEQ ID NO: 74124 - DNA, 601 bp, Human; identical to SEQ ID NO: 26222

SEQ ID NO: 74125 - DNA, 601 bp, Human; identical to SEQ ID NO: 26223

SEQ ID NO: 74126 - DNA, 601 bp, Human; identical to SEQ ID NO: 26224

SEQ ID NO: 74127 - DNA, 601 bp, Human; identical to SEQ ID NO: 26225

SEQ ID NO: 74128 - DNA, 601 bp, Human; identical to SEQ ID NO: 26226

SEQ ID NO: 74129 - DNA, 601 bp, Human; identical to SEQ ID NO: 26227

SEQ ID NO: 74130 - DNA, 601 bp, Human; identical to SEQ ID NO: 26228

SEQ ID NO: 74131 - DNA, 601 bp, Human; identical to SEQ ID NO: 26229

SEQ ID NO: 74132 - DNA, 601 bp, Human; identical to SEQ ID NO: 26230

SEQ ID NO: 74133 - DNA, 601 bp, Human; identical to SEQ ID NO: 26231

SEQ ID NO: 74134 - DNA, 601 bp, Human; identical to SEQ ID NO: 26232

SEQ ID NO: 74135 - DNA, 601 bp, Human; identical to SEQ ID NO: 26233

SEQ ID NO: 74136 - DNA, 601 bp, Human; identical to SEQ ID NO: 26234

SEQ ID NO: 74137 - DNA, 601 bp, Human; identical to SEQ ID NO: 26235

SEQ ID NO: 74138 - DNA, 601 bp, Human; identical to SEQ ID NO: 26236

SEQ ID NO: 74139 - DNA, 601 bp, Human; identical to SEQ ID NO: 26237

SEQ ID NO: 74140 - DNA, 601 bp, Human; identical to SEQ ID NO: 26238

SEQ ID NO: 74141 - DNA, 601 bp, Human; identical to SEQ ID NO: 26239

SEQ ID NO: 74142 - DNA, 601 bp, Human; identical to SEQ ID NO: 26240

SEQ ID NO: 74143 - DNA, 601 bp, Human; identical to SEQ ID NO: 26241

SEQ ID NO: 74144 - DNA, 601 bp, Human; identical to SEQ ID NO: 26242

SEQ ID NO: 74145 - DNA, 601 bp, Human; identical to SEQ ID NO: 26243

SEQ ID NO: 74146 - DNA, 601 bp, Human; identical to SEQ ID NO: 26213

SEQ ID NO: 74147 - DNA, 601 bp, Human; identical to SEQ ID NO: 26214

SEQ ID NO: 74148 - DNA, 601 bp, Human; identical to SEQ ID NO: 26215

SEQ ID NO: 74149 - DNA, 601 bp, Human; identical to SEQ ID NO: 26216

SEQ ID NO: 74150 - DNA, 601 bp, Human; identical to SEQ ID NO: 26217

SEQ ID NO: 74151 - DNA, 601 bp, Human; identical to SEQ ID NO: 26218

SEQ ID NO: 74152 - DNA, 601 bp, Human; identical to SEQ ID NO: 26219

SEQ ID NO: 74153 - DNA, 601 bp, Human; identical to SEQ ID NO: 26220

SEQ ID NO: 74154 - DNA, 601 bp, Human; identical to SEQ ID NO: 26221

SEQ ID NO: 74155 - DNA, 601 bp, Human; identical to SEQ ID NO: 26222

SEQ ID NO: 74156 - DNA, 601 bp, Human; identical to SEQ ID NO: 26223

SEQ ID NO: 74157 - DNA, 601 bp, Human; identical to SEQ ID NO: 26224

SEQ ID NO: 74158 - DNA, 601 bp, Human; identical to SEQ ID NO: 26225

SEQ ID NO: 74159 - DNA, 601 bp, Human; identical to SEQ ID NO: 26226

SEQ ID NO: 74160 - DNA, 601 bp, Human; identical to SEQ ID NO: 26227

SEQ ID NO: 74161 - DNA, 601 bp, Human; identical to SEQ ID NO: 26228

SEQ ID NO: 74162 - DNA, 601 bp, Human; identical to SEQ ID NO: 26229

SEQ ID NO: 74163 - DNA, 601 bp, Human; identical to SEQ ID NO: 26230

SEQ ID NO: 74164 - DNA, 601 bp, Human; identical to SEQ ID NO: 26231

SEQ ID NO: 74165 - DNA, 601 bp, Human; identical to SEQ ID NO: 26232

SEQ ID NO: 74166 - DNA, 601 bp, Human; identical to SEQ ID NO: 26233

SEQ ID NO: 74167 - DNA, 601 bp, Human; identical to SEQ ID NO: 26234

SEQ ID NO: 74168 - DNA, 601 bp, Human; identical to SEQ ID NO: 26235

SEQ ID NO: 74169 - DNA, 601 bp, Human; identical to SEQ ID NO: 26236

SEQ ID NO: 74170 - DNA, 601 bp, Human; identical to SEQ ID NO: 26237

SEQ ID NO: 74171 - DNA, 601 bp, Human; identical to SEQ ID NO: 26238

SEQ ID NO: 74172 - DNA, 601 bp, Human; identical to SEQ ID NO: 26239

SEQ ID NO: 74173 - DNA, 601 bp, Human; identical to SEQ ID NO: 26240

SEQ ID NO: 74174 - DNA, 601 bp, Human; identical to SEQ ID NO: 26241

SEQ ID NO: 74175 - DNA, 601 bp, Human; identical to SEQ ID NO: 26242

SEQ ID NO: 74176 - DNA, 601 bp, Human; identical to SEQ ID NO: 26243

SEQ ID NO: 74177 - DNA, 601 bp, Human
gcacaatctcagctcactgcaacctccacctcccaggttcaagtgtttctcctgcctcggcctcccaagtagctgggattacaggcacgtgccaccatgcctagctaatttttgtatttttagttgagatggggtttcaccatgctggccaggctggtcttgaacttctgacctcttgatccgctggcctcagcctcccaaaatgtttggattacaggcgtgagccatcgcgcccggccggttcaagcgactcctgtacctcagcctcccaggtaggtgggatcacagacatgtgccaccrtgcccagctaatttttgtatttttggtggagatggggtttcaccatgttggccaggctggtcttgaactcttgacctcaggtgatcagcccaccttggtctcccaaagtgttgggattacaggcgtgagccaccacacctggccctctctgcagtttatacttgaggaaactgaggcccagacaggtgaagtgactgtccagggtggtccagacagaggtggttggtccgaggtcagctgggctccagtctagcgctctttctacttcctcaaggcagattggattgcagtgtgtgcccc

SEQ ID NO: 74178 - DNA, 601 bp, Human
gcgcccggccggttcaagcgactcctgtacctcagcctcccaggtaggtgggatcacagacatgtgccaccatgcccagctaatttttgtatttttggtggagatggggtttcaccatgttggccaggctggtcttgaactcttgacctcaggtgatcagcccaccttggtctcccaaagtgttgggattacaggcgtgagccaccacacctggccctctctgcagtttatacttgaggaaactgaggcccagacaggtgaagtgactgtccagggtggtccagacagaggtggttggtcygaggtcagctgggctccagtctagcgctctttctacttcctcaaggcagattggattgcagtgtgtgccccactgtcctgagtgggtgcttccctcctccccagccctccctggcatgggccatctccagggctgtcccgagaagggcatagactgcggacagtcccagcaaagccaagcagaagtggcggtactttccatggcattctcctccttcagcttaccctcctggagaacctgaaactgtatcaccagaaggatcccgggttctttgggtcaggaatgggaaccaccatttat

SEQ ID NO: 74179 - DNA, 601 bp, Human
tcactgtgtcccccaggctggagtgcagtagcatgaccttggctcactgcaacctctgtctcctgggttcaagcaattctcgtgcgtcagcctcccaagtagctgggattacaggcctgcaccaccacgcccagctaatttttgtatctttagaagagacgaggtttcgccatgttggccaggctggtttcaaactcctgacctcaagtgatcctcctgcctcggcctcccaaagtgctgggattacaggtgggagccactgcacccagccaggaaccaccatttcttttcttttctttctttttttttttttgaggcagagtttcactcccgttgcccaggctggagtccaatggtgcgatctcagctcactgcaacctccgcctcccaggttcaagcgattctcctgcctcaatctccctagtggctgggattacaggcggatgccacaacgctcagctaatgtttgtatttttagtagagacggggtttcaccatgttggtcaggctggtttcaaactcttgatctcaggtgatccgcctacctcggcctcccaaagtaccgggattacaggcgtgagccaccgcgcccggccaggaa

SEQ ID NO: 74180 - DNA, 601 bp, Human
tggtttcaaactcctgacctcaagtgatcctcctgcctcggcctcccaaagtgctgggattacaggtgggagccactgcacccagccaggaaccaccatttcttttcttttctttctttttttttttttgaggcagagtttcactcccgttgcccaggctggagtccaatggtgcgatctcagctcactgcaacctccgcctcccaggttcaagcgattctcctgcctcaatctccctagtggctgggattacaggcggatgccacaacgctcagctaatgtttgtatttttagtagagayggggtttcaccatgttggtcaggctggtttcaaactcttgatctcaggtgatccgcctacctcggcctcccaaagtaccgggattacaggcgtgagccaccgcgcccggccaggaactgccatttcttgagtacctccctcggaccaggttgtgcccaaggccccacgtctcccagtggtaaagccggcggtgcttgctctctgtgaggcttggtgttctagcctgcaagacccggtgatactacctcacgcctggagctctaacaagaattccaggggatgaagttggggagagttcag

SEQ ID NO: 74181 - DNA, 601 bp, Human
ccttggtctccctaagtgttgacattacaggtgtgagccaccccaccctctgcatcattcttgctctcaggaaggcagctcccctttattcctgacccccagggcagcatctaccaagacacagctcccctttaggggaggcaccctgtcgccagaacccccccgcagctaccaaggcaggcactgtgccaagcgctttacggcattggctcattgaatcctcatgaaagtctctggagggaggtactatcatctgtattattcccattttacagatgagaaaactgaggcacggagaggmtaaattccctgcccagcaatctgtctttagcaccctctctgttgtatctcattgatttctgctgatcctggatcacgggttcatctggggaagtcattgctggactttgggcagtaggtggggagggctgagagctctgggtgccaggccttggccttagcccaaggcagctggctggaccagacagaaagcagatgggaggggccttggtactcgaaaatgaatcttccacatccatgccttaagggtttctctggcctggcctaacagtgagctgggaaaagacctcaccacgtgact

SEQ ID NO: 74182 - DNA, 601 bp, Human
ggtctccctaagtgttgacattacaggtgtgagccaccccaccctctgcatcattcttgctctcaggaaggcagctcccctttattcctgacccccagggcagcatctaccaagacacagctcccctttaggggaggcaccctgtcgccagaacccccccgcagctaccaaggcaggcactgtgccaagcgctttacggcattggctcattgaatcctcatgaaagtctctggagggaggtactatcatctgtattattcccattttacagatgagaaaactgaggcacggagaggctaarttccctgcccagcaatctgtctttagcaccctctctgttgtatctcattgatttctgctgatcctggatcacgggttcatctggggaagtcattgctggactttgggcagtaggtggggagggctgagagctctgggtgccaggccttggccttagcccaaggcagctggctggaccagacagaaagcagatgggaggggccttggtactcgaaaatgaatcttccacatccatgccttaagggtttctctggcctggcctaacagtgagctgggaaaagacctcaccacgtgactgcag

SEQ ID NO: 74183 - DNA, 601 bp, Human
ccaccctctgcatcattcttgctctcaggaaggcagctcccctttattcctgacccccagggcagcatctaccaagacacagctcccctttaggggaggcaccctgtcgccagaacccccccgcagctaccaaggcaggcactgtgccaagcgctttacggcattggctcattgaatcctcatgaaagtctctggagggaggtactatcatctgtattattcccattttacagatgagaaaactgaggcacggagaggctaaattccctgcccagcaatctgtctttagcaccctctctgytgtatctcattgatttctgctgatcctggatcacgggttcatctggggaagtcattgctggactttgggcagtaggtggggagggctgagagctctgggtgccaggccttggccttagcccaaggcagctggctggaccagacagaaagcagatgggaggggccttggtactcgaaaatgaatcttccacatccatgccttaagggtttctctggcctggcctaacagtgagctgggaaaagacctcaccacgtgactgcagttgggtgcttgtgctgcagaggccagagagaaggcact

SEQ ID NO: 74184 - DNA, 601 bp, Human
attgaatcctcatgaaagtctctggagggaggtactatcatctgtattattcccattttacagatgagaaaactgaggcacggagaggctaaattccctgcccagcaatctgtctttagcaccctctctgttgtatctcattgatttctgctgatcctggatcacgggttcatctggggaagtcattgctggactttgggcagtaggtggggagggctgagagctctgggtgccaggccttggccttagcccaaggcagctggctggaccagacagaaagcagatgggaggggccttggtrctcgaaaatgaatcttccacatccatgccttaagggtttctctggcctggcctaacagtgagctgggaaaagacctcaccacgtgactgcagttgggtgcttgtgctgcagaggccagagagaaggcactggaagcgctggcttttgtctgcagccaggagtctggcatcttaggatgttgggctcttggacagggaaatgaagacaagagcatgggcatttagaattccaactcattcccatttcacctaaaggttctgtgactttgggtcaggtatttagcctctctgtgcctcggtt

SEQ ID NO: 74185 - DNA, 601 bp, Human
aaccagagaggcaggctctgcgtggcccaaggaacccgggagttttttttgtttgtttggttttttgttttttgtttttgtttttgagatggagacttgctctgtcacccaggctagagtgcagtggcattatctcggctcactgcaatctctgccccctgggttcaagcagttctctgcctccacctcccgagtagctgggattacaggctcccgcccaccaccatgcctagctaatttttgtatttttagtaaagatggggtttcaccatgttggccaggctggtcttgaactcctgayctcatgatccacctgccttggcctcccaaagtgctaggattataggcatgagccaccgtgcccggctttttttttctttctttttttttttttgagacagagttttgttcttgtcgcccaggccggactgcaatggcacagtctctgctcactgcagccgccacctcccgggttcaagcgattctcttgcctgagcctcacgagtagttgggattacaggcatgtgccaccacgcccggctaatttttgtattcttagtagagacagggtttcaccatgttgaccaggctgctctcaaac

SEQ ID NO: 74186 - DNA, 601 bp, Human
taatttttgtatttttagtaaagatggggtttcaccatgttggccaggctggtcttgaactcctgacctcatgatccacctgccttggcctcccaaagtgctaggattataggcatgagccaccgtgcccggctttttttttctttctttttttttttttgagacagagttttgttcttgtcgcccaggccggactgcaatggcacagtctctgctcactgcagccgccacctcccgggttcaagcgattctcttgcctgagcctcacgagtagttgggattacaggcatgtgccaccacrcccggctaatttttgtattcttagtagagacagggtttcaccatgttgaccaggctgctctcaaactcctgacctcaggtgatccacctgcctcagcctctcaaagtgctgcgattacaggcgtgagtcaccacgcctggccacggaacctgggggttaaggtcccagtgtgggctctcagcagcactgtttccctggaaaacagggaatagacaggttatagggaggaaagtgggcatgtggggagggcacagctagacagctcccttacatagatagagagacagggccctctcaaca

SEQ ID NO: 74187 - DNA, 601 bp, Human
ttctttttttttttttgagacagagttttgttcttgtcgcccaggccggactgcaatggcacagtctctgctcactgcagccgccacctcccgggttcaagcgattctcttgcctgagcctcacgagtagttgggattacaggcatgtgccaccacgcccggctaatttttgtattcttagtagagacagggtttcaccatgttgaccaggctgctctcaaactcctgacctcaggtgatccacctgcctcagcctctcaaagtgctgcgattacaggcgtgagtcaccacgcctggccayggaacctgggggttaaggtcccagtgtgggctctcagcagcactgtttccctggaaaacagggaatagacaggttatagggaggaaagtgggcatgtggggagggcacagctagacagctcccttacatagatagagagacagggccctctcaacagatggcctggccaccgtccctggctgggcagtgcatgcatttaggttaagagaggagactctgggttcaggcttgtgtccaagtcctggtgctgctgcttcctagctcccttgggcacattactcgccagctgtacccttggtt

SEQ ID NO: 74188 - DNA, 601 bp, Human
tttaggttaagagaggagactctgggttcaggcttgtgtccaagtcctggtgctgctgcttcctagctcccttgggcacattactcgccagctgtacccttggtttcctaactggaaagtcgggggttagtatgtgtgaagtgcttggaacagcattggctgggcacggtggctcatgcctgtaatccagcactttgggaagctgaggcaggcagatcacctgaggtcatgagtttgcgaccagcctggccaacatggtgaaaccccatctctactaaaaatacaaaaaattagctgggcrtggtggccggcacctgtaatcccaactatttaggaggctgaggcatgagaatcgcttgaacccaggagatagaggttgtagtgagacaagatctagccactgcactccagcctgggtgacagagcgagactctgtctcaaaaaaaaaaaattgtgtctggcacacagaaaatgctcgatgaaggtaagccattattgttgctgttattgagaagcaggaacctgagaaaggggctttgagccacgccaccccatccccttcccccacccctgctgctggagttcaagagcctgttccatc

SEQ ID NO: 74189 - DNA, 601 bp, Human
gggccgactcattggttctaagagcctcaagcatggtgttgggagaatctagagccatgtgatactcagcaagaaagactgtgagatagattagcaatgtctgtcctgggttaggtatggagagcagggacctgtgagccatgtatttgctgtccctgggctaattgtctatcattggccagagagatcttcctggtggtcagcattcagagtaatcttccttccacaccctctaaagccagaaactcagtcctataatgtagggtgtagacacctctcctgtctacagcacatgcttcakgacatgttggtcagtgtatttgtctgttttatgttgctgtaaagaagtacccgtggctgggtgatttctcaagaggtttatttggctcacagttctgcaggctgtacaagcataccaccagcatctgttctgcttccagtgaggcctcaggaagctttgactcatggcaggcatgtcacatggtgagagctggagcaagagagaggaggaagtgcaaggctcttttaaacaaccagctctctgctgggcacggtggctcatgcctgtaatcctggcactttgggaggccaaggcgtgtgg

SEQ ID NO: 74190 - DNA, 601 bp, Human
ggttctaagagcctcaagcatggtgttgggagaatctagagccatgtgatactcagcaagaaagactgtgagatagattagcaatgtctgtcctgggttaggtatggagagcagggacctgtgagccatgtatttgctgtccctgggctaattgtctatcattggccagagagatcttcctggtggtcagcattcagagtaatcttccttccacaccctctaaagccagaaactcagtcctataatgtagggtgtagacacctctcctgtctacagcacatgcttcatgacatgttggtcagtgtatttgtctgttttatgttgctgtaaagaagtacccgtggctgggtgatttctcaagaggtttatttggctcacagttctgcaggctgtacaagcataccaccagcatctgttctgcttccagtgaggcctcaggaagctttgactcatggcaggcatgtcacatggtgagagctggagcaagagagaggaggaagtgcaaggctcttttaaacaaccagctctctgctgggcacggtggctcatgcctgtaatcctggcactttgggaggccaaggcgtgtggatcatttgcggtc

SEQ ID NO: 74191 - DNA, 601 bp, Human
aaatatattatatatattatatataataatttatataatatatataatatatatattggtggctcatgcctgtaatctcagcactttgggaggccgaggtgggcggatcacgaggtcaggagatcgagaccatcctggctaacacgatgaaaccccgtctccactaaaaatacaaaaaattagccaggtgtggtggcaggcgcctgtagtcccagctactcgggaggctgaggcaggagaatggcatgaacccgggaggcggagcttgcagtgagccgagatcgtgccactgcactccagmctgggcgacagagcgagacattgtcttaaaaataaataaataaataaagatgcaaattcacacacatcacttaatgactttccactgcacggagaataaaatccacaggcctcttttcaaccttagatggggatctgccatctgccctcaacagacacttttttccactggtccagagtaagcacagtccagatggccttgccctggcccaggcccaggagtagggatgtcccattgctcttgtggttgcttgtcaccagtctgtactctagccaggggcccatgtgggcttccccacta

SEQ ID NO: 74192 - DNA, 601 bp, Human
ttccactgcacggagaataaaatccacaggcctcttttcaaccttagatggggatctgccatctgccctcaacagacacttttttccactggtccagagtaagcacagtccagatggccttgccctggcccaggcccaggagtagggatgtcccattgctcttgtggttgcttgtcaccagtctgtactctagccaggggcccatgtgggcttccccactatgccaggtctcagcccccaaggcactctgtgagcttggcccagcctttcccttctctgggccaggtttcccagataactrtaaaaagggacaccaggcctgtatcctcccagccctgctctccaggggctcctcgtacaatccgtttcttcaccacctatatggtgcccagcactgaacagtacagcttagtgggcaccattggtcttattcttggggtcattaggaactcattaataagtgacattcactggcagccccatttccaacctgcagccccacctcctgtcaattcaggaggacttctgagaggtgacagggtttgtgggcatatgagtggaggtggataagagggaagggtgggaggaggcccctgactta

SEQ ID NO: 74193 - DNA, 601 bp, Human
ttttccactggtccagagtaagcacagtccagatggccttgccctggcccaggcccaggagtagggatgtcccattgctcttgtggttgcttgtcaccagtctgtactctagccaggggcccatgtgggcttccccactatgccaggtctcagcccccaaggcactctgtgagcttggcccagcctttcccttctctgggccaggtttcccagataactgtaaaaagggacaccaggcctgtatcctcccagccctgctctccaggggctcctcgtacaatccgtttcttcaccacctatrtggtgcccagcactgaacagtacagcttagtgggcaccattggtcttattcttggggtcattaggaactcattaataagtgacattcactggcagccccatttccaacctgcagccccacctcctgtcaattcaggaggacttctgagaggtgacagggtttgtgggcatatgagtggaggtggataagagggaagggtgggaggaggcccctgacttagaggctggaagctaagggtccgtcttggtgtccccacccaccaaccttcaggcttcatcggttatgcccccaacctcagca

SEQ ID NO: 74194 - DNA, 601 bp, Human
ttctctgtcccttgttttttccgttatgaaatgcaataatgggccagacccagtggctcatgcctgtaatcccagcactttggaggccaaagcgggtggatcacctgaggtcaggagtttgagaccagcctggccaacatgatgaaaccctgtctctactaaaaatataaagattagccgtgcgtggtggtgggtgcctgtaatcccagctactcaggaggctgaggcaggagaattgcttggacctgggaggcggaggttgcagtgagccgagattgtgccattgcactgcagcctgggygacaagagccagactccatctcaaaaaaaaaagcaataatgataatactttctcacagagatgttgtcaggattaaattgattaatatatgtagaatagtttatttatttatttgagacagggtctcactgtcacccaggctgatgcgcagtggcagaaacatagctcactgcagcctcagcctcccggactcaagcgatcctcccacctcagcctcctgagtagctgggactataggcctgcgtcaccatgtctggctaattttaagatttttttatagagatgaagttttgctatgtt

SEQ ID NO: 74195 - DNA, 601 bp, Human
gccagacccagtggctcatgcctgtaatcccagcactttggaggccaaagcgggtggatcacctgaggtcaggagtttgagaccagcctggccaacatgatgaaaccctgtctctactaaaaatataaagattagccgtgcgtggtggtgggtgcctgtaatcccagctactcaggaggctgaggcaggagaattgcttggacctgggaggcggaggttgcagtgagccgagattgtgccattgcactgcagcctgggtgacaagagccagactccatctcaaaaaaaaaagcaataatgrtaatactttctcacagagatgttgtcaggattaaattgattaatatatgtagaatagtttatttatttatttgagacagggtctcactgtcacccaggctgatgcgcagtggcagaaacatagctcactgcagcctcagcctcccggactcaagcgatcctcccacctcagcctcctgagtagctgggactataggcctgcgtcaccatgtctggctaattttaagatttttttatagagatgaagttttgctatgttgcccaagctggtctcaaactcctgggctcaagtgatccttct

SEQ ID NO: 74196 - DNA, 601 bp, Human
ccctgctgcagtctggtaccttctttcctgcaggagcagatcaatatcaccctggaccaccgctgccgtatcttccagaacctggatggagccttgggtgagcagcccccacggggaggggtggatcctcagaggggtgataggaagaattccaggcagggcccgagcccagggaggagaaatgggctgcttctttctggccattgtgctgagaggtcactggcctcatccccaggtccccaggggccacttggatatcctggcgcagagccatgtctctcttgggggcgggggacaagtragcattcagcctgggaggagttgggggatgcgcacagcaggtgctggaccccctgccctgcataccaggtccttacaggtgggccctctttccccactttcccggccctcccaccttccaggtgaaggagtcctgggctaggggcaggaactcagctggtgggacaggcagcttgggaagcaaaaggctacttgacccttgatgccgcaaacatccctgggcctggcctcatgtctgtggctggtgatgacattgctttgccgcaggtcttcctgtcttcctgagtgacctcaggcaagt

SEQ ID NO: 74197 - DNA, 601 bp, Human
aacatgagtattggaaccctgctgcaggggctccctccactgggacaagatctgtcctgatcatgcccaggcctcccctgcatgtggctctggcattttctcagtgctgctctgcctactcagagaaggcgcgtcccagaccctttctcttggggcttctctgaggtgcctggagctgggatgttccaggtcttcgttcttctcccagcccctgcttctgactgtaagtaaccacaacaagtacaggggttgccgtggattctgtgctcatgatgggccaggcttggtgccccacgcttgytcaacacaaatcctccccctcaccccatgaagaagggattattcctattttatagatgaggaaactgaggcttagagagaagtgacttgcccgaggacataatctactcactgcacagctgggatttgagcccagctggttggaccctgagcctgacctctgggtctgatgctgggtgggactgtgctttctgacccccagatgaggtcgtgctcaagtttgaaatgggccatgtgagagcgaggaacctggcctatgacaccctcccggtcctgatccatggcaacgggccaaccaagg

SEQ ID NO: 74198 - DNA, 601 bp, Human
gcctgctatgaactcactgcctctgtcctcacatctgagctcagcgtgatgccttcttttcctgctgtggtggtcagtggtactctgtctgttcttgctggtcacaggacacgtaggaggctgccatccccttccaggcctaggctgggctaccagagccatctgcactgtcaccccagggcagagtcacttattcactcagtaaacctttatttcatgtttgcaccagacagtaagacatagtcataagcaggacggatgtcctgcattcatggtgacagaagggactgggtgcagatgyggccagggacagaatggacctcactggtccctggggaactggctcatagctcatagcatatttgagtgtggtccttcaccgctggaatgagggagaggaaggaggatgtgatgtgtttaaaatgcaaatttgctgatttcacccaggatctgttcagatggaatctctgagcggggtgggacccaggaatctgcattttacaagctctcgggagaagcactagagtgccaagccctcccctgccctctctcagagcggcttggtgatctcctggggatggagcattatctccaagaccct

SEQ ID NO: 74199 - DNA, 601 bp, Human
agggcattggggtgaggctgcgcccaggcctgtgcctgagggacacggggggctcagtcccctgagatggcgagatgggtgattctggaatagactccattgtctttggtggaaagtgaaggggtcacctccctgcctggggttctatcccggttgccacccaagtgcctcctcctggaagccctctcagattgcatgtctctagcttcccccgagatgtccaggttctggtttcttctgcctggtccttcaggctctcctgcagccccctccccatcccatgaacctcatcctcatttaygactcacctcgaacaccacgccagccacgatctcctgacagcaggccctcaaccgagtccttgttccaggcctgggctcctgctgctctctccccggggcaccctcctgctgcttccctgcccccccgtaccccctgactggagttccccggcccgggcacctttcttgggaagtctacatgcttctgattctggctctgactcccttgggccaccctggggtggagtggcagtgctgtgactggacactgctggactcttgtgccgccctccctggtgcaggatgaagctctgcccacg

SEQ ID NO: 74200 - DNA, 601 bp, Human
gacctggtcagaggagaatgggcaaaggatggccagggaagggtgttcctggcacagggctggcatgggcaaaggtctggagacaggaaagcagatggccggggtgccagagatgaaggggcacagcctggcagtgacaggaggtgctacagtccctgggtggaagctgtgtcctccttcctcacccccgcatccccttccccatccccaaccccaggagcagcaccacaaggctcaggtggaagagttcctggcacagcatggcagcgagtaccagtctgtgaagctggtgggccctgargtgcggatggcgaatgcagatgccaggaacatgggcgcgtgagttgtgggccacagtactctccactgacagtgggggcaggggagctgtggctgtggtaaggagcagcaggctgagtgacaggagttcagaaggctgtgtgtgctctagcaagttcctgcccctttctgggccttggagtttccatctgtcaaaaggggaaatagcctctgtcctgccaacccccggggctcctgggcagggctgagccatgttatttgggttcaggaagcaaatcagagaaagaggaaggactggggg

SEQ ID NO: 74201 - DNA, 601 bp, Human
tatagggcaggatttgggtagggagagaagggtgtccagagaggcaacaccatctattggaggagggaccaggactcaagaggcctgggtttgtggcctagatctgccatcatctgggacttagttgagccttccagctttggggaccttagttatcttagctccaaaatgggtatactgtcccagcctgtcttacccatgagggtgttgtgatgatcagaaggggagacagttgtaactgtttctagacgttgggagctcacagctgatgggtgtaagcacatgcctgcacacagacatrtacacacaagcacacacatgtacatacatgtgcaaacaccacctcctatgggcacacctgtgcacccagacaacacacacgcacccagtgggtgcaggtgaacacctgcctctgtcaagcacgtacaccttcactcccactttgaggggtctgctctgagcatccctggcagttgagccaatggtgaggaccctagcctgcttcccacttcccacaggactggaaggagaagtacatccaccagaactacaccaaagccctggcagggaagctggtggagacggtaagggccatggacac

SEQ ID NO: 74202 - DNA, 601 bp, Human
cagtctctccaggattgacaaggccctgctccccggggacactgggagggctccctggcttgggtgtgtggccctgaagaggaaggaggattctgtggtgccactgtggacccccttgactgagtccctgccctccccagccctgcccggatgtctattggttccccatcttcacggaggtggcctgtgatgagctggtggaggagatggagcactttggccagtggtctctgggcaacaacaaggtgggaccctgatgcctgggctggggccgcagggaggctgcctctccatcagtgcygctcactgtctggggtcttctggcaagctggcctggccaccctttctgggactcttgacataggggtgctggcatgggtatctgcaggcaggtaggagtagagggattgagaaacctgagatggagtttggtccctgagctgctgttgccaccgtgtggctttgagttgccttgaccgtaagctactaggttttcagttcctggtttgctattggaatggcttagcttggttccctagacttcccccaggtggagctggggaggaaagggccaaggtgggatgaggggcattaggaaggg

SEQ ID NO: 74203 - DNA, 601 bp, Human
tgtggacccccttgactgagtccctgccctccccagccctgcccggatgtctattggttccccatcttcacggaggtggcctgtgatgagctggtggaggagatggagcactttggccagtggtctctgggcaacaacaaggtgggaccctgatgcctgggctggggccgcagggaggctgcctctccatcagtgccgctcactgtctggggtcttctggcaagctggcctggccaccctttctgggactcttgacataggggtgctggcatgggtatctgcaggcaggtaggagtagagrgattgagaaacctgagatggagtttggtccctgagctgctgttgccaccgtgtggctttgagttgccttgaccgtaagctactaggttttcagttcctggtttgctattggaatggcttagcttggttccctagacttcccccaggtggagctggggaggaaagggccaaggtgggatgaggggcattaggaagggctgtcgggtccaagttcatcagacagcaggagcaggtggcctgctgagggtgctaggccctgtgttctctccgtgagaatcccaacacctgttcctgtcctgga

SEQ ID NO: 74204 - DNA, 601 bp, Human
ggagtacagtggcgcaatcttggctcattgcaacctctgcctcccaggttcaagagattctcatgcctcagcttgccgagtagctgggattatagacgtgtgccaccacgcccagctaatctttgtattctttatttatttaattgtgtgtgtgtaaattttttttttttttttaaggcagtgtctcgttctgtcacctaggctggagtgcagtggcatgatctcagctcactgcaaccttcctttcccaagttcaagcagttttcttgcctcagcctctccagtagctgggactacaggygtgtgccaccatccctggctaatttttgtatttttagtagacactgggtttcaccatgttggccaggctggtctcaaactcctggcctcaggtaagctacccacctcggcctcccaaattgctgggattacaggcgtgagccaccgtgtctggcctaaggcacctttttattttatttattttttttattttaatgatcccagaacatttatttccataggattttgataaaagagcacaatcttgaataaaaatacaccactgtacttaaaggcaacattacctactaagcaaactctg

SEQ ID NO: 74205 - DNA, 601 bp, Human
ccagaacatttatttccataggattttgataaaagagcacaatcttgaataaaaatacaccactgtacttaaaggcaacattacctactaagcaaactctgtccttagccctttcacagaagagaaactgcagaaaggaatttttcgtctcctgacagttttacaacattcatatctcctatgtacttcaagccccaacccacctctgattttcttttttcttttttttttttttgaatggagtctcgctgtgtcgcccaggctggagtgcagtggcgccatctcagctcactgcaacctycgcctcccaggttcaagcagttctcttgcctcagcctcccgagtagctgggattacaggcgcctgccaccatgcccgactaatttttgtatatttagtagagatgggtttcaccattttggtcaggctggtctcgaactcctgacctcatgttgtgatccacctgcctcagcctcccaaagtggtgggattacaggcatgagccaccgcaccgggcaccccacctctcattttctacgtcctttttttttttttttttggtgaagtggagcctcgctctgtcgcccaggctggggtgcag

SEQ ID NO: 74206 - DNA, 601 bp, Human
aaaaaaaaaaaattagccaggcatggtggcgcacgcctgtaatcccagctactcgggaggctgaggcaggagaatcacttgaactcaggcggtggaggttgcagtgagctgaaatgacgccattgcactccagcctgggcaacagagtgagactccgtcacacacacacaaaaataaaaataataaaaataaaattagttgggcgtgatggtgcgtgcctgtagtcccagctacacgggagggtgaggtgggaggatcacttaggcctggaaggttgaggctgcagtgagctgaagttgcrccactgcgctcttacctgtgcaacagagggataccctgtctcaaaaaataaggtctttctgcagatgactcacctagtaggtcaggcccccccaggataatctcccttttgattaacccaaagtcaactgattaggagccttaattgtatctgcaaagcctgttcagttttgtcatgtaatgtggtccggtcacattcccgggtgtaggagaggggagtagacagagcctgggggccatcctagaattctgcctaaacattcacctcggtcacctccaggacaaccgcatccagggtggc

SEQ ID NO: 74207 - DNA, 601 bp, Human
tggggggcttgggtggaagggccaggggtgggtgggggctggagagtctggcaaggggaggggctggggaaggggttgggttggagtacgggtggaggaacatcccagcttatgggagaggcctggatatttggtccccaggcaggagtgaggtctcaccgcacacaccccctccatctagtagcgtgtgggaagacagggtgctgggctgggactctagggccggctagttggcctctagcctgagctggagtctcactcagcctcatgagtagctgggattacaggcacctgccaccaygcctggctaatttttgtattttttgtagagacagggtttcaccatgttggccaggctggtctcaaattcctgacctcaagtaatccgcccacctctgcctccaaaagtgctgggattacaggcatgagccaccgtgcctggccgacctcagctcttttgaatctttcttccttgtcattaaccctgcctcagtggctcctataccagcccaccaaaaaagcacccctgcccaccttagctggccagcgtgcccactccctccctagccacaagcctgtgccccacgcctgggccctgctt

SEQ ID NO: 74208 - DNA, 601 bp, Human
ccctgtaagctgacctgcagcaggccagaccaggccccatgtgtgcaccctcctctcctggcctttgtgtcctccttaactaacacgggctctcttgtccccctgccttggtacaggcccagtttgacctggcctttgtcgtccgctacaagcctgatgagcagccctcactgatgccacaccatgatgcctccaccttcaccatcaacatcgccctgaaccgagtcggggtggattacgaggtgagcaggagccagccggggtcaaggggccggcaatggggatgaggagggctagctgrggagaggcttcagggtggttgaggcagaggggccccaggtaaccagtgccagagaaccagaaaaaaaaggatgtgggtctgtgggagggcttcctggaagggttcacagtctagcaggaggaggggccaggctcttaagctactattttaagagatttttgggctcggcatggtggctgatgcctgcaatcccagcagtttgggaggccaaggcaggcagatcacttggggccaggagtttgagaccagcctggccaacatggcgaaaccccatttccactaaaaatagaaaaattagct

SEQ ID NO: 74209 - DNA, 601 bp, Human
tttagcttctccagtcctttctcactctatccctcaccctttctgggtcactgacagtccagcttccccctgcaaagcatcctgggaaaacttgagttgtgttcccagagttgacaagtcctttctgatttcagatacgtcacactgtcaaatggaacctgcatttttaccccccttttcagctggcgttggacatctttgaggtgtcctgaagaggagggtggttatttggagactatcagtggaaatgaagagctcagctgatggctgtagatcctcacccacatggtccctcaccccygaaaggttttttttgagggctggttcctatttgataatggctccagatgatttagaagctagccactgatttcagtaaatacttctgcctccttccactcctaaccactaaaaaaggctccctctgcggatctgtttttctagaccatccttggagaaacacaggaggaggaggatgagattcttccaaggaaagactatgaggtgagctcctttgatactgcttgggcaactaaagtagtgagtggcctggtcacttcaggccgaagcattatgattccaaccagagatgctctttgac

SEQ ID NO: 74210 - DNA, 601 bp, Human
attaggtaattttccacaaccttttcttttttttgacagagtctcactcttccataaattcttcatgctgtagaatttagtgtcagcgttaggatttgtagcacttttttgtttaacttttattatgaaggatttcaactatatgcaaaaacagaataatctgttgaaaccccttgtcctcatcacacagcttccacagtgatttagctcaagcccagtcttcttttgtctgtgctttcgttatccacttctcctttctcatattattattttttattgtatgtgtgtgtgtgtttgtgtgtgtgtgtgtgtgtgtgtgtgtgtgtgtgtgtgtgtgtgttttaaagtaaagacagtctccctatgttgcccaggctgttctcgaactccttgacaccagcgatcctcccatgtcagcctcccaaagttctgggattacagtcatgatctaccatacctggccgcccttcccatgttattttgaaagaaattctgtacatcatattatttcacccataattctatatgcatctctaatggataaggacttttaaaaagcataacccaatactattaccacatctaaaaaattaggaatttc

SEQ ID NO: 74211 - DNA, 601 bp, Human
tttgagatggagtctcactcttagtgcccaggttggagtgcaatggctcgatctcagctcactgcaacctccaccccaccctaggttcaagcggttcttctgccccagcctcccgagtagatgggattacaggcgcccaccaccatgcccggctaatttttgtatttttagtagagatagggtttcaccatgttggccaggctggtctcgaactcctgacctcaggtgatactgcttcggtctcccagagtgctgggattacaggtatgagccactatacctggccattttcttctgtttygtaagtatttgttttcttgtacatagttgagaagtttgcaggaattagtataagatactccatattgttctgtcaccttgcactccctcactgaaccctgttacatcatcctgactgtatcaccaggactgagactgtctcacagccttcatcctacttctaggagctcaccaaggcttccccattgacacccaggctccctcaccccttctactaaattgtacttacatttgtaatgtgcttgccttcagctgatatgcatattcatgtaaatttttgttgttcttgtcattgtttgag

SEQ ID NO: 74212 - DNA, 601 bp, Human
cattttcttctgtttcgtaagtatttgttttcttgtacatagttgagaagtttgcaggaattagtataagatactccatattgttctgtcaccttgcactccctcactgaaccctgttacatcatcctgactgtatcaccaggactgagactgtctcacagccttcatcctacttctaggagctcaccaaggcttccccattgacacccaggctccctcaccccttctactaaattgtacttacatttgtaatgtgcttgccttcagctgatatgcatattcatgtaaatttttgttgttsttgtcattgtttgagacagagtctcactctgtcgcccaggctggaatgcagtggtacggtcttggatcactgcgacctccacccccgcctctgagttcaagctgttctcctacctcagcctcccaagtagctgggactacatgcatacaccaccatgcctggctaagttttgtatttttagtagagatggggtttcaccatgttggtcaggctggtcttgaactcctgacctcaggtgatccacccacctcagcctcccaaagtactgggattacaagcgtgagccaccacgcgtggcca

SEQ ID NO: 74213 - DNA, 601 bp, Human
acttgacacaaaaagtataataaagaggggagtgagtgggacaggttaaaatagttgatttagtggaatctcatttttgttatttaaaacacgtgttaaaagcatgtgtataaaaacgtgggtaaggatgtagaaggatatttagtaaggtattaatagtcatattttaatgaatggagttatagggttttctctaccttgatagtcagtcaactagaaaacccttctgttgaatatctttctaaaaagtgccccttcttcctgtctcaggaagagttcattgcacatatttgactctttrtttgataaatttagggtcttacaaaatgttagaatcccattttgacatccattctcattataggtggtttgaaaaatggtaactttctgtgagatgtgccattgcaaacaggaatgttttcatgcaggtcacacagtctatttatattgtacctttgaattagaaagaggcacactcagaacgtaagacttagaattaaaggcctcccccactggccatagcagcacccctagctcacaaccagttgaaggtggttttggtgtgaacactaagatgccccttcctggttgaattggggct

SEQ ID NO: 74214 - DNA, 601 bp, Human
cctttgaattagaaagaggcacactcagaacgtaagacttagaattaaaggcctcccccactggccatagcagcacccctagctcacaaccagttgaaggtggttttggtgtgaacactaagatgccccttcctggttgaattggggctggttcagcccccacctccctcccggccaggtgccattttgctcgtaaccccctgtaacagccctgcaagacacagataacattttatttttttaaaaagttgttagtcccctaaaccaaagagcaacatatactgcagaaataaaaagttartcatagcaaaggagaagtaacagtatctggttttaataatagctcatatattccattggtacatatttacaaagggccaaactcaactaatttatttaaaaaaaaaagaagcgtggcacagtggctcacgcctatatgctcagcactttgggaggccaaggcaggaggatcgcttaaagccaggagttcaagaccatcctgggcaataaagtgagactttgttcctacaaaaaaatttgttcaaaattagcagggggccgggtgcagtggcccacacctgttacccccacactttaggag

SEQ ID NO: 74215 - DNA, 601 bp, Human
attcacagagttgtacaaccattcctacagtcaatttttttttttttttgagacggagtttcgctcttgttgcccaggcaagagtgcaatgttgtgatctcagctcactgcaacctctgcctcccgggttcaagtgattctcctgcctcagcctcccaagtagctgggattacaggcgtctgccaccacacccggctaattttgtatttttagtagagacgaggcttctccatgttggtcaggctggtcttgaactcctggcctcgggtgatccgcccgccttggcctcccaaagtgctgrgattacagacgtgagccactgcgcccagctaattcctacagtcaattttagaatattttcatcacctgagaggaaaccctgcactcattagcagccactgcctgttctccttgcccctgactccaggcaaccagtgatctcctttctgtctatttgcctattctagatatctaaaaaccttctaaatgtttacggaaccatatcattattagatggaaccatcaatgaagtacttgaccagtaatttccatacatattttggatgaaggcaagggtattgtttctcctctgctctcaggc

SEQ ID NO: 74216 - DNA, 601 bp, Human
tccaaacggttcagctgtctggaagctctctgaaccttgtcattttggagttttatggaagcttttttatgcagtcatgattgattacatcaccagcccttggtgatcagcttaaccttcagcttcggtctcctccctggagggatgggtgtcccaccccgctaatcctgccttggtctttctggtgaccagccccttttctgaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtgtattgttggggctcagaaaatgatacctggaaatatggtgctttgatatgctgaactctccaccctcacactttgtctctcccaaagcacaggatgaggctcttctctgccgttcccttatctacctagaaactggacctaccagagaggaacacagttgtctttgatccctttcctgaaatgtcattaaccagggaacattaaaactcatcttacagaggagactgaagaccaaacaacatacctagagcctggacaaact

SEQ ID NO: 74217 - DNA, 601 bp, Human
caaacggttcagctgtctggaagctctctgaaccttgtcattttggagttttatggaagcttttttatgcagtcatgattgattacatcaccagcccttggtgatcagcttaaccttcagcttcggtctcctccctggagggatgggtgtcccaccccgctaatcctgccttggtctttctggtgaccagccccttttctgaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtgtattgttggggctcagaaaatgatacctggaaatatggtgctttgatatgctgaactctccaccctcacactttgtctctcccaaagcacaggatgaggctcttctctgccgttcccttatctacctagaaactggacctaccagagaggaacacagttgtctttgatccctttcctgaaatgtcattaaccagggaacattaaaactcatcttacagaggagactgaagaccaaacaacatacctagagcctggacaaactgt

SEQ ID NO: 74218 - DNA, 601 bp, Human
gattctcctgcctcagccaccctagtagctgggattacaagtgtgtgccaccacacccacctaatttgtgtatttttggtagagacggggtttcgccatgttggccgggctggtctcaaactcttggcctcaagtgatccacctatctcggcctcccaaactgctggaattacagacgtgagccatcacgcccagccgatcattttttaaaatataaaaaagcacaccatttgtgctatgagaatttcagacaacacccagaaacaaatatctccttaagcactacctcacggatgttttyccattatgaatgctgacgtacaaataatcctaattttgtttaatcaaaaagggatattatacttttaattctccatcctgctttatttttattttttaattgcatcttgctcttttgctgaataatttttggagattttccatatctttctatatagacttaactataatcattttattggtgtatagtttactatatttggatgtataattgatttactcagtcacttgttggtactccaggactcataaaaaaagaatttggactaactctaggtagtcatatagatagaataaattg

SEQ ID NO: 74219 - DNA, 601 bp, Human
accctagtagctgggattacaagtgtgtgccaccacacccacctaatttgtgtatttttggtagagacggggtttcgccatgttggccgggctggtctcaaactcttggcctcaagtgatccacctatctcggcctcccaaactgctggaattacagacgtgagccatcacgcccagccgatcattttttaaaatataaaaaagcacaccatttgtgctatgagaatttcagacaacacccagaaacaaatatctccttaagcactacctcacggatgttttcccattatgaatgctgacktacaaataatcctaattttgtttaatcaaaaagggatattatacttttaattctccatcctgctttatttttattttttaattgcatcttgctcttttgctgaataatttttggagattttccatatctttctatatagacttaactataatcattttattggtgtatagtttactatatttggatgtataattgatttactcagtcacttgttggtactccaggactcataaaaaaagaatttggactaactctaggtagtcatatagatagaataaattgtcactcatcacatgtgtt

SEQ ID NO: 74220 - DNA, 601 bp, Human
aacaggaagtttaaaaataggtaatttaaaacttctcctaaagcatgaagtatgaacctaaagcaacaccactcaaattttaatgtgcatctgagtcatctggggctgcagggctgcaggagtctaagattctgcattttgtttttgtgtttgtttttgaaacggagtctcgctgtgtcacccaggctggagtgcagtggtgcgatctcggctcaccacaacctccacctcccaggttccagtgattctcctgcctcagcctccaaagtagctgggactacaggtgcgcgccaccatgccyggctaattttgtatttttagtagagacagggtttcaccatgttggctagactggtcttgaactcctgacctcaggtgatccacctgccttgacctcccaaagtgctgggattataggcatgagccaccgcacccagccagattctgcattttgaaccagctcctcctgggtgctgcaggtaccactgctctgcccatccacacgttgagtagcaggaacccagaggtttgtccctttgcaggtcttctcacctgacatgaccttttgactcaactttgcctcttttcagagtttggatta

SEQ ID NO: 74221 - DNA, 601 bp, Human
ctttatttcacctcgcaggtactgcaggttttacaaactggaggttggtggcaaccctgtgttgagcaaggtgccatttttccaatagcatgcattttgtttgcattttttagccataaagtattttttaattaaggtaggtacatttttgtaggcataatgctattacacactttatagacctcagtatagtgtaaacatcacttttatatgcactgggtaaccaaaacactcgtgtgactcactttattgtgatatttgctttattgtggtggtctagaaccaaacccatgctatctgyaaggtaggcctatgttggcatttattccctaggcctttatcctgccaaccagagttccccctgtcagtgcaccttgcccagcctcttaagagtccatcatttttgcactgtaaagcacctgaaatcccaacatcatctttactgtgcctgctctccacgtggaatttagcttaaaactggttggccaagatgtatttcttcccctctgccaccataaccctgtaaactgaatcattcttttcctgtgtgaacagaaaggtcgaagatatgaggcggtgaagtggatggtggtgtttgcca

SEQ ID NO: 74222 - DNA, 601 bp, Human
actacaggttgagtgttccttatcagaaaatccaaaatgctccaaaatccaaaactttttgaatgctgacacgattctcaggaaatactcattggcgcattcagattttggatttcaaatttttggatttgggatgtttaatcagtataatgtagatattcgaaaaaaaaatctgaaatccaaaacacttctggtcccaagcatttcagataagtgttactcaagctgaagcaactttacctcctacctttgtattttaggaaggcacacctgcctttatgacatagcactcccaactctygtccattgatgtgtggccactttatggcttcagtatcaaaaagcctccaggcattggcttgagggaaggccagagttaaaggcaagaagctttgatcctgaatccataaaattagaagtctttctagttctcctttaagccctgagcactttggagagtggaatactggaatttggttgttttctctacccagagtaactatggactataagatggttataagtcaagcctggcacagtggggtgtgcctgtaatcccagctacctgggaggctgaggcaggaggatctcttaaaccctg

SEQ ID NO: 74223 - DNA, 601 bp, Human
tcaatggctgggtgcagtggctcatgcctgtaatctcaggactttgggaggccgaggcaggcagatcacctgaggtcaggagttcaaggccagcctggctaacatgacaaaaccccatctctactaaaagtacaaaaaattagctgggcatggtggcgggtgcctgtaatcccagctacttggaaggctgaggtgggagaatcgcttgaacccgggagacagaggctgcagtgagccgagatcgcgccattgcactccagcctgggcaatgagagcaaaactgtctcaaaaaaaaacaacaaaaaaaaaaaacaaacaaaatcaataaatttgaccacatcaaagtacatattgtatttataaagacaaaaactccaaataacaacaataaaacaccataaataaagtgaaaacaagtccacagcctgagagaggttatttactatgcatttaagaggcagataattagtatccacaatacaggaagaggctgggcgcggtggctgacgcctgtaatcccagcactttgggaggccgaggcaggcggatcacttgaggtcaggagttcaagaccagcctggccaacatggtgaaaccctgt

SEQ ID NO: 74224 - DNA, 601 bp, Human
ctacttggaaggctgaggtgggagaatcgcttgaacccgggagacagaggctgcagtgagccgagatcgcgccattgcactccagcctgggcaatgagagcaaaactgtctcaaaaaaaaacaacaaaaaaaaaaaacaaacaaaatcaataaatttgaccacatcaaagtacatattgtatttataaagacaaaaactccaaataacaacaataaaacaccataaataaagtgaaaacaagtccacagcctgagagaggttatttactatgcatttaagaggcagataattagtatccasaatacaggaagaggctgggcgcggtggctgacgcctgtaatcccagcactttgggaggccgaggcaggcggatcacttgaggtcaggagttcaagaccagcctggccaacatggtgaaaccctgtctctactaaaaatacaaattgagctgagtgtggtggtgtgcacctttagtccagatacttgggaggcagaggcaggagaatcacttgaacccaggaggcggaggttgcagtgagccgagattgcaacactgtactccagcctgggtgacagaatgagactctgattcagaacaaa

SEQ ID NO: 74225 - DNA, 601 bp, Human
tcccaggtgatgctcattcacagggaacttgtacagattctggggggaggaaaaaagggggaaagggctgaaaacaaaactgttgggtgccatgcgcactacctgggtgacaggatcattcatgtcccaaacctcagcatcatgcaatataccctcgtaacatacctgtacatgcaatccctgaacctaaaataaaagtggaaattatttttctttaaaaagtgcaagtctggccactttgggaggccaaggcgggcagatcacctaagatcgggagtttgagaccattctgaccagtgtrgagaaaccccgtctctagtaaaaatacaaaattagccggtaaaaatacaaaattagccgggcgtggtggcgcatgcctgtaatcccagctactcgggcgactgaggcaggggaattgctggaacccagaaggcggaggttgcaatgagtggagattgtgccattgcactccagcctgggcaacaagagtgaaactctacctcaaaaaaaaaaaagaaaaaaaagtgcaagtcctcccattgcccctcagacctcctgagtcagatcctctggagtggggcccagcagctgtggttctgca

SEQ ID NO: 74226 - DNA, 601 bp, Human
ggaaattatttttctttaaaaagtgcaagtctggccactttgggaggccaaggcgggcagatcacctaagatcgggagtttgagaccattctgaccagtgtggagaaaccccgtctctagtaaaaatacaaaattagccggtaaaaatacaaaattagccgggcgtggtggcgcatgcctgtaatcccagctactcgggcgactgaggcaggggaattgctggaacccagaaggcggaggttgcaatgagtggagattgtgccattgcactccagcctgggcaacaagagtgaaactctayctcaaaaaaaaaaaagaaaaaaaagtgcaagtcctcccattgcccctcagacctcctgagtcagatcctctggagtggggcccagcagctgtggttctgcaagccctccaggtgacgctcacgctgctaatgaaggtggccagctctccctcttccgccgcccagattgttgagggtaagccagagaaccaatggatttcgagttatgggtgtgcctgctctcctccatcagccggtggcagcaggttccgggatacccgaggtcaaatgctatctgaatggcgtaaaggtgccaggaat

SEQ ID NO: 74227 - DNA, 601 bp, Human
ctgggggtaggcagggttatgttttgaatttctgagaccagagcttctttctgtggcgttgtaacagctgtgctttgcctcctagagtcttagagagcctccttgtgtctctggtaaccaccgtggtggtgtttgtggcctcgatggtgttaggagaatgccgacagatgtcctcttcgagtcaaatcggtaatgactcattccagctccaggtaaccccagtgcacctgctacctttatcccataccacgaggaagaatccagaaatgtatgaccttcctctgttgagaactaatagatrtgttgggttcatccttccacacccattacctgagcgttgagagatatgggaatctgtagtcgtctttttacctcagagaaagtgcacaccacatgccctgtgtctttgccacttctgtgaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcatcacagag

SEQ ID NO: 74228 - DNA, 601 bp, Human
tatttgcatgcacagtgataggtgtgaagtacaaccttgtaccgttgtacactgtcaactagaaaataaaacagcacacttgaaacacccttgccttctagcaaagatcccatcttcccacacagaatgatggcaagaaaatgaggtctaaaatgtgtagaagtagtagaagaaataatctctttttctgtttgggttttgttccccagatggggtctagaaggagaggcagcctggaggactgggtctgctctccaggcattatggaggtgggttttcttttgcagcaaattcaggtgcttttttttttttttgtagcaaattgcagcaaaatcaaaggctttttctatttggaaccagagttggggctttcggtcaagtggtgccctggattttcctccccagatacctgtcaactcccagtcacttgctctcacctgcctcatattcccccagtcctagggctctcaggccaggcttctagcagcatcacttagaaagttagcaccgggagaggaagcagaaccaaattcacggtgaatcacggccatagtgacattttcatcatgagtgtggatgaacaaaaggccctcatcccgat

SEQ ID NO: 74229 - DNA, 601 bp, Human; identical to SEQ ID NO: 74209

SEQ ID NO: 74230 - DNA, 601 bp, Human; identical to SEQ ID NO: 74210

SEQ ID NO: 74231 - DNA, 601 bp, Human; identical to SEQ ID NO: 74211

SEQ ID NO: 74232 - DNA, 601 bp, Human; identical to SEQ ID NO: 74212

SEQ ID NO: 74233 - DNA, 601 bp, Human; identical to SEQ ID NO: 74213

SEQ ID NO: 74234 - DNA, 601 bp, Human; identical to SEQ ID NO: 74214

SEQ ID NO: 74235 - DNA, 601 bp, Human; identical to SEQ ID NO: 74215

SEQ ID NO: 74236 - DNA, 601 bp, Human; identical to SEQ ID NO: 74216

SEQ ID NO: 74237 - DNA, 601 bp, Human; identical to SEQ ID NO: 74217

SEQ ID NO: 74238 - DNA, 601 bp, Human; identical to SEQ ID NO: 74218

SEQ ID NO: 74239 - DNA, 601 bp, Human; identical to SEQ ID NO: 74219

SEQ ID NO: 74240 - DNA, 601 bp, Human; identical to SEQ ID NO: 74220

SEQ ID NO: 74241 - DNA, 601 bp, Human; identical to SEQ ID NO: 74221

SEQ ID NO: 74242 - DNA, 601 bp, Human; identical to SEQ ID NO: 74222

SEQ ID NO: 74243 - DNA, 601 bp, Human; identical to SEQ ID NO: 74223

SEQ ID NO: 74244 - DNA, 601 bp, Human; identical to SEQ ID NO: 74224

SEQ ID NO: 74245 - DNA, 601 bp, Human; identical to SEQ ID NO: 74225

SEQ ID NO: 74246 - DNA, 601 bp, Human; identical to SEQ ID NO: 74226

SEQ ID NO: 74247 - DNA, 601 bp, Human; identical to SEQ ID NO: 74227

SEQ ID NO: 74248 - DNA, 601 bp, Human; identical to SEQ ID NO: 74228

SEQ ID NO: 74249 - DNA, 601 bp, Human; identical to SEQ ID NO: 74209

SEQ ID NO: 74250 - DNA, 601 bp, Human; identical to SEQ ID NO: 74210

SEQ ID NO: 74251 - DNA, 601 bp, Human; identical to SEQ ID NO: 74211

SEQ ID NO: 74252 - DNA, 601 bp, Human; identical to SEQ ID NO: 74212

SEQ ID NO: 74253 - DNA, 601 bp, Human; identical to SEQ ID NO: 74213

SEQ ID NO: 74254 - DNA, 601 bp, Human; identical to SEQ ID NO: 74214

SEQ ID NO: 74255 - DNA, 601 bp, Human; identical to SEQ ID NO: 74215

SEQ ID NO: 74256 - DNA, 601 bp, Human; identical to SEQ ID NO: 74216

SEQ ID NO: 74257 - DNA, 601 bp, Human; identical to SEQ ID NO: 74217

SEQ ID NO: 74258 - DNA, 601 bp, Human; identical to SEQ ID NO: 74218

SEQ ID NO: 74259 - DNA, 601 bp, Human; identical to SEQ ID NO: 74219

SEQ ID NO: 74260 - DNA, 601 bp, Human; identical to SEQ ID NO: 74220

SEQ ID NO: 74261 - DNA, 601 bp, Human; identical to SEQ ID NO: 74221

SEQ ID NO: 74262 - DNA, 601 bp, Human; identical to SEQ ID NO: 74222

SEQ ID NO: 74263 - DNA, 601 bp, Human; identical to SEQ ID NO: 74223

SEQ ID NO: 74264 - DNA, 601 bp, Human; identical to SEQ ID NO: 74224

SEQ ID NO: 74265 - DNA, 601 bp, Human; identical to SEQ ID NO: 74225

SEQ ID NO: 74266 - DNA, 601 bp, Human; identical to SEQ ID NO: 74226

SEQ ID NO: 74267 - DNA, 601 bp, Human; identical to SEQ ID NO: 74227

SEQ ID NO: 74268 - DNA, 601 bp, Human; identical to SEQ ID NO: 74228

SEQ ID NO: 74269 - DNA, 601 bp, Human; identical to SEQ ID NO: 74209

SEQ ID NO: 74270 - DNA, 601 bp, Human; identical to SEQ ID NO: 74210

SEQ ID NO: 74271 - DNA, 601 bp, Human; identical to SEQ ID NO: 74211

SEQ ID NO: 74272 - DNA, 601 bp, Human; identical to SEQ ID NO: 74212

SEQ ID NO: 74273 - DNA, 601 bp, Human; identical to SEQ ID NO: 74213

SEQ ID NO: 74274 - DNA, 601 bp, Human; identical to SEQ ID NO: 74214

SEQ ID NO: 74275 - DNA, 601 bp, Human; identical to SEQ ID NO: 74215

SEQ ID NO: 74276 - DNA, 601 bp, Human; identical to SEQ ID NO: 74216

SEQ ID NO: 74277 - DNA, 601 bp, Human; identical to SEQ ID NO: 74217

SEQ ID NO: 74278 - DNA, 601 bp, Human; identical to SEQ ID NO: 74218

SEQ ID NO: 74279 - DNA, 601 bp, Human; identical to SEQ ID NO: 74219

SEQ ID NO: 74280 - DNA, 601 bp, Human; identical to SEQ ID NO: 74220

SEQ ID NO: 74281 - DNA, 601 bp, Human; identical to SEQ ID NO: 74221

SEQ ID NO: 74282 - DNA, 601 bp, Human; identical to SEQ ID NO: 74222

SEQ ID NO: 74283 - DNA, 601 bp, Human; identical to SEQ ID NO: 74223

SEQ ID NO: 74284 - DNA, 601 bp, Human; identical to SEQ ID NO: 74224

SEQ ID NO: 74285 - DNA, 601 bp, Human; identical to SEQ ID NO: 74225

SEQ ID NO: 74286 - DNA, 601 bp, Human; identical to SEQ ID NO: 74226

SEQ ID NO: 74287 - DNA, 601 bp, Human; identical to SEQ ID NO: 74227

SEQ ID NO: 74288 - DNA, 601 bp, Human; identical to SEQ ID NO: 74228

SEQ ID NO: 74289 - DNA, 601 bp, Human
attcagtgtgaattggactgagagcactgccatacgcgggaggcgctctttagcccgcctacctgcgggcccgtcggggtcctgggcagatcaggtgaggccgtgggagtagtgggcaggccagatggggcctcccttagccatgggaggttggtcgtccgcgctctaccctgttgtgtgcgcggtcccgtttgcccccttcctaagctggccactggctggagggtcaaggaaaggagggagagttggctgtgggtgagagtggggtgagggtgcaggaccaccgggattagcttccccratccgcgtccggcaaagcaacgctgtggattgaattcgctggagcacgtggtgggcatttgcccctggaagaaggtcagtggtggggctgaagtctatggtgggttgcctcagaattgagtttggggactgctttaggaaaactgagcacttaccagtggccagcgccaaattaatcactgtggggagaatgcaaagtaaccaggcgtgtttcacggagcccaggggctgctggagagagaggccctcagctgacccaggaccccggtggacccctgcatagaaccatagtaggtgcgag

SEQ ID NO: 74290 - DNA, 601 bp, Human
tgctcccactcatatctgacttagactcgtttcttgagcagattgtgattcattctaaggtttttatactccctcatcacccttcttcacatcaggacaatcatcagaaggaaaatggggctgaaggatgactgtgtctggcccgggggagtcctggaggcttgagggtccttggcaatgacagtagatcagcccagcctgggccagcttgtccagccggtgcactgaccctgggtgtggcccatctgggatcacagtcctcatttcacagacaaggattcagtgcagaggcccagaggtrggggagagtcttgcctacagttccaggactggtcggggtagagcccaccacagactagacacgcagaatgtcaaaaaaaggcagctctcggccataccagttctccacttctctctctcccctcccaggtccacccaggggatactggggtgggggtgggggaccttcttccggtatctatggttgaaaaccactgggcattctcgtggccttgctggtggggagggactttttatacatggctcagtctagttactccctgaatgcctaagtcttttggtgacatgcaagtattcatgc

SEQ ID NO: 74291 - DNA, 601 bp, Human
ttggggggagcaggcaggatgggagcaggaagccaggtcattgcattgatccaggggaggggtgagcagaggtgggaatgtgctttttcttcttttcttttctttttttgagacggagtcttgctctgttgcccaggctggagtgcagtggtgtgatctcggctcactgcaagcttcgcctcccaggttcaagccattctctcgccttagcctcccgagtagctgggactacaggcgcccgccaccacgcctggctaattttgtttttgtatttttagtagagacagggtttcaccgtgtyagccaggatggtctgatctcctgacctcgtgatctgcccgcctatgtagagacagggtctcactatgttgcccagtttggtctcaaactcccagggctcaggtgatcctcctgcctgcgcctcctattgctgggattacaggcatgagccactgtgcccagctggaatgtgctttcaagctagaatcaacaggacctgtggatgggtctggtgggagcgcagagggcaggagggaaatcagggatcctgtccgtatttgggagctcagaatctggctgcatggaggtgtcattttgggat

SEQ ID NO: 74292 - DNA, 601 bp, Human
tgggtgacagagcaagattctgtctcaaaaaaagaaaaaagtctatgataaggcagcagagctatttttcttctggatatgctgtagcaaaatgtttccttgcttttttccagtttctagaagctgcctgtgttccttggtccctggccctgcatcactctgaactctccttccatcctcacatttcctctctctcttttttttttgagctcgatctctcggctcactgcaacctccacctcctgggttcaagtgattctcctgcctcagcctcccaagtagctgggaccacaagcacccrccaccacgcccggctaatttttgtatttttagtacagacaggtttcaccatgttggccaggctggcctcgaactcctggcctcaagtgatccacctgccttggcctcccaaagtgctgggattacaagcacgtgccaccatgccagctaatttttgtatttttagtagagatggggtttcaccatgttggccaggatggtttcgaactcctgacctcaagtgatccacccattttggcctcccagagtgctgggactataggcatgagccacctttgagagacagtagagcatttcgtta

SEQ ID NO: 74293 - DNA, 601 bp, Human
tggtggatggggtagacgagaggagaccctcgggtggtcactgtcaagtccagatggcgggaaggtgaggaagagctggtagatgtgggggtaaaactgcaggttaaacagacagaactagtgataggttgggggccagggagaagcaagcatttcaaaaagcagtcagtctcggccaggcatggtggctcatgcctgtaatcccagcactttgggaggctgaggtgggtggctcatttgaggtcaggagttcgagaccagcctggtcaacatggtgaaaccctgcctctactaaaaatayaaaaattagccaggtgtggtgccaagcgcctgcagtcccagctacttgggaggctgaggcaggagaattgcttgaacgcgagaggtagaggttgcagtgagccgagatcgcaccactgcactccagcttgggcgacggagcgagtactctgtcttaaaaaacaaaaacaaaaaaaccctcagtctcatggggagtggggagcagggatctcagagccctgaactacagcacccccccaccccaggcagcagaagctggcggatcagagcacgtgccaaatcctggccctaacactgacca

SEQ ID NO: 74294 - DNA, 601 bp, Human
ggagggaggagggtgtcctcaaggcccggggctctggattaaataagaagggagacaactcaagcgccatgtgactattgggcaaatatcacgttcatgtattatttcaaattaatatggtgacatgtttcagacatgcaaaaaaaaaaaagaatgatgtaaccaacaccccatttatccaccttccagccacgctgctgctttctgctgcttcctgaacatgccggaagcttcactgctccctcgagtggagagaagagtcaggcagccctttaggccagccaggcctctctcctggggraaagtggcttctgcttccttccctaaaccaagaaagccccacatcgcaccaggggccacctcctttctgccaggcaccatcttggatgctgaagacatggaaatgctacaaggcttcctccctgcctcttgcctcacttcctgcttcccttctcttgcctcacttcctgcttcccttctcttgcctcacttcctgcttcccttctcttgcctcccttcctgcttcccttcttttcccttttgctccaccctagaagtttcacatcctggatcaccccagaaaagtgcaatggcgttcccc

SEQ ID NO: 74295 - DNA, 601 bp, Human
cgtttggacactaaaacgtgtgtacaggaatgttcccagcagcactatcataataaccaaaaagtggaatgtctatcgagagcaggcccggagtggtggctcatacctgtaatcccagcactttgggaggccaaggcgggtggatcatttgaggtcaggaattcaagaccagcctgaccaacatggtgaaactctctctgctaaaaatacaaaaactagctgggcatggtggcacacacctgtagtctcagttacttggcaggctgaggcacaagaatcatttaagcccaggaggtggagkctgcagtgagttgagattgcaccactgcactccaacctgggcaatagagcaagactctgtctcaacaaattaaaaaaaagagagtagactagacaaataaattgtgcatatttgtgtgatgctatactgcaaagcaatggacagaaatgagcaactgttatttgcaacagtgcgaatgattctcacaatataatgctgaattaaagaggccgattgcaggggaatggactgcgtaattctactttatgtaaaatccaaaagcagtcaacactaatagagcgatagaaatcagccttttgg

SEQ ID NO: 74296 - DNA, 601 bp, Human
gagctgcgcgggaacccaggtcagtcagttcctagacttgtggcctcaactcccccatgagatgcagaccaggctcgtgctcaggccaccaaaggacagagggaaacattcttggaaagaatttgatgtttttgtatttgattttgatttgtatttccaacaatgattcaaagtattcattgtatgggcaaaagtagtgggttggatgctattggactttcttgcttttatttttggtttagtgttgattttgaatgatctattaggtgggtcccctggttttttcagtgcttcactggtyggccatccacccacccatccaagtacctgcccccctcacccacccacccatccaagtacctgcccacccacccatctttttaaccactcaccaacccacccctcccatcccctttccatttttcttcccatctagccactatccatccatccatctgtattagtttgctggggctgccataacaaaatactgtagtctgggtgacctaaacaatagacatttatttcttacagttctggaggcttgaaggtccaagatcaaggtttttggaggatttggtttctggtgagggctgtcttc

SEQ ID NO: 74297 - DNA, 601 bp, Human
tttaaccttaattatctcctaaaagtcctatctccaaatacagtcacactggggttagggtttcaacacatttaacatatgaactttgtgggggacacaattcagtccatagcaccatcgccttcccatatccctccaattatcctcccattcaccgcccccatccatacacccacccctctcctggccattttctcatctacctttctatccatccatccatccatccatccatccatccatccatccatccatccatccatcatccatccaacaaatttttatttctctctctctctcttttttttttttttttttttgagatagagtctgtctctgtagtccaggctggagtacggtggtgtgatcttggctcactggaacctccgcctcctaggttcaagcaattctcttgcctcagcctcctgagtagctgggattacaggcatgtgccaccacacccagctagtttttgtatttttagtagagatggggtttcaccgtgttggccaggctggtcttcaactcctgacctccagtggtctgcccgccttggcctcataaagtgctgggattacaggcatgagccactgtgccaggc

SEQ ID NO: 74298 - DNA, 601 bp, Human
gtttcaacacatttaacatatgaactttgtgggggacacaattcagtccatagcaccatcgccttcccatatccctccaattatcctcccattcaccgcccccatccatacacccacccctctcctggccattttctcatctacctttctatccatccatccatccatccatccatccatccatccatccatccatccatccatcatccatccaacaaatttttatttctctctctctctcttttttttttttttttttttgagatagagtctgtctctgtagtccaggctggagtacggkggtgtgatcttggctcactggaacctccgcctcctaggttcaagcaattctcttgcctcagcctcctgagtagctgggattacaggcatgtgccaccacacccagctagtttttgtatttttagtagagatggggtttcaccgtgttggccaggctggtcttcaactcctgacctccagtggtctgcccgccttggcctcataaagtgctgggattacaggcatgagccactgtgccaggcctagtttctgggcctttggacatgcctgtccccatgtgggatgccctcccctccgtccc

SEQ ID NO: 74299 - DNA, 601 bp, Human
ttttgcctgccctgtgcagccagcactcagctgtgtggccgggtttgcttgtgggcgggttggtggaggaaggaagctgagggacctttgagattgaaaaatgtagatgtcatcgaatccctccttgcacccaggcctgtgatgccctctccagcattcctgagagcaggtccccagccctttgcttacatactcttggtgacggggagctcattcactgactcataacaatgaccacgattcataccgatggagcacgctatgtgctggccactgtgctgggccctttaccgaccttaagttccttcaatcctgataagaaatccagagaggaaacttggacaccgaggggttcaggaatttgcacaaggccacatgcgtatcagtggctcagccgggccgtgaacatgaccaccgagtgcagtctcctgagctcttcaactgtagttgatactgaccctcaaggcctcgaatttgggaggcagaagagtttacgagtgaagagctaatgcgggggctacaaagcccttcctgttctccatcttcctggactaccctctctttgtgtgcagactcgctccccacaggaaggggtctctcc

SEQ ID NO: 74300 - DNA, 601 bp, Human
agtttccctctgttgcccaggctggagtgcagtggtgtaatctcagctcactgcaacctccacctcccaggttcaagtgattttcctgccccagcctcccgagtagctgggattacaggcacatgccaccatgccctgctaatttttgtatttttagtagagacggggtttcgctatgttggccagggtggtcttgaactcctgacctcaggtgatctgcccgcctcggcctcccaaaatgctgggattgcaagcgtgagccaccgcaccggccaagtttccccttttcatgagaacaccrgtcagattagattaggcccaccctagcggcttcattttaactggattgcctcttcagagcccctacctccaaataaagtcacatcctgaggtactgggggttaggactccagcatatatatttttttggggagacacaatttaatccataccaacattcaggatgtatgaggggtgttagagaaaagatcaagatacccagactggctgtagtagagagtgcatgaagtgagcaatgtactagaatgccagactgggaagatggagacacagtgtgaggcctgggagtgcaggctgggga

SEQ ID NO: 74301 - DNA, 601 bp, Human
tgttggccagggtggtcttgaactcctgacctcaggtgatctgcccgcctcggcctcccaaaatgctgggattgcaagcgtgagccaccgcaccggccaagtttccccttttcatgagaacaccagtcagattagattaggcccaccctagcggcttcattttaactggattgcctcttcagagcccctacctccaaataaagtcacatcctgaggtactgggggttaggactccagcatatatatttttttggggagacacaatttaatccataccaacattcaggatgtatgaggggtrttagagaaaagatcaagatacccagactggctgtagtagagagtgcatgaagtgagcaatgtactagaatgccagactgggaagatggagacacagtgtgaggcctgggagtgcaggctggggaatgccgtatgaactaggttgacagaacatgttttaatgaaatatgtgtgaggccctatgataggggaggcattggtgagtggacatagaaagactcatcctcaaggagctgacttttttttttccttgagacagggtcttgcttcgttgtccaggctggggtgcagtggcgctatg

SEQ ID NO: 74302 - DNA, 601 bp, Human
aatcacagtggtgaggaacatggagtactctgattggcctgcttgggtcatgtggcaatcctgagccaattatattgatgggaagaagtattctgattggcctgcttgggtcatgtgctcatcctggaagcaaggtaggcagcgattgctgggtgacttgtttatctcgaaatcaggctggattagggtcttagtggcaggagtgtccaatctttcggcttccctgggccacattggaagaagaagtgttagtgtggaagaagtgaatttagtctaacactaaggatagtgttttagcttrtagctgatgagctaaaaaaaaaaaaaaaaaaatcacacacacgcaaatctcataatgttttaagaaagtttatgagtttgcgttgggcctcattcagagctgtcctgggccgaatgcggctagtcgtgggttggacaagcttggtctagactttcatggtctaaagttatggctctcctaattcctgcagtgagataagacccctgcagagaatgatgacaaccggtgctcatatagtgcttgttgggtgccagggactgctgtagtactttatacatatttatcttcacagtccattca

SEQ ID NO: 74303 - DNA, 601 bp, Human
ggaacatggagtactctgattggcctgcttgggtcatgtggcaatcctgagccaattatattgatgggaagaagtattctgattggcctgcttgggtcatgtgctcatcctggaagcaaggtaggcagcgattgctgggtgacttgtttatctcgaaatcaggctggattagggtcttagtggcaggagtgtccaatctttcggcttccctgggccacattggaagaagaagtgttagtgtggaagaagtgaatttagtctaacactaaggatagtgttttagcttatagctgatgagctaaaaaaaaaaaaaaaaaaatcacacacacgcaaatctcataatgttttaagaaagtttatgagtttgcgttgggcctcattcagagctgtcctgggccgaatgcggctagtcgtgggttggacaagcttggtctagactttcatggtctaaagttatggctctcctaattcctgcagtgagataagacccctgcagagaatgatgacaaccggtgctcatatagtgcttgttgggtgccagggactgctgtagtactttatacatatttatcttcacagtccattcagtcctttcaagaac

SEQ ID NO: 74304 - DNA, 601 bp, Human
tcaagaacactaggaggtgggtcctattactaacttaatagtgctaaatatatacacgtactatgtaccctcacacacacacacacacaaatagtgctgacaaggtcattatcacgcaattggcaaatggcagccctagaatcccaggcccagctcttctctataactatgttgcttttccttgcctgctaggggaccttaggcgagggttgcccctcctgggtgtcagtgcttccatccataacacaagaattggactgacagttttcgggggttggaggtggagctgggaggggcgtcmgggatgagaggtgtggggcattgggtcataaggcctttgctaagtcagcctggcttggagcttctctgtttcttttcccagggctgttcccgacacagcagtgcccacagaggcctactgactgcaggaagcagtgtgagcctgactactacctggatgaggccgaccgctgtacagcctgcgtgacttgttctcgaggtaagggccttgttctctctccagggcctccttctagggagcatgaggggtcctcagaggagaggtgaagaatctggaaggtggagagcatcatgatttgat

SEQ ID NO: 74305 - DNA, 601 bp, Human; identical to SEQ ID NO: 21313

SEQ ID NO: 74306 - DNA, 601 bp, Human; identical to SEQ ID NO: 21314

SEQ ID NO: 74307 - DNA, 601 bp, Human; identical to SEQ ID NO: 21315

SEQ ID NO: 74308 - DNA, 601 bp, Human; identical to SEQ ID NO: 21316

SEQ ID NO: 74309 - DNA, 601 bp, Human; identical to SEQ ID NO: 21317

SEQ ID NO: 74310 - DNA, 601 bp, Human; identical to SEQ ID NO: 21318

SEQ ID NO: 74311 - DNA, 601 bp, Human; identical to SEQ ID NO: 21319

SEQ ID NO: 74312 - DNA, 601 bp, Human; identical to SEQ ID NO: 21320

SEQ ID NO: 74313 - DNA, 601 bp, Human; identical to SEQ ID NO: 21321

SEQ ID NO: 74314 - DNA, 601 bp, Human; identical to SEQ ID NO: 21322

SEQ ID NO: 74315 - DNA, 601 bp, Human; identical to SEQ ID NO: 21323

SEQ ID NO: 74316 - DNA, 601 bp, Human; identical to SEQ ID NO: 21324

SEQ ID NO: 74317 - DNA, 601 bp, Human; identical to SEQ ID NO: 21325

SEQ ID NO: 74318 - DNA, 601 bp, Human; identical to SEQ ID NO: 21326

SEQ ID NO: 74319 - DNA, 601 bp, Human; identical to SEQ ID NO: 21327

SEQ ID NO: 74320 - DNA, 601 bp, Human; identical to SEQ ID NO: 21328

SEQ ID NO: 74321 - DNA, 601 bp, Human; identical to SEQ ID NO: 21329

SEQ ID NO: 74322 - DNA, 601 bp, Human; identical to SEQ ID NO: 21330

SEQ ID NO: 74323 - DNA, 601 bp, Human; identical to SEQ ID NO: 21331

SEQ ID NO: 74324 - DNA, 601 bp, Human; identical to SEQ ID NO: 21332

SEQ ID NO: 74325 - DNA, 601 bp, Human; identical to SEQ ID NO: 21333

SEQ ID NO: 74326 - DNA, 601 bp, Human; identical to SEQ ID NO: 21334

SEQ ID NO: 74327 - DNA, 601 bp, Human; identical to SEQ ID NO: 21335

SEQ ID NO: 74328 - DNA, 601 bp, Human; identical to SEQ ID NO: 21336

SEQ ID NO: 74329 - DNA, 601 bp, Human; identical to SEQ ID NO: 21337

SEQ ID NO: 74330 - DNA, 601 bp, Human; identical to SEQ ID NO: 21338

SEQ ID NO: 74331 - DNA, 601 bp, Human; identical to SEQ ID NO: 21339

SEQ ID NO: 74332 - DNA, 601 bp, Human; identical to SEQ ID NO: 21340

SEQ ID NO: 74333 - DNA, 601 bp, Human; identical to SEQ ID NO: 21341

SEQ ID NO: 74334 - DNA, 601 bp, Human; identical to SEQ ID NO: 21342

SEQ ID NO: 74335 - DNA, 601 bp, Human; identical to SEQ ID NO: 21343

SEQ ID NO: 74336 - DNA, 601 bp, Human; identical to SEQ ID NO: 21344

SEQ ID NO: 74337 - DNA, 601 bp, Human; identical to SEQ ID NO: 21345

SEQ ID NO: 74338 - DNA, 601 bp, Human; identical to SEQ ID NO: 21346

SEQ ID NO: 74339 - DNA, 601 bp, Human; identical to SEQ ID NO: 21347

SEQ ID NO: 74340 - DNA, 601 bp, Human; identical to SEQ ID NO: 21348

SEQ ID NO: 74341 - DNA, 601 bp, Human; identical to SEQ ID NO: 21349

SEQ ID NO: 74342 - DNA, 601 bp, Human; identical to SEQ ID NO: 21350

SEQ ID NO: 74343 - DNA, 601 bp, Human; identical to SEQ ID NO: 21351

SEQ ID NO: 74344 - DNA, 601 bp, Human; identical to SEQ ID NO: 21352

SEQ ID NO: 74345 - DNA, 601 bp, Human; identical to SEQ ID NO: 21353

SEQ ID NO: 74346 - DNA, 601 bp, Human; identical to SEQ ID NO: 21354

SEQ ID NO: 74347 - DNA, 601 bp, Human; identical to SEQ ID NO: 21355

SEQ ID NO: 74348 - DNA, 601 bp, Human; identical to SEQ ID NO: 21356

SEQ ID NO: 74349 - DNA, 601 bp, Human; identical to SEQ ID NO: 21357

SEQ ID NO: 74350 - DNA, 601 bp, Human; identical to SEQ ID NO: 21358

SEQ ID NO: 74351 - DNA, 601 bp, Human; identical to SEQ ID NO: 21359

SEQ ID NO: 74352 - DNA, 601 bp, Human; identical to SEQ ID NO: 21360

SEQ ID NO: 74353 - DNA, 601 bp, Human; identical to SEQ ID NO: 21361

SEQ ID NO: 74354 - DNA, 601 bp, Human; identical to SEQ ID NO: 21362

SEQ ID NO: 74355 - DNA, 601 bp, Human; identical to SEQ ID NO: 21363

SEQ ID NO: 74356 - DNA, 601 bp, Human; identical to SEQ ID NO: 21364

SEQ ID NO: 74357 - DNA, 601 bp, Human; identical to SEQ ID NO: 21365

SEQ ID NO: 74358 - DNA, 601 bp, Human; identical to SEQ ID NO: 21366

SEQ ID NO: 74359 - DNA, 601 bp, Human; identical to SEQ ID NO: 21367

SEQ ID NO: 74360 - DNA, 601 bp, Human; identical to SEQ ID NO: 21368

SEQ ID NO: 74361 - DNA, 601 bp, Human; identical to SEQ ID NO: 21369

SEQ ID NO: 74362 - DNA, 601 bp, Human; identical to SEQ ID NO: 21370

SEQ ID NO: 74363 - DNA, 601 bp, Human; identical to SEQ ID NO: 21371

SEQ ID NO: 74364 - DNA, 601 bp, Human; identical to SEQ ID NO: 21372

SEQ ID NO: 74365 - DNA, 601 bp, Human; identical to SEQ ID NO: 21373

SEQ ID NO: 74366 - DNA, 601 bp, Human
ctggacagcgggttttctgattttgaattctgtttcctatattacactctacataacctttggcaggttatataattctgtgtgcctcagttttctcatatataaaatgggagtgattaataatatctatcttataggtttattgtgaggattaaatgattcagtatttgcgaggcattcagagtggtgactggcacataattagtggtatataaatattttttcccatggaaacattcctcttcaataaagaaaacatgttctgtagtgcacatcctcaaatgctcagtactgctttggraaggaagcaaataaaaacaaacatattcttccacagtccttttccacatcttatttaaacgtatgactcactagcattttcttcttttacctattctgctcctgtggtgggagtgacagataaaatgaattgtccttcctaaaactggagtcaaatctgaagtcagatggcaagtctttgttttatctttccttttcatgaaagaacaatagtttcaaatgatagtttaagcatccctagcaaaatgcagtcataccagcaacttgccagatgtctctgattaatttgcctgtgttccac

SEQ ID NO: 74367 - DNA, 601 bp, Human
attcccatgagcatcaaagagcagggtttaacaatgaaatgttgaaaacaatcaaaacttacaaagaagtttatctgacacactcaatgacaggcataattatcattgtgttgcatggtaattaggtataaaaggcaaacagttcctttaaatgtctctaattagtactgctcttaaatcttcaaaccaagtagttgaggagtcagcggcagggaaacctgctcctataacacaatgctcctcaatggtggcttcatatgagaatcagcaggggagcttttaatatacatatatatatattcgcacctataatccatatgcccagggctcttgcctcaaatcaatttagttagaatacctgggggttagacccaggcatcagtacttcttattacaggtgattacaatgtaaacttaagattaaggattacagctgtaaacaacaacatggaagagagttgaagttgtcccttccctctatatttccacagcactaggaacatgctctactgaaggctcatcaattaatcaatcaattaggtaattaacaagtattgattaacaatgatcaattaatgtttgttacaagaatttgacatag

SEQ ID NO: 74368 - DNA, 601 bp, Human
tcaccattgttaattatcaaggaaaagaaaactaaaaggacactgagacaccacaaaatgtccagcagaatggccaaaatgaaaaagactgactgaatgctgttgaatgcatgaagtcatttaatacacatatgtgttggtgggagtatatatttgtttaatcattttggaaagttatttggccatctatattaaacttggatataatgtactacccagtaacttcactcctaggtttatacccatcataattcatatacaagacatgtacaaaaatgttcatggcagcattattcataamtgctaaataccagaattaaccaaatgcctataaatcatagaatgattaaattgtatatagtcatacaggaaatactatatagcaatgacaattagtgaacctctgttacatacaataacataaatgaatctcactctaggaacaaaagaagccagagtctttagagtacacactccgtacttccattaaataaatttcaacaacaggtaaaaagtactatgtctgataaaagtagtgcaaatagtagctccctttaaaagggaagataatgggtagaaattgaaagagggcatgaggggc

SEQ ID NO: 74369 - DNA, 601 bp, Human
cataaaaaccctagaagaggcaataccccattcaggacataggcatgggcaaagacttcatgactaaaacaccaaaagcaatggtaacaaaagccaaaattgacaaatgggatctaattaaactaaagagcttctgcacagcaaaagaaaatgtcatcagaatgaacaggcaacctacagaatgggagaaaaagtttgcaatctttctatttgacaaagggctaatatccagaatccccaaataactgaaacaaatctacgagaaaaaaaataactccatcaaaaagtgggtgaagaataygaatagacacttctgaaaagaagacatttatgcagccaacagacatgaaaaaaagctcaacatcactggtcattagaaaaatgcaaatcaaaaccacaatgagatgccatctcatgccaggtagaatggtgatcattaaaaagtcaggaaacaacagatgctggagaggatgtggagaaacaggaacacttctacactgttggtgggagtgtaaattaattcaaccattgtggaagacagtgtggcgattcctcaaggatctagaaccagaaataccatttgacccagcacacccattac

SEQ ID NO: 74370 - DNA, 601 bp, Human
tttgtcttattttattattgctacatcttcagaaataataaaaatgtcaacacacacaaaaaaaaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcgtattctcactcataggtgggaattgaacaatgagaacacatggacacaggaaggggaacatcacactctggggactgttgtggggtagagggagkggggagggatagctttaggagatatacctaatgctaaatgacgagttaatgggtgcagcacaccagcctggcacatgtatacatatgtaactaacctgcacgttgtgcacatgtaccctaaaacttaaagtataataagaataataataaaaagaaaaaaaacagacagagagccaaatcatgagtgaactcccattcacaattgctacaaagagaataaaataccaaggaatacaacttacaagggatgtgaaggacctcttcatggagaactacaaaccactctgcaaggaaataaga

SEQ ID NO: 74371 - DNA, 601 bp, Human
gtagcataaagcatttaaaatgtcgtttctgtatgttctggccccatccctagaatgagttctttctgaagagaaagattttgtcttatttaatctttttgtcttattttattattgctacatcttcagaaataataaaaatgtcaacacacacaaaaaaaaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccrcgtattctcactcataggtgggaattgaacaatgagaacacatggacacaggaaggggaacatcacactctggggactgttgtggggtagagggagtggggagggatagctttaggagatatacctaatgctaaatgacgagttaatgggtgcagcacaccagcctggcacatgtatacatatgtaactaacctgcacgttgtgcacatgtaccctaaaacttaaagtataataagaataataataaaaagaaaaaaaacagacagagagccaaatcatgagtgaactcccattcacaat

SEQ ID NO: 74372 - DNA, 601 bp, Human
aagctttataagcaaaggagaaataaaatcctttacaaacaagcaaatgctgagagattttgtcaccaccaggcctgccttacaagagctcctgaaggaagcactaaatatggaaaggagaaaccagtaccagccactgcaaaaacataccaaattgtaaagaccatcaacactatgaagaaaccacatcaactaatgggcaaaataaccagctagcatcatgactggatcaaatttacacataataatattaaccttaaatgtaaatgggctaaatgccccacttaaaagacacagacttggcaaactggatagagtcaagacccctcggggtgctgtgttcaggagatccatctcacatgcaaacacaaacacaggctcaaaaaaagggatggtggaatatttaccaagcaaatggaaagcaacaaaaagcaaaagttgcaatcatagtctctgataaaacagactttaaacctacaaagatcaaaaaagacaaagaagagcattacataatggtaaaggaatcaatgcaacaagaagagctaattatcctaaatacatatgcacccaataaaggagcacgcagatcaataaagcaagt

SEQ ID NO: 74373 - DNA, 601 bp, Human
aagaaagagcaatggaaaatataaatctatgggtgattaaagaaagcttgtatttattaaaaagcaataataataccttgtgcggtgtaaaatatgtaagaaataaatgtagaaaacagccaaaactgcaggggagggaacaataaatggagttaacacaatttaaggtccagcaattgataaaagtactaatctatgttaaaagtttagtaagttaaggatgcatgccataatttatagtgaggcctacaagatcagtcaaagaatgtttaactagaaagctaacaaggataggccgggygcagtagctcatgcttgtaatcccagcactttaggaggctgaaggcaaatggatcacctgaggtcaggagtttgagaccagcttggccaaccccatctctactaaaaacacaaaaattagccaggcatggtagcagccacctgtaatcccagctactcgggaggctgaggcaggagaattgcttgaacccgggagtcggaggttgcagtgagctgagatcgcaccattgcactccagcctgggcaacaagagtgaaactccatctcaaaaaaataaaattaaataaataaataaatgaat

SEQ ID NO: 74374 - DNA, 601 bp, Human
accgtgaagagctccagacagaagaaatatgatctcagatggaaactggcagatgttagaaggaagaaagagcaatggaaaatataaatctatgggtgattaaagaaagcttgtatttattaaaaagcaataataataccttgtgcggtgtaaaatatgtaagaaataaatgtagaaaacagccaaaactgcaggggagggaacaataaatggagttaacacaatttaaggtccagcaattgataaaagtactaatctatgttaaaagtttagtaagttaaggatgcatgccataatttatagtgaggcctacaagatcagtcaaagaatgtttaactagaaagctaacaaggataggccgggcgcagtagctcatgcttgtaatcccagcactttaggaggctgaaggcaaatggatcacctgaggtcaggagtttgagaccagcttggccaaccccatctctactaaaaacacaaaaattagccaggcatggtagcagccacctgtaatcccagctactcgggaggctgaggcaggagaattgcttgaacccgggagtcggaggttgcagtgagctgagatcgcaccattgcactccag

SEQ ID NO: 74375 - DNA, 601 bp, Human
cagaaataacagaagccagaacacagtagcatatcttaaaagcgcttcaaagagcctatttcaatatctttacccagtgaaaatcaccttcaaaaatgaaggcaaaaagaagatattttcaaaatgtttttccattggcaacagacttgtaaccgtgaagagctccagacagaagaaatatgatctcagatggaaactggcagatgttagaaggaagaaagagcaatggaaaatataaatctatgggtgattaaagaaagcttgtatttattaaaaagcaataataataccttgtgcggtrtaaaatatgtaagaaataaatgtagaaaacagccaaaactgcaggggagggaacaataaatggagttaacacaatttaaggtccagcaattgataaaagtactaatctatgttaaaagtttagtaagttaaggatgcatgccataatttatagtgaggcctacaagatcagtcaaagaatgtttaactagaaagctaacaaggataggccgggcgcagtagctcatgcttgtaatcccagcactttaggaggctgaaggcaaatggatcacctgaggtcaggagtttgagaccagcttgg

SEQ ID NO: 74376 - DNA, 601 bp, Human
ttttttaaataggaaatatttgtcatgacatcagaagttaccaggcatactaagagaaaagcccaaatgactaaggacagagagaaaaaaagacaatagaaacagaaccatagtagatcaatatattgcagctatcaggtacaactttaactgtaagcaatatgctttcaggacaaatggagatgtcagtagaaaacgtgaatatttaaagaaatcaaatggaaattctaaaactgaaaaacacaatatctgaagcttgacacgcaaaagatcagtttgcaatccgataaaatgcagctgmtaataattagaaactaattataggcagctagaatatatttatagaagattggagagaatctaggatgcaaaacaaagcaaaacaaaaaactaaaaatcaaaacataagagatatatgaggcataatagagaagttgaacatacgtataatctgggaccctgaagaaagagaaataattgagctgaaacaatatatgaaggaatcatatttaagagttagcttaaatcaggcagagtgcagtgcctcacgcctgtaatctcagtactctgggaggctgaggtgggcagattacaaagtcaa

SEQ ID NO: 74377 - DNA, 601 bp, Human
tcagattattcttgctaaaaaaaaatttaaaaatggatttcatgttcatccaattcatttttatccactaaagccaactcacttaatatatattgagaacatatctttgctaggtaattctcttagtacaactggtagaactgtgaacaatatcaagaagctccagctttcgcagactttatatgttagtataatattccagtcagtgtttcctcaatgcccacatatactaattttccaaagtatgttccaagaacactgtttctttataagcaaaagtgtgctaagtttaagcaacttkggaaatttaaaatgcacacttcaaagaagtcttgctgtaaacaaatctctttaaaccagtatttctggagcttcaatgtcctctttatttctttcttttttggtttaacttctttcttttggttcttcatttctttttggtttaacttcattcattcaacatccaacattccatggaagtactcaaaaagactcttttgtccatagaaaaaaaaaatcaatatcctacaacccagtatttactattttctacaacatggctccaatctatccatctagtacttactccctaaaacaaatt

SEQ ID NO: 74378 - DNA, 601 bp, Human
tattttcttggacttaagcttctagccgattttccctaaaatccaactgtattatatcatcagattattcttgctaaaaaaaaatttaaaaatggatttcatgttcatccaattcatttttatccactaaagccaactcacttaatatatattgagaacatatctttgctaggtaattctcttagtacaactggtagaactgtgaacaatatcaagaagctccagctttcgcagactttatatgttagtataatattccagtcagtgtttcctcaatgcccacatatactaattttccaamgtatgttccaagaacactgtttctttataagcaaaagtgtgctaagtttaagcaactttggaaatttaaaatgcacacttcaaagaagtcttgctgtaaacaaatctctttaaaccagtatttctggagcttcaatgtcctctttatttctttcttttttggtttaacttctttcttttggttcttcatttctttttggtttaacttcattcattcaacatccaacattccatggaagtactcaaaaagactcttttgtccatagaaaaaaaaaatcaatatcctacaacccagtattta

SEQ ID NO: 74379 - DNA, 601 bp, Human
aaagttttcaaacaaaaggtaagacttcatgaaattaaataattctttcatgactctatccatcatatctttaggctacatgaagaaaacagaatgaagtcttgtacaaagaaatttcttcttccctacagtgactcaaagctattcaaattatttgagtgccttgagaagttccatctaatctattactaaatcgtatcaatttgttttaaaaagtatcactgttatccattttatttcccattttcaaggatggcaccacagtccaagaacaaatcttaggtctggacaactttaaaaktttattttcttggacttaagcttctagccgattttccctaaaatccaactgtattatatcatcagattattcttgctaaaaaaaaatttaaaaatggatttcatgttcatccaattcatttttatccactaaagccaactcacttaatatatattgagaacatatctttgctaggtaattctcttagtacaactggtagaactgtgaacaatatcaagaagctccagctttcgcagactttatatgttagtataatattccagtcagtgtttcctcaatgcccacatatactaattttcc

SEQ ID NO: 74380 - DNA, 601 bp, Human
gctggtgatctttttctacacaaaaagttttcaaacaaaaggtaagacttcatgaaattaaataattctttcatgactctatccatcatatctttaggctacatgaagaaaacagaatgaagtcttgtacaaagaaatttcttcttccctacagtgactcaaagctattcaaattatttgagtgccttgagaagttccatctaatctattactaaatcgtatcaatttgttttaaaaagtatcactgttatccattttatttcccattttcaaggatggcaccacagtccaagaacaaatyttaggtctggacaactttaaaattttattttcttggacttaagcttctagccgattttccctaaaatccaactgtattatatcatcagattattcttgctaaaaaaaaatttaaaaatggatttcatgttcatccaattcatttttatccactaaagccaactcacttaatatatattgagaacatatctttgctaggtaattctcttagtacaactggtagaactgtgaacaatatcaagaagctccagctttcgcagactttatatgttagtataatattccagtcagtgtttcctca

SEQ ID NO: 74381 - DNA, 601 bp, Human
tcaacgtatataaaacaatcttttatatactataaatagaataatacatgtttattaatttgtttagatagacaacttctgcctcacacttaaggccccaaaggaacaagaataaaagcaatacttagattatcaggaactacaatgccaatgaaggaatgacaaccatcattgttgtcaacaacatgtcaacaacatcaacaaatagaaagcattcctccattcatcactccttctgggtaagccagttttaacttttttccctaaaactcaaaaagttgtgccagaatgtgacaaaacrttctataactttaatccctgtttagataattttttgcttctatatacaaaagagaaaaaaattgagtagtcattataagatctatacattacaaaaataaatcatttgcctatctaaccattataatcttcccaacttgtaagcatgttcaaattaccacagatgaaggaaaccatttaaataattctaaaaacaccggttttaattgtaagatatgtcatttgatttgtgtgttggtcaaaagtacctaaattatctttttaaatcattggtataaaaccaaaacatcttccagaacca

SEQ ID NO: 74382 - DNA, 601 bp, Human
ccctaaaaacttgaaggctggctaaattaagactataactcattaattaagtagaatgattccttgggaatgactgtataattttaaaggtgcctacaaagatatatacggcaaataataatcataaaattggcatgttcaaataatcaacgtatataaaacaatcttttatatactataaatagaataatacatgtttattaatttgtttagatagacaacttctgcctcacacttaaggccccaaaggaacaagaataaaagcaatacttagattatcaggaactacaatgccaatgawggaatgacaaccatcattgttgtcaacaacatgtcaacaacatcaacaaatagaaagcattcctccattcatcactccttctgggtaagccagttttaacttttttccctaaaactcaaaaagttgtgccagaatgtgacaaaacgttctataactttaatccctgtttagataattttttgcttctatatacaaaagagaaaaaaattgagtagtcattataagatctatacattacaaaaataaatcatttgcctatctaaccattataatcttcccaacttgtaagcatgttcaaat

SEQ ID NO: 74383 - DNA, 601 bp, Human
actcttcttttgctttgaacaaatacaaacaaaaccttaaccaactaaaagcataagcaaaaaagatctaagttcttagaggaaaaaaaagtgatggggtaatatctcctttccttaaagaattagtctttccttttcctaattcactgctaagtagctctgtatcatctctgtccatcccttcattcagcaaaactgatccgagtacctatgttgtgctgggaactgttccaagtgccagagccatagagaggacaaaagagaagatatccttagcctgatagaatttatactagcaagraaaaaaaacactcagttctggctccaaatcctagaggttagacatgcaatttaaaatttctcattagctaaattctattctatcaaagccacttagtggtagtgtccagttgatatcatgaatcttaatgcatttcaagtttttatcttgaaattggttatggctcattgtgcctgagcaatgctgaagaattatatggaatatcaaaagttaaagctaaatatgcttttactatttgctattcatgctatgtttcataaagggaatatttttaattatcaaattaatttgctcaaccag

SEQ ID NO: 74384 - DNA, 601 bp, Human
ccccaaatgtggtccacatagggatggaggacagcaatttctccccttggaacacctctagtcgaccctctatcaagcagaattttaaaaaacacacacacaaataatcgaaatccgtgtagatactataaattagtaaaataaaacaatcataaagcacacaaagtatacaggtaagatattttatgattctcattataatacaccagttaaaagtgtagactgaaatcacctctgccacttactattagctgggttgccttgagaaacttacgctatctgtctgaagttcctcatcaaygatgaggataataataattattattattattttacagtggcaagaatgaaataagttaatctaggtaaggaatttagaacaatggctagtgcatagtaaatgctgtgtgttagctattattaatattattatttttacaatgttattttcctgaagcagtggatggcaagtgttttgtttaaaattcattataacctatgagaaatgtaatacatgaaactatttctcttttatgaggagctcaacaatcactgtatgtcataaaaacacagagaaattgttcacaatgatggaatgaca

SEQ ID NO: 74385 - DNA, 601 bp, Human
tatgatttaaatgttgaaagagctcatagagatatggcccaccactccattattttgtagatgaagagatgatatgctaaagcctaccacaattcattgacagctggtagagtgacagaggcagaaccacaagccctaatctccagactttggactagtgaactttgtacaacacctggctgccccacctttagctcaatggttcataaactgtagcgaaatctacaattatttcaactttcttatggctctggatttaaccgttaggatgacaggaaaaaaaaaaatcctggtttatgcragtgttggtaaggactacaagaaagactagacttgaaaaaagtgattaaaatggaaaattcccaaagaaagaggcagacggttgcaaactctaaacattcataactaaaccagtgcttcttagactttaataagcataaaaatcccaccattagagtgttaggtgtggatctgggggccccaacttgagtttccgattcagtaagtgtggggtggtgcctgggaatatgccttctcatcggcaccacaggcaatctgactaagggcaaaggtgctccacactacaccctcatcccagcct

SEQ ID NO: 74386 - DNA, 601 bp, Human
cccatttttactgtaaacaaaatgttcattctgtgataatctagcaaaatgctagagcctgagtacctgtaaatacaatatataaaaccagaaggaaattccaaagtgacagaggacaaagaaaatgaaggaaggcaatgacttccttagagcctttaatttgcagctacaaatcttctttataagtatcttgcaaaaagcaaatgaaatcctcattaaaaagaagtattggaagtactgatgatatacaaccagatgtatagtacacacacacacacacacacacacacacacacacacacacctctgtgcattatgtgactatgtaccaagtgtgtcggttaaaaaattgtttacagttagttatttatgttgttactagttaatctttgttttccaagtacaagagtttagaacacctcagaagttttaaggcaagcacacctggatcaggtgggcccagtcagccattcgggcatgtagcacctgattggttattttcaaagaaccagatactacaaaatgaaaaacaacagaagttatttctatttgggtgagccaatcatatagaattctatgatttaaatgttgaaagagctca

SEQ ID NO: 74387 - DNA, 601 bp, Human
taatgatttgctcagctgtttcctacatcttctggacctctgtttcattttctgtaaaattaagattatatttactactacacctaatgttgtttgaggactagttaagacggtgtatctaaagtacctgatggaatgtttagtgcacaccaggtacccggtgactgttaatcttacgaaagaggctgtaagctggtcacgaaagtcttccagaggaatatatgattgtccaggtaagttacacttgccagccttcctgctgttagctatggccatgtgatgaacttttatctaaaataawctgagtggaagtgatctgtgacaattccacaccaagcccatgcatgctttcatgcatgtgtctttatactttttccccaattataatggcatggcccacacaaacctggaaaaccacatgttgaaaatggcagagtagacatcagcttggattcccaaatgactgtgtggagccaattgggactatctttcctggacagttatgttaacgagtgacaaacttctgttttatttaagcaatgatatttggcgtgtctttgcctcatagtttgcttactcaaacccttcatcccttcccaat

SEQ ID NO: 74388 - DNA, 601 bp, Human
ttgcctgaaatagtaggagcatctaaaatatagtaaatgcacaattaattgttgccatgctaagaaggaggatgataatgatttgctcagctgtttcctacatcttctggacctctgtttcattttctgtaaaattaagattatatttactactacacctaatgttgtttgaggactagttaagacggtgtatctaaagtacctgatggaatgtttagtgcacaccaggtacccggtgactgttaatcttacgaaagaggctgtaagctggtcacgaaagtcttccagaggaatatatgaytgtccaggtaagttacacttgccagccttcctgctgttagctatggccatgtgatgaacttttatctaaaataatctgagtggaagtgatctgtgacaattccacaccaagcccatgcatgctttcatgcatgtgtctttatactttttccccaattataatggcatggcccacacaaacctggaaaaccacatgttgaaaatggcagagtagacatcagcttggattcccaaatgactgtgtggagccaattgggactatctttcctggacagttatgttaacgagtgacaaacttctg

SEQ ID NO: 74389 - DNA, 601 bp, Human
tggacacaggaaggggaacatcacactctggggaccattgtggggtggggggaggggggagggagagcattgggagatatacctaatgctagatgacgaattagtgggtgcagcgcaccagcatggcacatgtatacatatgtaactgacctgcacattgtgcacatgtaccctaaaacttaaagtataataataataaaaaataaataaataaataaaaagataatgtaagatcaagtggagacacataattgaagacataaagaaagcagaactccttttgtctttgaaatgagtattmcacacctgttttagcatttgtttggttgttgtttttgcctattgaaactgtaagcttttcttacattgcagtcataaactgtagaaaagtaaggagacttttgctttattatctgcacttatgttttcttctttcacagagtaaattcacctggaatactgaatttcaggcatggggtccaaagatataaagagaaatgagagccaggcaacaatcaccagctttcacctgcataatctaaatataaactgtttggtgatcagcaacattctaaaaattgagtctgggctctagaaaaag

SEQ ID NO: 74390 - DNA, 601 bp, Human
ttaccggctataaagtggtaaagaagaattcagcttatctttaaatcccacttttaaattgctacataatagctaaaactttatttttttggttttctttaaaaactaagagatttgtgatttttaaagactcaaatttgtcttcaggtaatatctgaacactttttctttgctctgtacttatgtaaacctgatctacaaatcagcagaattggggtttcataggcaaaggttaagaagataaatgaacaggaatactattccttttccaaaagcatacagttgaaacaaatgcatttartcatatgtaaattttaactgatttcttaaataattccaagtattaacttgaaaacatagataattccaataaagtgtgttgctctaactttaacttaatattttataaagttatttatatttaggaaaatgcatttgatcagacttgaggttttatgagttccaggaaatgcaaagtgtccctcgagccatttaattaacttttaaaaatatttcttccataaattagatcaacagtaaataaactcatacctcaagactgaaggttgtggtaaaaattgcaaatatactattttgagtt

SEQ ID NO: 74391 - DNA, 601 bp, Human
cccaaaaactgctgcttttaaacatcataatttatatccccccaaaaaaagatttgaaatgtgccccagtagaggttatgtacacaaagaattcagaggagaagaagataattgcactgggaacagagaagaataagtgactacaaatgtttatggaatctcattctgagctttgtgaaagtcaaaataaaatagctctcctctgatcaaaggagaactattcactaacaagaaggcaaaactgaaattaacttatcagagaaatgtattggaaaaacagtcaagtaattagcataagatmaaccaatcattaataaaataaaaaagtagtttcagtgccatatcacccaattaattaaatactaaaatactttcatttcaaagtgtaaagtgtatatttttccattaaaatctctgaaattagagcatgtcttaaaattgataaattgtagtgtaattagcagcattttctttttcttaggtgtatataatatagcagtgcatcttataattgacatcttgcaattatatatgatccaatggtagcaaatttaattacctaatgaatgccagtgggtatcaggtaaagtacttctttaca

SEQ ID NO: 74392 - DNA, 601 bp, Human
taggaaagtcaattttcactataattagaaattaaacatccacttttattagggaatgtactaactttgtatgaaaacaccaccatcacttacacctcccaaaaactgctgcttttaaacatcataatttatatccccccaaaaaaagatttgaaatgtgccccagtagaggttatgtacacaaagaattcagaggagaagaagataattgcactgggaacagagaagaataagtgactacaaatgtttatggaatctcattctgagctttgtgaaagtcaaaataaaatagctctcctcygatcaaaggagaactattcactaacaagaaggcaaaactgaaattaacttatcagagaaatgtattggaaaaacagtcaagtaattagcataagatcaaccaatcattaataaaataaaaaagtagtttcagtgccatatcacccaattaattaaatactaaaatactttcatttcaaagtgtaaagtgtatatttttccattaaaatctctgaaattagagcatgtcttaaaattgataaattgtagtgtaattagcagcattttctttttcttaggtgtatataatatagcagtgcat

SEQ ID NO: 74393 - DNA, 601 bp, Human
agagttggcatccaaagattacctttatctgaacacacttcacacttttctagtcctatgtttttgcttgagggttttatttcacctagggtgactttgacatttcctctttgcctagaaaagtcctgttaatactttaaatcccttttccacacctaaaaattaaaataaaaccttgaccactttactgcatagtgattgctcctctttttgaacacatgcttgggagccaactggcatggtgggaagcatggggaaatgagttagaaagcctggacagggacggctccaacacagggascactgctggggaaattatgtaacctacctgggactcattttgtatctgtagaggagagaattaaaataactctaagtgatattaagaattattgttaacatttcaggcatgttagccttattgtggtcatgcattacatgtaatacttagcttttagaaatgcaactaaaatgtatagataaaataattttatgttgggaatttgcttaaaaatagtgtggagatagcaggaagtggtaaaggggtatagataaggcataaattgatcattgtttaacttgcattatgggttcatgatac

SEQ ID NO: 74394 - DNA, 601 bp, Human
ttgattacttccaatgcttccctgcttctaactccaacaatccatcttgactggtaattattagggtacttcttttccctactacaaaatagtatccttcttaaaagtaaagaccatgctttaatcatctttgtaacattttaagtacctagtacacagtagaatgaaaagagtgagtttacctcaaaatacctaaaattaataagccagagccacctcaatattgtgctgtctcaacttactgcctctacccatttacttgacaaccaatctatatttactttattaagcacatattacmtactgtgcagggtatttttcctttcccctccagatctattctctactcttttctagcctgttctatggactgacctttgtcgactgaagagtagtgagacataaaacaggatggctatgaattttctaatctccaatagttgaaattttctgttaaaaaggaaacactcttactttgttttacttttatttattctatacttcaccattattttgctggctattaaactaactgcagtattactgtaaacaaatcttattttctaaatagaggtgagatgggtgctataggtctctagaa

SEQ ID NO: 74395 - DNA, 601 bp, Human
taggtttcttctcagtgtggaaattttttttaactaaaaatatatatacctcaaaaaagctgttaaaaaacaaccatgaaaagcagtcaatgaatgggaatgaaacaaggaagccacttcctttgctgcatgtacaggagaatgccacattgacaatctttcccacgttttgctagttttatcagatcttgaagctttgcatggctgaaccaaaataactgctttgtgaaatatgaaaagtacatttcttactttatgtctaagtaatatccatttttttctcttttaattaaggtttacyggtctgggttacatattcataaattattaccacaaaaggccttcagcgtaaaaattgcaaaaacatatgaagtactgattgaatattctaatttaattcaaatttaagttttctaagaattttgactatatggctttgatagcactatctagtgaacatgtgcttaagcattcactctaaaaaaatgtttcagcaaacaactttcaaataattttcatttaacaaaagtagagttttctagtacacacaaaaaattaatcactattactacatttagagacctacccaaccccctcctcc

SEQ ID NO: 74396 - DNA, 601 bp, Human
cttaatttcttattagatgctttgttagtttccttccatatctgttagatcttttttgagtttctgatccttgctcattttttaaccctctcttagttttaaaacatattagatgtatttattttatagtctgtatctgattactccaataaatgaggcacttatgtgtctgcttctgctctttttgtttctggaaatgaatgcctatggtagcttttttcctcatacattcatgttttttaatgctggcttatgttccctagaactttagatccagtagttctttgtgtcctgagttgasagtatattcttccagaaagaatatacattgattcttgggaacttgggcatgccaccaacatagattcatttcatttaaattcttgcttagatttttccatccttgaagactgggcacccaacctccactaagaccaacctgtggccaagaattcttagggataggtttctattcctctaccaagagccaataatgagaaaagcatgtttctttgcatgtaatctgtcattacaaatttgatatttttttcttgtttcctatttctccagcagtttaatgtatgtgattcctggtttcatg

SEQ ID NO: 74397 - DNA, 601 bp, Human
taaggcagtcctcgtagtgacaaaatctttcggcatttgcttctctgtaaaggattttatttttcctcgttttgggaattttcagcctttttgtgctgttttttcctcacttacatggatttatctacctttggtattagatgttggtgaccttcagatggggtttttgggtggaagtcctttttgttgatgttgatgctattcctttctgtttgttagttttccttctaacagtcaggcccctctgttgcaggtctgctggaggttcactccagaccccgtatgcctttgtattaccagrtgaggctgcagaacagcaaagattgctgccttttccttcctctggaagcttcatcccagaggggcacctgccagatgccagctggagctctcctgtatgagatatctgttgatacctgctgggaggtgtctccccggcaggaggaacaagggtcagggacccacttgaggaggcagtctgtcccttagcagagctcgagctctgttctgggagatcccctcctctcttcagagctggcaggcaggaatgtttaagcctgctgaagctgcacccacagccacgccttcccccaggtgctct

SEQ ID NO: 74398 - DNA, 601 bp, Human
attttttaaatgtatttgacaatagttttttgcctgaagagttaagtccatttacatatactggatctcttttctgtttccttaatttatgctttctctttgattatttttggattttctgtttcctttgcggccttcttttaaaataacattttctcaaaaaaagaatttgatccttctattttaattcccattatacccactctcagtttgcatgctactgttgttcagttatttcaccttttttacattttaatattatctattggaataattattactttatgccataattttttawcatggtaacatgtttaccatttctttgtggtcaccactccttgtggcatatcagatccttcatcagggatcatttttcttctctcttaagcatatcctttgtatgtagaagtaaacaccctttatctttgtctgaaaatgtctttctttcaccctttctgaaagacagtttccctggacatggagtttttcatttactttttttcagaactttaaattctactgcattctagcttctattgttgctgttgaggtgtcagctgaaagcttaatttttattcctttatatataaactatctt

SEQ ID NO: 74399 - DNA, 601 bp, Human
ttgcatggtaattttaagttctttaagaaattgccacactgctttccacaatagctgaactaatttacaatcccctcagcagtgtaagtgttctcttttctctgcaaccctgccagtatgttattttttgattttgtaatgttagccattatgactggtgtgagatagtatctcactgtggtttttatttgcacttctcccatgattagtgatgttgagcatttttttcatatgcttgttggccacatgtatgtcttctttgagacgtgtctgttcatgtcccttgccaatttttaaatgkgattgcttttcttcttgtcaatttgtttaagtttcttatagatcctggatgttagacttgtgtcagatgcctagtttgcaaaaattttctcccatctgtaggttatctatttaccctgttgttactttttttttttttttttttttttttgagacagggtctcactcagtcacccaggctggagtgcagtggcatgatcttggctcactgcagcctcaacctcctgggctaaagcaatcctcccatctcagcctcccaagtaggcaaaactacaagcgtgaacaaccacacccagctaat

SEQ ID NO: 74400 - DNA, 601 bp, Human
ccctatagcatttgcaacacagatgttcaacctgtgtttggtgaaaaaaaaaaaagaattgaatgaagagataatcattaacgtcagttttagtaagacataatgaggtttaggaaggtcatggatacttgtctatagtaaaatttgaaccaggttcaaagggaatcttcttatataaattgatgaggaagtagaaggtgtttaagtgagaagcaacagcatgtgttaagcacattggtgagagaaacttaactgtcaagtacagctaataatggtctggctaataatggtctggcaatamaaatatggtttgagttggtgattatttttaattttcaatttaaaaaataattgatacatacaaaataatgtgacacataaacaagttataaagcatgagaataaaaacacccctgcacctaccaacagtttaataactaaacagaaccaacacagaagccttctgtcttcctcccacagtgccctcttgctcactgcccagaggtcccactaccctgacttttgtgttcaccgtttgcttgcattgatttctaatttatccacaaatctagtatccttaaatactttatagtttttttaa

SEQ ID NO: 74401 - DNA, 601 bp, Human
ctttaaaaaccatcatacacaatgtctgcaccctacacattttggcagtcgaaagcaaagtcagggtaatatcatgccaactttgtctgggctctatacacttcttgtctctcaggaaggtgagtggtgggcagtatctacgttaacttacttattcggaaaacatacattcagcacccagtcaaggtcaggctttctgctaggcctatagatacaaagttaactctcagacttcagtgcattagcaaaatgtacacaaacatgattaatattatatcatgttatacatgattaatattayatcatgttatacatgattaatattatatcatgtaatacatgatataattgaagaaagtataaattcatagggcaaaaatcatatatgtcaagaacattagggagatgatggttggggaagatgttattagcaggtgacatctgagcttggccctgactgaggattaggaactctcccagggtaatgaatcagtgctaccgtcctccgttttcgcaaaatagacctttcctcttctctgaggccctattcaaagaactccgtgcacagaatagacagaaaaaaagctggagctacagaagg

SEQ ID NO: 74402 - DNA, 601 bp, Human
tcttcgcaaatccaaagtcaacctggtaaagaatagcaaagaaattgtgcagaaaccataaaactcatgctcctctttaagcctccctcttacctctgaaatctgctttctacaccccacccttctttttataccatgcacacacacacacacacacacaaagagagagagagagagacagacagacagacggacagacagacaaagagacagagagaccacctcgtgtattcctttgcagggtcaggtgtgtatctagttgcactgcggaaagttccatgcacatacctctctgcccacracccctagaggatatggaggaatggcttagcaaaggggatccataacaacaactttgaagctcagggcaagcaggactaaacagatgtttaattcaaaagtggtattatttgggaagaagagacaaggaagaaatgatggacacctgagcaagtaaagctccgtcatgaatgtaaaaataaaaacaaaattgagagtttgggaaatggactaatgctgagaaggggggcttaatactctggacagtctttaaaaaccatcatacacaatgtctgcaccctacacattttggcagtcgaaa

SEQ ID NO: 74403 - DNA, 601 bp, Human
atccacactgaagtcatgtcccttgttgagaatgacttcaggagctacatattctggagtcccacagaatgtccatgttttctgtccagaccctattttcttcgcaaatccaaagtcaacctggtaaagaatagcaaagaaattgtgcagaaaccataaaactcatgctcctctttaagcctccctcttacctctgaaatctgctttctacaccccacccttctttttataccatgcacacacacacacacacacacaaagagagagagagagagacagacagacagacggacagacagacaaagagacagagagaccacctcgtgtattcctttgcagggtcaggtgtgtatctagttgcactgcggaaagttccatgcacatacctctctgcccacgacccctagaggatatggaggaatggcttagcaaaggggatccataacaacaactttgaagctcagggcaagcaggactaaacagatgtttaattcaaaagtggtattatttgggaagaagagacaaggaagaaatgatggacacctgagcaagtaaagctccgtcatgaatgtaaaaataaaaacaaaattgagagtttggg

SEQ ID NO: 74404 - DNA, 601 bp, Human
aaacaattgttacaaaaacagtttcttggcctagtgtgatggctcacacttgtaatctcagcacttttggaagctgagatgagtggactgcttgagcccaggagcttgagcccagcctgggtaacacagtaagatcccatttctgcaaaaaaattttaaaaattagctgggcatggtggcatgtgcctgtagtcccatctactctggaggctgaagcaagaggattgcttgggcccagaaggtggaggctgcagtgaccagtgatcacaccacttcattgcagcctgggtgacagagtgayaccgtgtctcaacaaacaaaacaaaacaatttctcaacttctttatgacctactccttctaatatgttattccagctggtgaaaactgacatacatatctgattacctatagaagccagcatgtatctcttacaaatgcagctgacaaatttcccagagaaacaaatttttgaaatagaattcgttgtgcccaagcccttaaacaacttttctctgaatgactgaatattttctcttccttccttcagaatcttaagcaatgaatatttgaaaataattacagacaatataaaatggtct

SEQ ID NO: 74405 - DNA, 601 bp, Human
ggaaaccaaaaacattgttatgatatattcaacttatttatatattaacactattggttttttttttttttttaattttcatttccctcctatgctctggagttcagggcatttaaagttaacctttctcatgccctacccagaaaatcatttacaggtcaaacaaaacaattgttacaaaaacagtttcttggcctagtgtgatggctcacacttgtaatctcagcacttttggaagctgagatgagtggactgcttgagcccaggagcttgagcccagcctgggtaacacagtaagatmccatttctgcaaaaaaattttaaaaattagctgggcatggtggcatgtgcctgtagtcccatctactctggaggctgaagcaagaggattgcttgggcccagaaggtggaggctgcagtgaccagtgatcacaccacttcattgcagcctgggtgacagagtgacaccgtgtctcaacaaacaaaacaaaacaatttctcaacttctttatgacctactccttctaatatgttattccagctggtgaaaactgacatacatatctgattacctatagaagccagcatgtatctcttacaa

SEQ ID NO: 74406 - DNA, 601 bp, Human
tgaatttggataacattttaactcatatactttgctttcaaaaacactttcgaggccgggcatggtggctcacgcctgtaatcctagcactttgagagaatgaggcgggaagattacctgaggttagaagttcgagaccagcctggccaacatgacaaaaccctgtctctactaaaaatacaaaaatcagctgggcatagtggtgggcacctataatcccagctactcaggaagctgaggcaggagaatcgcttgaactcgggaggcagaggttgcagtgagctgagactgcctcactgcmctccagcctgggcaacacagcaagactccatctcaaaaataaataaataataaaaacactttcatatttattctattatgccatttaatttttgaaaattaaagatgactttccatgaactacttttgctatatattagtcacactggagaccttgtgttactgagctttcccactctagataataaacgagacagtcagtgtaccaactttttactaaactatatttcacttgtaaagaaaatgaggcaggaaaccaaaaacattgttatgatatattcaacttatttatatattaaca

SEQ ID NO: 74407 - DNA, 601 bp, Human
agaacaagcaggcactatcttgccaactgtgctgagaaaaccggggcaagctttagagaatcatttacatctaagctgaaatcttagaagcatactggcaacccatagctacgtttttagttctaaattatactaaattgtaatgcttttttaaaagttcaaataggaaaaaaacagcaaaatgaattttaaacaaaaaaaatccagaagtctcctattctctgataaattatttttaatggtaagtagaagttggggtaatttaaaataagaacagaggagcactttttaaaaaatgaaratggaaagaggtcatataataacacttcattatcacgactaattttctttcaaaataacaagattattataaataaattactcctattttatattgtgaaaatttatgtggcacatgagaaaattcgttacgcgtatataatgcctagtgatcaactcagggtattaaggatgtccgttgcctgagtataatacatttttgttaagtattcaattgtcctctttgaacattgaatttattccttttatcttactgtataattacctatttaacccacttcccttcagcctcccctctccc

SEQ ID NO: 74408 - DNA, 601 bp, Human
tgtgtttcttaatgtcatttattccattcttcagatttcccagcctttctgttggattttgcctaaaacaataatttgtaaaaggcaatttataataattatatttataataattataattcagaaaattttaaattaaaacttaacatctatttgttaattaattaattcattcattcattaaaaaacatgcatgaagttgctactgtagaccagacatctgagtttagggaggtgaaaagacacgacctcctccctggaggagccacagttaaattagacttcggagtgtatatatatrtatgtgtgtataaggtatgaataaatactttaaagaacaagcaggcactatcttgccaactgtgctgagaaaaccggggcaagctttagagaatcatttacatctaagctgaaatcttagaagcatactggcaacccatagctacgtttttagttctaaattatactaaattgtaatgcttttttaaaagttcaaataggaaaaaaacagcaaaatgaattttaaacaaaaaaaatccagaagtctcctattctctgataaattatttttaatggtaagtagaagttggggtaatttaaa

SEQ ID NO: 74409 - DNA, 601 bp, Human
atggtggcttgtgcctataatcccagcactttgggaggctgaggcaggtggatcatgaggtcaggagtttgagaccagcctggccaacatggtgaaaccctgtctctactaaaaatacaaaaatcagctgggtgtggtggcaggtgcctgtaatcccagctcctccggaggctgaggcaggagactcatttgaacccaggaggtggagattgcaatgagccaagatcgtggcattgcactccagcctgggcaacagggtgagactctgtcataagaaaaacaaacaaacaaacaaacaaaaaaaaaaacctaaagaataataaagacagaagtggataaaaagttaatttgctatgacttgaagatgtgattttgtaacttcttttgtaacttcagtcattcttgatacgaatttccagcatgagacaaatcactttgagattgattattataactacatctactaaaacacagataaaaagcaaagcactataaagaaaaatttgaaagtctggaaagggacctttgtggcctcctgagagaagcttttgcaagtaccacattgttctctaaatttctatatttttctgggcaaagaaat

SEQ ID NO: 74410 - DNA, 601 bp, Human
aaatttggtatatcttattaatcaactctatactctgcactcagagtctatattacatatagcaaagacaatgttgcctattaagaaggaatagacaaattaatccctacagggaaggaaattcaaaattctttattgctatgctgaggtgagaaaatcctttagcagcaatttgcatgtgcatctaatgacaatttgacagctacatttaaatgagcctcaggtaaagaagtaaaagctaagctggagcctgttaacagatatatcacttctatttcccagctatgccaaagcataacaygaagaaccttccataatgagagaaaggaagaatgtatattggaagaatggctttaattgacagagcacttgtttcctcaatatgaatagtgtgtttctgtgtcatttcatgatgagaaaagaaattgtgataacagcatggagcgctggaagaaaataaattagaatctaagacaaataatgagctttacagctgaaggcaatccaaaggatagcacagaacattagaatagtacaagcattttgattctataaaatctacatgtgtctttatctttctttccttcctatgtttcctccc

SEQ ID NO: 74411 - DNA, 601 bp, Human
tacctaatgttaaatgacgagttactgagtgcagcacaccaacatggcacatgtatacatatgtaactaacatgcacgttgtgcacatgtaccctaaaacttaaaatataataaaaaaaaagaaagagagacaaatagaaaaaagaaaaaaaaaacaaaattaaagtgactggttctctaagaaaaaaaaagttttactttagaagagactgagaaaatctgatgccaaactttagaaagaagcttttttgtttgtttgtttgtttttaactctaagaatatactgagtagagaagctacrcagcttaaagacttgtggaaggtttttaaacactcccatttggagagaaagatcaagttttctgatgttccccaccttcagctttatagcttaaaaagcactatgaaaatagaatgaaaaaatgcttctgagcatctacacaaccgaagacaccgtaaatttggtatatcttattaatcaactctatactctgcactcagagtctatattacatatagcaaagacaatgttgcctattaagaaggaatagacaaattaatccctacagggaaggaaattcaaaattctttattgctatgc

SEQ ID NO: 74412 - DNA, 601 bp, Human
gaacaatgagaacacatggacccaggaatgggaacatcacacaccggggcctgttgtggggtggggggaggggggaggtatggcatttggtgatatacctaatgttaaatgacgagttactgagtgcagcacaccaacatggcacatgtatacatatgtaactaacatgcacgttgtgcacatgtaccctaaaacttaaaatataataaaaaaaaagaaagagagacaaatagaaaaaagaaaaaaaaaacaaaattaaagtgactggttctctaagaaaaaaaaagttttactttagaasagactgagaaaatctgatgccaaactttagaaagaagcttttttgtttgtttgtttgtttttaactctaagaatatactgagtagagaagctacgcagcttaaagacttgtggaaggtttttaaacactcccatttggagagaaagatcaagttttctgatgttccccaccttcagctttatagcttaaaaagcactatgaaaatagaatgaaaaaatgcttctgagcatctacacaaccgaagacaccgtaaatttggtatatcttattaatcaactctatactctgcactcagagtct

SEQ ID NO: 74413 - DNA, 601 bp, Human
tatatcagccttcttttgagataggtgttgggagacatgactggtgcctagttttaaattagctcttagacacaagatagcagagctctgtagctatttctgagaaagattatttaatatagaatggacagatagatacaactgtattgttttaaaataccaaagcctggcagagacacaacaacaaaaaagagaattttagaccaatatccttgatgaacattgatgcaaaaatcctcaataaaatactggcaaaccgaatccagcagcacatcaaaaagcttatccaccatgatcaagygggcttcatccctgggatgcaaggctggttcaatatacgcaaatcaataaacataatccagcatataaacagaaccaaggacaaaaaccacttgattatctcaatagatgcagaaaaggcctttgacaaaattcaacaacgcttcatgctaaaaactctcaataaatgaggtattgatgggacgtatctcaaaataataagagctatctatgacaaacccacagccaatatcatactgaatgggcaaaaactggaagcattccctctgaaaactggcacaagacagggatgccctctctc

SEQ ID NO: 74414 - DNA, 601 bp, Human
taattggcacaggaggcctagctttcagtctatctcagcttttgatatgccttcttcactaagcttaataatttctagctttttatttaaagtgagagacttgagactgtttcttttacttcaatacttagaggccattgtagggttattaattggcctgatttcaatactgttgtgtctcaggaaatagggaggtctgagtagagggagagatgggaaaatgggccatcgataaagtcatcagaacacacaacatatatcgatgaagtttggcatcttatatggctgcggtttgtggtgycatcaaaattacaatactaacatcaaagatcaatgatcacagatcactataatagatataaaaataatgaaaagtgtaaaatattgtaagaattaccaaaatgtaacacagacacacaaagtgagcaaatgttgttggaaaaatggccctgatagacttgcttgatgcagggttatcacaaaccttcaattggtaaaaaataaaatatctgcaaggtgcagtaagtaaagcaaagtgggataaaacaaggtatgcctgaacctgaaacaaatgtttcctcttcctgtcaggaaagatgtc

SEQ ID NO: 74415 - DNA, 601 bp, Human
atcttgggtgtgtttgtgaaggtgttgccaaaagagattaacatttgtgttagtgggctgggaaaggcagacccacccgtaatctcagtgggcacaacctaattagctgccagtgcggctagaatataagcaggcagaaaaatgtgaaaagagagactggcctagcctcccagtctacatctttctcctgtactggatgcttcttgccctcgaacatcggactcgaagttcttcagttttggaactcagactgctctccttgctcctcagcctgcagcctattgtgggaccttgtgatcgygtgagttaataaactcccttttatatatctattccattagttctatacctctatagaaccctgaataatacatgtgtgttcactggagtaacacctttaatttccttcaagaaactttcctttggattcaaaacttgactaattggcacaggaggcctagctttcagtctatctcagcttttgatatgccttcttcactaagcttaataatttctagctttttatttaaagtgagagacttgagactgtttcttttacttcaatacttagaggccattgtagggttattaattggcctga

SEQ ID NO: 74416 - DNA, 601 bp, Human
accttgcccttttaagttatggagatggctttttttcttaaacttcatgaaccaatttctgacagcttctgacttttcttcttcagctacctcacctctctcagccttcatagagttgactagggttagaattttgctctggattagactttgggttaaagaaatgttgtgtctggtttgatctctgtaaagactactaaaatttgttccatatcagcaataagccagttttgctttcttaccatgtgcattgtgatggttaataatgagaggcaagttgattggattgaagtactgatcytgggtgtgtttgtgaaggtgttgccaaaagagattaacatttgtgttagtgggctgggaaaggcagacccacccgtaatctcagtgggcacaacctaattagctgccagtgcggctagaatataagcaggcagaaaaatgtgaaaagagagactggcctagcctcccagtctacatctttctcctgtactggatgcttcttgccctcgaacatcggactcgaagttcttcagttttggaactcagactgctctccttgctcctcagcctgcagcctattgtgggaccttgtgatcgtgtg

SEQ ID NO: 74417 - DNA, 601 bp, Human
tgccactgcactccagcctgggtaacagaatgagaccctcaaaaacattaaaattaaaaataaatactccttggttcctgggctgcagaatggatgttaacagccatgaaaatatattaatctccttgtacatttccatcagagctctttggtgactaggtgcattgtcaatgaacagtaatatttgaaagaaatattttattccgagcaggaggtctcaagagtaggcttaaaatattcagtaaaccattctgtaaacagatatggtgtcattcaggctttgttcaatttataaagcacyggcagagtagatttagcatcattcttaagggccttaggatttttagaatggcaaatgagcattgacttcaagtcaccagctgtattcctaataagagagttaatctgttcttcggagctttgaagctagatattagcttctcctctctagctaggaaaatcctagacagtatcttctttcaatgtaaggcaatttattcttcactgaaaatctgttgtttatgtagacactttcatcagtgatcttagctgaatcttctggataacttgctggagcttctatatcagcacttgcttcttc

SEQ ID NO: 74418 - DNA, 601 bp, Human
gcaagacacccatctctacaaaaaaaatgttaaaaaattatccagacatggtggcatgcacccatagttccagctactcaggaggctaaggcaggaagatcacttgagcccaggaattcaaggctgcagtaagccctaatcacaccactgcactccagcctgggtgacagtgagactctaaaataaataaataatcaaataaataaataaattgaggtcaattctttcaaaccctgctactacattatcaactaagtaagtttatgtaatatttaaatcctttgttgtcatttcaacaatrttcacagcatctttgccagaagtagattagatttcaagaaaccactttctttgctcatccataagaagcaactcctcatctgttcaagtttcatcattagattgcaacattcagttgtatgttcaggcttcaattcaaattctagttctattgatatttctaacacatctgcatttactttctccaattaagtcttcaacttcccaaagccatttatgagcgttaggatcaactttttccagactcctattgatgttgctattttaacctcctctgataaatcacaaatgtttataatgg

SEQ ID NO: 74419 - DNA, 601 bp, Human
gtagtgaatgcagaggaaactagaaaaaaaaaatgatgtctgagaaagagccagaggctagatcacgtacagctttgcaggcacagtaaggaatcaagatttctacgtgtagtgaaagaatcagaaagctctaagtaaatgacaccagctacttttcaaaagatacttctggctgctttagagataaagaaagaccacaggggccagaatgggatggtgatgcgtccctgtgattaaaggcagggagactttcagaaggctgtcacattgctctgtctgttggccataccagaagttaggmtcttccacctttctcactctcttctcatccccagacttgggtttggtttagtgcttgactggatttcctattacaagtctaagcttagcaatagaaaaggaacgaaaaacagagagcagacactagtgcattccatttcagatgctattctaaaccaaaatatcattttgccataagctgctgaaactccagtcaaaaagtgagagtcagacagcaacccagctgttttatatccctcctctgcccttgctgtaaaaccacagaagtcctctctttgttctacccattgcttttttgcat

SEQ ID NO: 74420 - DNA, 601 bp, Human
gtaactgaaacaaatgtttcctcttcctgtcaggaaagatttagttgtaccctacaagtatatcagccttcttttaaggtaggtgttgggagacatgactggtgcctagttttaaattagctcttacatacaagataccagagctctgtagctatttttgggaaagattatttaatatagaatggacagatacatacaactgtattgtttttaaatacaaaattaaagtgactagttctctaagaaaaaaaaaagttttactttagaagggactaagaaaatctgatgccaaactttagaagaaatttgtttgtttgtttgtttgttttttaattctaagaatatactgagtagagaagctacacagcttaaagacttgtggaaggttttaagatgtttttgttttgctgggaggtgacagaaaaaagtcaagtaaacaatataaattattaaattaatttcagacagtagtaagtacaaggaagataaaagagaataaagtggtagatgatgtcgggaataggaacaggttgggaagggctgcttatagctagggaagtatttgaaaaagtgatatttgaaagagccagaatgaagagaa

SEQ ID NO: 74421 - DNA, 601 bp, Human
cttgacttagttatcatgtttactttctatctccccactagaaagcaagctccatgagggcagagatttttatctatttccttttctctgtgccccagcacttggagtagtgcttgatatgggacaggggctcaataaatttttgttgagtgattgaatgactctgcaaagaaacacacttaagcagaaaaagtattttacagtaatctgtgaaaatatgggattaagaggaagttctttcatcattgcttatgcatcactcatctaaaagggctgatctgatcttcatatatttcaagtrtatatttcaagcttgatggtctagaaatataacaccaggagtcaggaggcctcatttctcttgaatagaaacaatctactctgtctctcaggatcttataataagaacatgaaatcatgctgttctatagccactgatcttttctactggcacactgaggtcagctcagccagccaaccgatatttatggaaagtcagcttggtctcaggcatcaaaaaatggccctgatagacttgcttgatgcagggttatcacaaaccttcaatttgtaaaagataaaatatctgcaaggtgcagta

SEQ ID NO: 74422 - DNA, 601 bp, Human
ttatcttacccccttagcatctatagctatctaacatactacttgacttagttatcatgtttactttctatctccccactagaaagcaagctccatgagggcagagatttttatctatttccttttctctgtgccccagcacttggagtagtgcttgatatgggacaggggctcaataaatttttgttgagtgattgaatgactctgcaaagaaacacacttaagcagaaaaagtattttacagtaatctgtgaaaatatgggattaagaggaagttctttcatcattgcttatgcatcaytcatctaaaagggctgatctgatcttcatatatttcaagtatatatttcaagcttgatggtctagaaatataacaccaggagtcaggaggcctcatttctcttgaatagaaacaatctactctgtctctcaggatcttataataagaacatgaaatcatgctgttctatagccactgatcttttctactggcacactgaggtcagctcagccagccaaccgatatttatggaaagtcagcttggtctcaggcatcaaaaaatggccctgatagacttgcttgatgcagggttatcacaaa

SEQ ID NO: 74423 - DNA, 601 bp, Human
ctcatctcaattcttccagttgctcaaaccaaagctcttgtagttgttctttgccttatatcctatctgagtccatgatcaaatcctgtcagtgctagcttcacattctatctatattcagtatctggccagtcttcaataccttcactctactagcaaggaaccagccgtacttttgtgctggagataacttagcagcaagactggtcgtttatagcataagtcaggtcacaacatgcctcggttcaatacttccccaccttttccatcttactcagtgtaaaaggcaaagtctgttccrtgtctttgctgtaacctataaggctttatagaatcattgtttctaccaccatccttccattaccttaccactgtattacttttctctttctttctcccttaactcatttatcttctcactattctcctaaccaactagggttgttcccactttaaggcctttgtactcaaggctggattgttctttctctagatttccatgtcttattctctcaacaccttcatgtcttttctcaaagttcatctcagtgagatcttccttggccatccaatctaaaattgaaactctcccccaccaaca

SEQ ID NO: 74424 - DNA, 601 bp, Human
aaaaggaatattacttggatgataaactattagcatgtcaagttatctgtcatggctttaaatagcacttatatgctaattattcccaaatttctatttccaaccaagacccctccatcagcttacaggctaaggtctacaattcttattcatcttctcactattagatgtctaataggcatctggcatgtatcatgtctgaacagaagcttaaaatgttctccaccaacctcatctcaattcttccagttgctcaaaccaaagctcttgtagttgttctttgccttatatcctatctgaktccatgatcaaatcctgtcagtgctagcttcacattctatctatattcagtatctggccagtcttcaataccttcactctactagcaaggaaccagccgtacttttgtgctggagataacttagcagcaagactggtcgtttatagcataagtcaggtcacaacatgcctcggttcaatacttccccaccttttccatcttactcagtgtaaaaggcaaagtctgttccgtgtctttgctgtaacctataaggctttatagaatcattgtttctaccaccatccttccattaccttacca

SEQ ID NO: 74425 - DNA, 601 bp, Human
atgtttaaaggaatgaagtaacagtagtgtttttattattattattattattattttttgagacggagtcttgctctgtcatccaggctggagtgcagtggcgtgatctcggctcactgcaagctccacctcctgagttcacgccattctcctgcctcagcctcctgagtagctgggatgacaggtgcccgccaccatgcccggctaatttttttttatttttagtagagacagggtttcaccatgttagccaggatggtctcgatctcctgacctcgtgatccgcccgcctcggcctccyaaagtgctaggattacaggcgtgagccaccatgcctggcctagtgttttattttaaaatgtcaatatttacaacatactggaaatcatattctccacaactacactttgatgaaaaaaagtcagatagcaatctaccaatgtataagaggaaatatagatctttgcaatcttttggaaaaaacactaacataaacttagtagtatgttgacctagatcattcctgagtcattcttcctcccatgttagctgaagttctgctgcctctagagctgcactatccaataacaaaaccattagc

SEQ ID NO: 74426 - DNA, 601 bp, Human
agaatgaaaatatgatgatatgatgaaaaggagtgatacaatatttctgcccaaactttataagtggcagataggtattaaatctcaatggtatttagattatagtagacatgtttaaaggaatgaagtaacagtagtgtttttattattattattattattattttttgagacggagtcttgctctgtcatccaggctggagtgcagtggcgtgatctcggctcactgcaagctccacctcctgagttcacgccattctcctgcctcagcctcctgagtagctgggatgacaggtgcccrccaccatgcccggctaatttttttttatttttagtagagacagggtttcaccatgttagccaggatggtctcgatctcctgacctcgtgatccgcccgcctcggcctcctaaagtgctaggattacaggcgtgagccaccatgcctggcctagtgttttattttaaaatgtcaatatttacaacatactggaaatcatattctccacaactacactttgatgaaaaaaagtcagatagcaatctaccaatgtataagaggaaatatagatctttgcaatcttttggaaaaaacactaaca

SEQ ID NO: 74427 - DNA, 601 bp, Human
atttcatactgcagccacttggaagttacatacaagaaaaaaatgaccaattatcattcttgagtcctagtctcagcctcatgagatcttctctttacaaccaaatagatttggtcaccagataacattcaatagtaactacctggcatgaagagttttcctaaagaaaaagttcagaaataggccaggcgctgtggctcacgcctgtaatcccagcactttgggaggccaagacaagcagatcacctgaagtcaggagttcgagaccagcctggccaatgtggtgaaactccatctctaytaaaaatacaaaaattagtttggcatggtggcacacacctgtgatcccatctactttggaggctgaggcaggagaatcacttgaacctgagaggtgaaggttgcagtgagctgagatcacaccactgcactccagcctgggtaacagagtgagactttctctcaaaaaaaaaaaataagtgacagaaatgatgtctatttatttttttaattgaaaactcttttaaaatcaaaatctgctagcgttcttcttccattatataagtttctcaccaatcctgaaatttttatggttaattga

SEQ ID NO: 74428 - DNA, 601 bp, Human
atttcttgctttacttttttttctaagttccccaatagaaaataattacctgactggattgattgattcagttactttaggaaatggtgccactgactattgctcaatcttgcctctccctggactcatgtcagaggcgtattaatatattttcaggttaaaagcaggtgaaagtcaggaggttctgttggctaccatggtttctgcaaaccaccattttaagataccaccatgcttatatgaagttgctgagagctggggagctctccaaaattcaccattgtttttccttctatttgtatgacttagttattcaagggcaagaccctttttaaacgttagtagtactcaaacgagaaggatatgattggaatggaacaatagattgcagaaaaaactgccactttaacaaaaatggctctgattgtggaaaggaaaatggggtagcctctagcagttgagaaaagcaaataatgtaatacatcaataattcacagcatctaaataagacactataactcagaaccatatccacaccattctcctcttcccattgtgcaggaatttcttttccctaatggtcttccaaagatattataat

SEQ ID NO: 74429 - DNA, 601 bp, Human
agactgggttgcaacggtcgcgagactcccctcgccgtagcgcgaagaaacgagactgaagaagagagcaaggtgggaggggcgcgctggggagcttcggcgcatgcgcgctgaggcctgcctgaccgaccttcagcagggctgtggctaccatgttctctcgcgcgggtgtcgctgggctgtcggcctggaccttgcagccgcaatggtatggcagcttgcgggaagatcggcaggaccgcaagggatggaagagcttgggcacggggcagggaggaggagatgggcgcgggggcagatstggggtcgcagggcctagctgggcccctggcccgtcggaggcgccgggtagcgggggctgcaggaagcggctctgaggtcgggcaaggtgtgcgcagggccgggctccggcggagcaaggtcccgcccggttccctgaggtcggagggccacctgggacctcgggactgcggcctgagtccaaattgacgtctgggcggtcttgagttccctcagctaatcagcacttcctgagcttccacttccactgcaagccaggcccccagtctcagggcctgcaaggtgacgggagcctgagcaa

SEQ ID NO: 74430 - DNA, 601 bp, Human
ggctgcaggaagcggctctgaggtcgggcaaggtgtgcgcagggccgggctccggcggagcaaggtcccgcccggttccctgaggtcggagggccacctgggacctcgggactgcggcctgagtccaaattgacgtctgggcggtcttgagttccctcagctaatcagcacttcctgagcttccacttccactgcaagccaggcccccagtctcagggcctgcaaggtgacgggagcctgagcaatagcccaggggaaggttaagtcgtgctttttgtccttgacgccctttgaaaccctstagtgctggacagagtgaccctttaagattcgatcgagtcagagagcgcggccgtcgagcacctcccgtgttgcagacgctttgctgggtgctgcaacagcaaaggcgaacatcctagatgcctctgagggtggttttggtgcagaagggaccgtacagatctgtctgagggcggggaagggaaggacacctagcactaccttgaaaccacttgctgaaaccgtaaccctgcaaggtcatgaaattgcccccaggtcctgggggaggagttcggtgggcttttaagtggcatttgttaac

SEQ ID NO: 74431 - DNA, 601 bp, Human
taacataaaaacattaggcttacttaaattcacagtggttattttaatagttgttagggtatcggcaaaatactctaacgttttgaaaattaaaccttttttttaaagcagcatataagaaaatggaaattaaaaatttgagagaaagaatcccggattttactgtcttcaaatttgggaaaaacatttctatttcttagagttcagtagtctctaaaatggaactgttttttaataacgtgtcagtagtcataaactacagataccgataaggagatggcatttcaggagagaaaagacraattgtcatctgagaccatgagggcagatatttactaataaatgtaaaaaatgtgaggcagcagagtgtagtactgtatgaagagagagactctgtagccagccctgaagggctgcattcagacggcagggattgaattctgattgccacttagcagctctgtgaccttgggcaggttactcagtgtctgtcccaccagttcctcatctgtcaaatatatgcaataaaagtgcacaattcagtgggttagtgtgaggattagagtatttgcaaagcatgtaggacaatgggagaaatgct

SEQ ID NO: 74432 - DNA, 601 bp, Human
gaaaagacaaattgtcatctgagaccatgagggcagatatttactaataaatgtaaaaaatgtgaggcagcagagtgtagtactgtatgaagagagagactctgtagccagccctgaagggctgcattcagacggcagggattgaattctgattgccacttagcagctctgtgaccttgggcaggttactcagtgtctgtcccaccagttcctcatctgtcaaatatatgcaataaaagtgcacaattcagtgggttagtgtgaggattagagtatttgcaaagcatgtaggacaatgggrgaaatgctgatagggatccaaatgctgtatatcagtagagaaatgaagagtttttaagtacagtttctacatcaaatgtaatgtaagaagattgcttggacttgcgaaaagaggaaaagaagatgcagtcgggctaggcgcagtggctcacgtctgtaatcccagcattttgagaggccgaggcgggcggatcacaaggtcaggagatcaagaccatactggccaacatggtgaaaccctgtctgtactaaaaatacaaaaattacccagacgtggtggtacgcacctgtagtcccagct

SEQ ID NO: 74433 - DNA, 601 bp, Human
tgaccttgggcaggttactcagtgtctgtcccaccagttcctcatctgtcaaatatatgcaataaaagtgcacaattcagtgggttagtgtgaggattagagtatttgcaaagcatgtaggacaatgggagaaatgctgatagggatccaaatgctgtatatcagtagagaaatgaagagtttttaagtacagtttctacatcaaatgtaatgtaagaagattgcttggacttgcgaaaagaggaaaagaagatgcagtcgggctaggcgcagtggctcacgtctgtaatcccagcatttwgagaggccgaggcgggcggatcacaaggtcaggagatcaagaccatactggccaacatggtgaaaccctgtctgtactaaaaatacaaaaattacccagacgtggtggtacgcacctgtagtcccagctactcgggaggctgaggcaggagaattgcttgaacccgggaggcggaggttgcagtgagctgagatcgtgccactgcatttcagcctggcgacacagtgagactccatctcaaaaacaaaaaaaaaaagatgatgcagtcatgggtgtgggttaggtaagtgtgaaggagtc

SEQ ID NO: 74434 - DNA, 601 bp, Human
aagatgcagtcgggctaggcgcagtggctcacgtctgtaatcccagcattttgagaggccgaggcgggcggatcacaaggtcaggagatcaagaccatactggccaacatggtgaaaccctgtctgtactaaaaatacaaaaattacccagacgtggtggtacgcacctgtagtcccagctactcgggaggctgaggcaggagaattgcttgaacccgggaggcggaggttgcagtgagctgagatcgtgccactgcatttcagcctggcgacacagtgagactccatctcaaaaacaaamaaaaaaagatgatgcagtcatgggtgtgggttaggtaagtgtgaaggagtcagtttttgctggtggcaggtaatggacttttacacgcttaatatcagaattagagtcacttcataattttcgttgagaattagccaatattgcttgctttttaagtttttatgtatcttaatatactccttaaaaatctctcaaacaatagtttcttggaagggtgtcattcctgactccctcctccactgccttcgtcagctgttataacagcgctgtggaatcatggtagatagtggtaatccacgg

SEQ ID NO: 74435 - DNA, 601 bp, Human
tttttatatacactaaccttatatcctgcaaccttgtcataaatgcttattggttctaggaggggctatttttattctttgggattttctacatagataatcatgtcatctatgaacaaaaacagttttattccttcccttcaaatttctatgcctcttattttcttgtcttactgcattagctaagacttccagtatgatactgaagaagagtgatgagtggggatttccttgtcttgttcgcaatcttatggggaaagctcctagcctctcccattaaatcagagattttgtgtgttgktttttttttttttagcaggttgaggaagttctctattcctagtttgctgagagactttttcatgactgggtgttagattttgttggatgctttttctgcacctattgattgtatgattttttctttaacctgttgacgtaatagattatattatttgattttttaatattgaaccagctttgcatacctggagtaaatcccacgtagtgatggtgtataattatttttaatacattgttggatttgatttgctaatacactgttgaggatttttgcctctaacctatgctcatgagagat

SEQ ID NO: 74436 - DNA, 601 bp, Human
gaggggctatttttattctttgggattttctacatagataatcatgtcatctatgaacaaaaacagttttattccttcccttcaaatttctatgcctcttattttcttgtcttactgcattagctaagacttccagtatgatactgaagaagagtgatgagtggggatttccttgtcttgttcgcaatcttatggggaaagctcctagcctctcccattaaatcagagattttgtgtgttgttttttttttttttagcaggttgaggaagttctctattcctagtttgctgagagactttwtcatgactgggtgttagattttgttggatgctttttctgcacctattgattgtatgattttttctttaacctgttgacgtaatagattatattatttgattttttaatattgaaccagctttgcatacctggagtaaatcccacgtagtgatggtgtataattatttttaatacattgttggatttgatttgctaatacactgttgaggatttttgcctctaacctatgctcatgagagatattagtcactgtccaccaaggtcattcaattagagaaaccttagatcattcttactgct

SEQ ID NO: 74437 - DNA, 601 bp, Human
ttgccagcatcttcatccaggttcttgaggtctctcctgaggctgtggcagcctacatccccatgtcttctgtgttcatcaaaactccaacctcattttacgcttgtcactgccatgtgagatactttgctgaaatactaaactgatttgtgggcttataaacattcatttccctattaacctacaaataagatttaaaccaatttgctttttttgatatttaaaaatattaattatttaaagtaacaaacccaactcatgtgtccagtttccccttctccatttctcactctttcctgawcatgaatgctcttaaaatgacattctgttcccgagaatcccctcctcacatctctactttgtgcacacatttcatcatgctcagttctcctgtgtagctttgcctgcaaacacaggcactttgtatggatttgaaggcagaaagatcatctaatattttttagcatgtcttcccccattaggccaggaattctctcatattcatctttcaccaacatttcatttaagcctaatcattttgacttctgcacattagcatttcaattttaaagacttgaaaaaaaatactaaatgttatgta

SEQ ID NO: 74438 - DNA, 601 bp, Human
gctttttttgatatttaaaaatattaattatttaaagtaacaaacccaactcatgtgtccagtttccccttctccatttctcactctttcctgatcatgaatgctcttaaaatgacattctgttcccgagaatcccctcctcacatctctactttgtgcacacatttcatcatgctcagttctcctgtgtagctttgcctgcaaacacaggcactttgtatggatttgaaggcagaaagatcatctaatattttttagcatgtcttcccccattaggccaggaattctctcatattcatcwttcaccaacatttcatttaagcctaatcattttgacttctgcacattagcatttcaattttaaagacttgaaaaaaaatactaaatgttatgtaaatgtaattttttatgaaccttgtttacaaggtaacaatatgtcagagaccatgtcgtgtttaccagtgcctggaatttagagcatcttggtaaatgtttattgagctaaattgaaaaagttaagaatcagtttatataaactacttttacacgtgtagtcatgttcgactatatcattgactctgttactggaagaggttgctgt

SEQ ID NO: 74439 - DNA, 601 bp, Human
ttgaaaaaaaatactaaatgttatgtaaatgtaattttttatgaaccttgtttacaaggtaacaatatgtcagagaccatgtcgtgtttaccagtgcctggaatttagagcatcttggtaaatgtttattgagctaaattgaaaaagttaagaatcagtttatataaactacttttacacgtgtagtcatgttcgactatatcattgactctgttactggaagaggttgctgtgaactaaggaaatttttagagtggctggccttgattcgaagtatagttgggcagcttaacaaggggaggggcttttctgtcatggaaacaagataagcaaagatatggaggtgggactagagcatgtgtgagtcaatagagcatgttgacttctgggaaggtggtggtacagacaggccaaataaaaggaggccttcaatacagggattcgcgccactactaagggatttaaatatatgtctattcatatacattctgagtcctgtatttgatagattgtttctttatggggtattctttaaataaatatatattaactgaaagtttttcttgtataatggaactatttttcaaaaaactgaaacatt

SEQ ID NO: 74440 - DNA, 601 bp, Human
gccactactaagggatttaaatatatgtctattcatatacattctgagtcctgtatttgatagattgtttctttatggggtattctttaaataaatatatattaactgaaagtttttcttgtataatggaactatttttcaaaaaactgaaacatttttaaaacttttatcctcaggattcaagttcgaaatatggcaactttgaaagatagtaagtatgttgtttgtctcaatatgtgaattgagaaaaactaaattttgacaaatacaaatactttcaaaaatatactgctttagcccrttgtgtatttgatcaaaactgaccaaatggatttccattgtatgtttgggacattggacttgttctgaaaagaccagtaagaaaggacacctgagacagctatgttctgttgtttgtagaatgatcatgatataactagaaaaaattataccagtgttggtgtaggtgggtgtatgtgtgggaaggggtaaatcatgttatatataaataatgttatggaatatgtggttaaggcaactttcaataccatttaatgttttaaatgtatattattgtcttatgttgccatttgcttgtcct

SEQ ID NO: 74441 - DNA, 601 bp, Human
tcttatgttgccatttgcttgtcctaagtagtagctagttttgccttccttttattagtactatttctttttttttttttttggagatggagcctcattctatcacccaggctggagtgcagtggcgccatctcggctcactgcaagctccgcctcccgggttcacgccgttctcctgcctcagcctcccgagtagctgggactacaggcgcccgccaccacgctcggctaattttttgtatttttagtggagacggggtttcaccgtgttagccaagatggtcttgatctcctgacctcrtgatccgcccacctcagcctcccaaagtgctgggattacaggcgtgagccaccgcgcccggctattagtactagttctaatattaagactggtttagcatcgtgctgtttattgtttatctaagcgctcattattctgccttgcactttagaaaaatatgtcaataaattcacaaggaagttatactgtaattcctttgtcttaacacagtacttctatttttcagtcaccaggagactaaagtccatcaaaaacatccagaaaattaccaagtctatgaaaatggtagcggcagcaaaa

SEQ ID NO: 74442 - DNA, 601 bp, Human
ccgcctcccgggttcacgccgttctcctgcctcagcctcccgagtagctgggactacaggcgcccgccaccacgctcggctaattttttgtatttttagtggagacggggtttcaccgtgttagccaagatggtcttgatctcctgacctcgtgatccgcccacctcagcctcccaaagtgctgggattacaggcgtgagccaccgcgcccggctattagtactagttctaatattaagactggtttagcatcgtgctgtttattgtttatctaagcgctcattattctgccttgcacttyagaaaaatatgtcaataaattcacaaggaagttatactgtaattcctttgtcttaacacagtacttctatttttcagtcaccaggagactaaagtccatcaaaaacatccagaaaattaccaagtctatgaaaatggtagcggcagcaaaatatgcccgagctgagagagagctgaaaccagctcgaatatatggattgggatctttaggtaagggaagagtgtaattcacaaattaggaagaactgtttcacacaaggaagactactgatgacttacatttagagcttacagtgatgtc

SEQ ID NO: 74443 - DNA, 601 bp, Human
aagaatttatattgtgtttttagatgcttttatacttgtttgattatgaatttatcttggaaataaagttgtaaagagctggaaatgggaaagaagtttctattttaacttgtaattacattctttctcttaacttttttatgatcatgctgtcttatcctgagttgaggctatctaaaagaatttttaacttaaggaagatttatgcatatttgatagtaaagaagatcatgcagtgaaccccctatttatctaccaaatcctcagtatctcaactgacagctgtcctttgtttttttaggtgtgtgtgtgtgttttgttgttgttttttgtttgttttctttttgtgtttttttttgagatggagtctcattctgttgcccaggctagagtgcaatggtgcaatctcagctcactacaacctccccctcccaggctcaagcgattctcctgcctcagcctccccagtagctgggattaacaggcccccaccatcacacctggctaatttttgtattttttttttctgagtcggagtctagctctgtctcccgggatggagtgcagtggcataatctcagcttgctgcaagctctgcctc

SEQ ID NO: 74444 - DNA, 601 bp, Human
atttatcttggaaataaagttgtaaagagctggaaatgggaaagaagtttctattttaacttgtaattacattctttctcttaacttttttatgatcatgctgtcttatcctgagttgaggctatctaaaagaatttttaacttaaggaagatttatgcatatttgatagtaaagaagatcatgcagtgaaccccctatttatctaccaaatcctcagtatctcaactgacagctgtcctttgtttttttatgtgtgtgtgtgtgttttgttgttgttttttgtttgttttctttttgtgtttttttttgagatggagtctcattctgttgcccaggctagagtgcaatggtgcaatctcagctcactacaacctccccctcccaggctcaagcgattctcctgcctcagcctccccagtagctgggattaacaggcccccaccatcacacctggctaatttttgtattttttttttctgagtcggagtctagctctgtctcccgggatggagtgcagtggcataatctcagcttgctgcaagctctgcctcccgggttcacgccattctcctgcctcagcctcccaagtagctggggcta

SEQ ID NO: 74445 - DNA, 601 bp, Human
ggctcaagcgattctcctgcctcagcctccccagtagctgggattaacaggcccccaccatcacacctggctaatttttgtattttttttttctgagtcggagtctagctctgtctcccgggatggagtgcagtggcataatctcagcttgctgcaagctctgcctcccgggttcacgccattctcctgcctcagcctcccaagtagctggggctacaggcgcccgccaccacgcctggctaatttttttgtattttttagtagagacggggtttcaccgtggtcttgatatcgtgacctygtgatccgcccgccttggcctcccaaagtgctgggattacagacgtgagccaccgtgcccagccaatttttatatttttaatagagacgggatttcactacgttggccaggccggtctcaaactcctgacctcaggtgatccgcccacctcggcctcccaaagtgctgggattacaggcgtgagccactgtgcccggcctcagcttacagctgtcctaagaacacctgcttacactaggcagttgccagctaaatttaaatgcgtattttggaaataaccaactgctttgtaaattagag

SEQ ID NO: 74446 - DNA, 601 bp, Human
ggggctgtttcttttttagatggaatcttgctgcctcccaggctggagtgcagtggcaccatctcggctcactgcaagttccgcctcctgggttcacaccattctcctgcctcagcctccctagtacctgggactacaggcacccgccaccaagcctggctaattttttgtatttttagtagagacggggtttcaccatgttagccaggatggtctcaatctcctgacctcgtgatccacccgcctcggcctcccaaagtgctgggattacaggcatgagcccagccttttatttttttatttttttttttttgagacggagtctcactgtgtcacccaggctgaagtgcaatggcatgatctcggctcactgcaaccttcgcctcccgggttcacgccgttctcctgcctcagcctcccaagtagctgggattacaggtgcacgccaccacgcctggctaatttttgtatttttagtagagacagcgtttcaccgtgttcgccaggctggtcttgaactcctgccctcaagtgatccacctgccttggccttccaaagtgctgggattacaggcatgagccactgcacccggccgatctg

SEQ ID NO: 74447 - DNA, 601 bp, Human
ggtgcacgccaccacgcctggctaatttttgtatttttagtagagacagcgtttcaccgtgttcgccaggctggtcttgaactcctgccctcaagtgatccacctgccttggccttccaaagtgctgggattacaggcatgagccactgcacccggccgatctggggctgtttctgagaagtgccatctcttgacttccatgatacttaattcagtcattgtttgataactcctgctctattctgtcattaattgaaaagtcagtatctattgaggttcatcattagatttttttgtcctyaaggattgaagagcgtagctagaaactggctttgcaatttatgtttgggacctctaactacaataaaacagaagctctagaatagagagttgaacagtgttcacagctaatttacattgactgactcaattctcttgttttattgttggaataaagtcatcattgatcattgaagcatcctggaataatattctggaactgattttagttttctaaggcttttttcccttgtatataccatctattttctaatacttcatttattttcaagtatgtactttacacgttaatgtttctgaa

SEQ ID NO: 74448 - DNA, 601 bp, Human
caaagtgctgggattacaggcatgagccactgcacccggccgatctggggctgtttctgagaagtgccatctcttgacttccatgatacttaattcagtcattgtttgataactcctgctctattctgtcattaattgaaaagtcagtatctattgaggttcatcattagatttttttgtcctcaaggattgaagagcgtagctagaaactggctttgcaatttatgtttgggacctctaactacaataaaacagaagctctagaatagagagttgaacagtgttcacagctaatttacaytgactgactcaattctcttgttttattgttggaataaagtcatcattgatcattgaagcatcctggaataatattctggaactgattttagttttctaaggcttttttcccttgtatataccatctattttctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtatt

SEQ ID NO: 74449 - DNA, 601 bp, Human
ccactgcacccggccgatctggggctgtttctgagaagtgccatctcttgacttccatgatacttaattcagtcattgtttgataactcctgctctattctgtcattaattgaaaagtcagtatctattgaggttcatcattagatttttttgtcctcaaggattgaagagcgtagctagaaactggctttgcaatttatgtttgggacctctaactacaataaaacagaagctctagaatagagagttgaacagtgttcacagctaatttacattgactgactcaattctcttgttttawtgttggaataaagtcatcattgatcattgaagcatcctggaataatattctggaactgattttagttttctaaggcttttttcccttgtatataccatctattttctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtattttgataatatatagtactgtgtcacc

SEQ ID NO: 74450 - DNA, 601 bp, Human
tcattaattgaaaagtcagtatctattgaggttcatcattagatttttttgtcctcaaggattgaagagcgtagctagaaactggctttgcaatttatgtttgggacctctaactacaataaaacagaagctctagaatagagagttgaacagtgttcacagctaatttacattgactgactcaattctcttgttttattgttggaataaagtcatcattgatcattgaagcatcctggaataatattctggaactgattttagttttctaaggcttttttcccttgtatataccatctattttctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtattttgataatatatagtactgtgtcaccacttgaccccaatgaatgaattttgaaatgtacttctaaatttctacaacattaaaactacgattcataccaatttctagttctcccactctttcatgtgct

SEQ ID NO: 74451 - DNA, 601 bp, Human
attaattgaaaagtcagtatctattgaggttcatcattagatttttttgtcctcaaggattgaagagcgtagctagaaactggctttgcaatttatgtttgggacctctaactacaataaaacagaagctctagaatagagagttgaacagtgttcacagctaatttacattgactgactcaattctcttgttttattgttggaataaagtcatcattgatcattgaagcatcctggaataatattctggaactgattttagttttctaaggcttttttcccttgtatataccatctattytctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtattttgataatatatagtactgtgtcaccacttgaccccaatgaatgaattttgaaatgtacttctaaatttctacaacattaaaactacgattcataccaatttctagttctcccactctttcatgtgcttt

SEQ ID NO: 74452 - DNA, 601 bp, Human
ttaattgaaaagtcagtatctattgaggttcatcattagatttttttgtcctcaaggattgaagagcgtagctagaaactggctttgcaatttatgtttgggacctctaactacaataaaacagaagctctagaatagagagttgaacagtgttcacagctaatttacattgactgactcaattctcttgttttattgttggaataaagtcatcattgatcattgaagcatcctggaataatattctggaactgattttagttttctaaggcttttttcccttgtatataccatctatttyctaatacttcatttattttcaagtatgtactttacacgttaatgtttctgaaattgagatggctctaccagccaatggaacatcatttataattgagtacatttttttctctcttaatgagaaataaagtaggtgttacaaccagtaccatttaatgaaatatagtattttgataatatatagtactgtgtcaccacttgaccccaatgaatgaattttgaaatgtacttctaaatttctacaacattaaaactacgattcataccaatttctagttctcccactctttcatgtgctttg

SEQ ID NO: 74453 - DNA, 601 bp, Human
tgagtacatttttttctctcttaatgagaaataaagtaggtgttacaaccagtaccatttaatgaaatatagtattttgataatatatagtactgtgtcaccacttgaccccaatgaatgaattttgaaatgtacttctaaatttctacaacattaaaactacgattcataccaatttctagttctcccactctttcatgtgctttgaaaggttttccctctctcattttccagattgatacattcagatttcttcagtaatcaaatgactaagttggaattactgcacaggttgagtatsccttgtgtgaatgcttaggaccagaaatgtttgggatttcagaatattttcatatttataatgcagtatcttggggacaggacctgagtctgtacaccctatacacatagcctgaaggcaattttatgcaatattttaaagaattttctgcatgaaacaaagtttcaaatgcaccccatcacacaaggtcaggtgtggaattttccacttgtggcatcacgtcagtgctcaaaatgtttcagattttggagcacttcagattttggactttgggattagggatgctcaacctgtattaca

SEQ ID NO: 74454 - DNA, 601 bp, Human
tgcttgctggctttgtaacaggcacatgctaatgctgtccagagggcttcataaccacgagatatagtgcagttatttcaaatgttgacctaatttttctaaagttacacatgtggagtagaatatcaaatggtttatttacacattatattttgctaaaaatatgctatcatctgtagtgtggaaatagatgacattattagaacagattcatttaccttatctagcattaatttctgctctgtaattataaaggagttttacactgaaaagctgtttttgatgaattactattccttcyatataacttgaaagaaactcatcacttgttttaacagacagcatgagtatctatgacgatattgatgctgacgtgctgcaaaattaccaagaatacaatctggccaacatcatctactactctctgaaggagtccaccactagtgagcagagtgccaggatgacagccatggacaatgccagcaagaatgcttgtaagtacacagtatggacagtgccagcaggagtgcttgtgagcacacagtgaatctcagctgagaggagtccgtggccgagagtagcatcaacaacattaacatga

SEQ ID NO: 74455 - DNA, 601 bp, Human
gccaattttggtatccaaaaatttcttacttttaaattaagcaacagaagttagttaacaagttattctactctagtttcagattttttatgtagtgtttttgttttgtttgtagctgagatgattgacaaattgacattgacattcaaccgtacccgccaagctgtcatcacaaaagagttgattgaaattatctctggtgctgcagctctgtgagtaattgtagattgtcgccttcagagaattttttttcctcttgctgtgtctgcttgtttggatgcttaaaagtttttcgtttttktcttttgaagttgaaactcattgctgaaacttgcatcctaactcttaggctataaagatgtggtaaaaatgggacctctttgctttatttttattgtttcagctggaaacactcgggcttagttttcggttttctaaaggattaggaatgggatgtggataattcagtatcatttatgaaatctttttttggaatttaaacaattgtaagccaagctttctgagttacagggctagtttcagatttggttttacataaatctataaaccattgcatgttgggaaggtccaggaatttttt

SEQ ID NO: 74456 - DNA, 601 bp, Human
tattgtttcagctggaaacactcgggcttagttttcggttttctaaaggattaggaatgggatgtggataattcagtatcatttatgaaatctttttttggaatttaaacaattgtaagccaagctttctgagttacagggctagtttcagatttggttttacataaatctataaaccattgcatgttgggaaggtccaggaattttttaatcattatgttttttaatcattatgttttctatatcagtaccaaaagatagtatagccatccctcagtatctgcagtggattggttccagwactcactctcacctcccccaggataccaaaatctgaagatcctcaagtccctgaaataaaatagcacagtactacatataaaaaatgcacatcctctcgtatacttttaatcatctctagttataatgctatgtaaattgttgttgtattggtttttgtttttattattttatcattatttttgtcttttttccaaatattttacatcggctgttggttgaatccatggatactgagggccaactatatactgctttcctcaagaaaatttcttagttgttgaaaaactttaatgtttat

SEQ ID NO: 74457 - DNA, 601 bp, Human
aatcattatgttttttaatcattatgttttctatatcagtaccaaaagatagtatagccatccctcagtatctgcagtggattggttccagtactcactctcacctcccccaggataccaaaatctgaagatcctcaagtccctgaaataaaatagcacagtactacatataaaaaatgcacatcctctcgtatacttttaatcatctctagttataatgctatgtaaattgttgttgtattggtttttgtttttattattttatcattatttttgtcttttttccaaatattttacatcrgctgttggttgaatccatggatactgagggccaactatatactgctttcctcaagaaaatttcttagttgttgaaaaactttaatgtttatgaaaaaaaggttaagataatgggaattttattcaaaaagttattaagttgaatacccactatgtgcacagtacagtgctagacacagtgttaaggatgtgattctctcttttaaggcacttatattctaataggataagaaacatacaagtaattgtgattagataaaacgtgtagtaagttctttttgactcgttccttcttacctcc

SEQ ID NO: 74458 - DNA, 601 bp, Human
ccattctctgttatacactcattctgcagaaacactcgatgtatgtgatcctatattttctggtcaccagcactcttcccagtccagtctcttaccattaccatttctcacgtccttgaacctcagccaccttgatctacttccagatctacagattcgtcactctttctcgcggccagggagtggcatgtgctgcagcctgaaaagccactatttcttcccttgctcccttgattcttcatctgactgcctcctgtgtatccttccttactcagctgggggaatcctttcttccagaaarcactccttccttcagtctgagtgaggcagccttctgtagcatcctgtcttccatttagcttagctcttacagccttgtatgaggaattggctttttatttgtctgtgtgctcctcgaggctaggatgggaccatatcttattcacttttgtgtccccattgcctggtacatacctccttcgtgaatgttgaatgaatgaatgaaatgccatatgtattcagaactggaagttcagaagagggacaaataacattttattgggtgtatgaaaatgtgggtccatggttttaagagtcaggg

SEQ ID NO: 74459 - DNA, 601 bp, Human
tcacttttgtgtccccattgcctggtacatacctccttcgtgaatgttgaatgaatgaatgaaatgccatatgtattcagaactggaagttcagaagagggacaaataacattttattgggtgtatgaaaatgtgggtccatggttttaagagtcagggaaaagttcatcactatttaaagtgttccttaagtgttacttttcaagggcagaaactgggcagaatgccagagagacacaactagaactttttgagccaacagagacctttgtgtaagttgttagttggatccatcagcctygctatcctaagcattcttctcttattttactttctaagcacagctgtgttaggactaacccattcacagcctggtcaccaatgttctatcagcatcacagaatactgtctcatggtgtctagcttgatgaacttggttaggatactctctctgttactcagctttgtcatctgtaacatggggactaatacaaggactaaaaccttctattagccattatccttcttgccatctaccccatgttaaagccaggctgatttgttcttggatcttaagtgtgacaaagcctgcgggaaggaa

SEQ ID NO: 74460 - DNA, 601 bp, Human
tcatctgtaacatggggactaatacaaggactaaaaccttctattagccattatccttcttgccatctaccccatgttaaagccaggctgatttgttcttggatcttaagtgtgacaaagcctgcgggaaggaaccacattctgaaggtttgtgggctgtgtgagatccagagaacccaagggggtttttttgctcttgacaaacgaatgttaggtatgacctatgatgatacaacttctgcaaaattgaggaccagcctatttcttcattagaaatgcaggaaacctggccgggcgcagkggctgacgcctgtaatctcagcactttgggaggcagaggtgggcggatcacaaggtcaggagattgagaccatcctggctaactcggtgaaaccccgtctctactaaaaatacaaaaaattagctgggcgtggtggtgggcgcctgtagtcccagctactatggaggctgaggcaggagaatggcatgaacctgggaggcggagcttgcagtgagccgagattgcgccactgcactccagcctgggcaaaagagcaagactccgtctcaaaaaaaaaaaaaaaaaaaaagaaatgcagga

SEQ ID NO: 74461 - DNA, 601 bp, Human
ggctgacgcctgtaatctcagcactttgggaggcagaggtgggcggatcacaaggtcaggagattgagaccatcctggctaactcggtgaaaccccgtctctactaaaaatacaaaaaattagctgggcgtggtggtgggcgcctgtagtcccagctactatggaggctgaggcaggagaatggcatgaacctgggaggcggagcttgcagtgagccgagattgcgccactgcactccagcctgggcaaaagagcaagactccgtctcaaaaaaaaaaaaaaaaaaaaagaaatgcaggamacctatttaaaagtaacagaaacagctgggtgcattggctcatgcttgtaatcccagcattttgggagaccgaagcgagtggattgcttgagcccaggagttcaagacaagcctgagcaacatagcaagaccccatctctacaaaaatgaaaaaattagccaggcctggtggcatgtgcctgttgtcctagctactcaggaaattgaggcaggaggattgcttgagcccaggagttttaggctgcggtgagctatgatcgtgccactgcacaaaaccaagaatttagaaaaaggaatcca

SEQ ID NO: 74462 - DNA, 601 bp, Human
gtagtcccagctactatggaggctgaggcaggagaatggcatgaacctgggaggcggagcttgcagtgagccgagattgcgccactgcactccagcctgggcaaaagagcaagactccgtctcaaaaaaaaaaaaaaaaaaaaagaaatgcaggaaacctatttaaaagtaacagaaacagctgggtgcattggctcatgcttgtaatcccagcattttgggagaccgaagcgagtggattgcttgagcccaggagttcaagacaagcctgagcaacatagcaagaccccatctctacaaraatgaaaaaattagccaggcctggtggcatgtgcctgttgtcctagctactcaggaaattgaggcaggaggattgcttgagcccaggagttttaggctgcggtgagctatgatcgtgccactgcacaaaaccaagaatttagaaaaaggaatccacataattggaaattgagtattaagtttttgcttcctaggaaggtagtctaaatccttatacaaaaacttagctatgcagtgccaaggttggattgcttgtgaatgggtttgcatgctctgtaacctatcagttattctgaatcaa

SEQ ID NO: 74463 - DNA, 601 bp, Human
ctgaatcaagacttgaatatttaaacatacttggaaaagaaaaagatcaaaaaacaaaataaacatatttggctatttagtaatataattaagaacatgagtaaaccatagtattcgaggtccaagtattagttgccagcctaaaaactaaatatggccaggcgcagtggctcatgcctgtaatcccagcactttgggaggccgaggcgggtggatcacctgaggtcaggagttccagaccagcctggccaacatggcaaaaccccgtctctactaaaaaagtacaaaaattagctgggcrtggtggcgggcacctgtaatcccagctactcgggaggctgaggcaggagaatgacttgaacccaggaggaggttgcagtgagctgagatcacgccactgcactccagcctgggcaacagaacaagactccatctccaaaaaaaaaaaaaacctctaaatatattgtgttaatttatagaaaaattgtaatttaaattacatattcatagtcttgcctacttgcatgagcatgtttttattgcttctaacctggattgaaatctatgactttttataacagtcattgagtctgtttcaaag

SEQ ID NO: 74464 - DNA, 601 bp, Human
tggaaaagaaaaagatcaaaaaacaaaataaacatatttggctatttagtaatataattaagaacatgagtaaaccatagtattcgaggtccaagtattagttgccagcctaaaaactaaatatggccaggcgcagtggctcatgcctgtaatcccagcactttgggaggccgaggcgggtggatcacctgaggtcaggagttccagaccagcctggccaacatggcaaaaccccgtctctactaaaaaagtacaaaaattagctgggcgtggtggcgggcacctgtaatcccagctactygggaggctgaggcaggagaatgacttgaacccaggaggaggttgcagtgagctgagatcacgccactgcactccagcctgggcaacagaacaagactccatctccaaaaaaaaaaaaaacctctaaatatattgtgttaatttatagaaaaattgtaatttaaattacatattcatagtcttgcctacttgcatgagcatgtttttattgcttctaacctggattgaaatctatgactttttataacagtcattgagtctgtttcaaaggaatcttgtggtaagtatttttgcatgatgt

SEQ ID NO: 74465 - DNA, 601 bp, Human
agtacaaaaattagctgggcgtggtggcgggcacctgtaatcccagctactcgggaggctgaggcaggagaatgacttgaacccaggaggaggttgcagtgagctgagatcacgccactgcactccagcctgggcaacagaacaagactccatctccaaaaaaaaaaaaaacctctaaatatattgtgttaatttatagaaaaattgtaatttaaattacatattcatagtcttgcctacttgcatgagcatgtttttattgcttctaacctggattgaaatctatgactttttataacaktcattgagtctgtttcaaaggaatcttgtggtaagtatttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtc

SEQ ID NO: 74466 - DNA, 601 bp, Human
ttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagyagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaa

SEQ ID NO: 74467 - DNA, 601 bp, Human; identical to SEQ ID NO: 24966

SEQ ID NO: 74468 - DNA, 601 bp, Human; identical to SEQ ID NO: 24967

SEQ ID NO: 74469 - DNA, 601 bp, Human; identical to SEQ ID NO: 24968

SEQ ID NO: 74470 - DNA, 601 bp, Human; identical to SEQ ID NO: 24969

SEQ ID NO: 74471 - DNA, 601 bp, Human; identical to SEQ ID NO: 24970

SEQ ID NO: 74472 - DNA, 601 bp, Human; identical to SEQ ID NO: 24971

SEQ ID NO: 74473 - DNA, 601 bp, Human; identical to SEQ ID NO: 24966

SEQ ID NO: 74474 - DNA, 601 bp, Human; identical to SEQ ID NO: 24967

SEQ ID NO: 74475 - DNA, 601 bp, Human; identical to SEQ ID NO: 24968

SEQ ID NO: 74476 - DNA, 601 bp, Human; identical to SEQ ID NO: 24969

SEQ ID NO: 74477 - DNA, 601 bp, Human; identical to SEQ ID NO: 24970

SEQ ID NO: 74478 - DNA, 601 bp, Human; identical to SEQ ID NO: 24971

SEQ ID NO: 74479 - DNA, 601 bp, Human
ttgctgctgttgatatatttacatgttagtaattttgatggcttttggataattccactctagagggagacgtggtgggcggtccttcctgtgacacgacccttgagtgacagttctatttgattgcctccggtactgtgaggaaaggacacgactctatggtgaggactgatggacatacattatctgagaaaagaaactaccaggtaagaccagtctttcttcttttttctctattggtcttatagctacattgaaactgttcaaatgtgttatatgtaattggaaccagcaaattggwtacacctcaatttgaaaatttgggtttataattttaaattaagtactggatttgatagttgaaatagttgggaacacttttcaaaataaagcatattcataatgtatattttttagtgtcaaatcaggttttctgagatatttgtcaaaacttagattatttgatatacaagttatgacttcatgactgaattcaaaatggtaaaaacaaaagtgttgattgcttttacgtatattattcctggaagactaaacccgaagtcttgtgctatattttggataacaaagtatatatcacaga

SEQ ID NO: 74480 - DNA, 601 bp, Human
ctggccgcaaagttatcttttaagaggttatcttaggtcttgcgtggagtctaggatgatagcactgatggtggcaggttagttttttgtttttttttttaaatctttctgaatttccacataaaaatagaaccagctagacagcaaaactaaaactcgtgaaacataacagaacttcttgacaaagtgtccccatgaaccccaatataagcagatgagaactaagaaaaagacctacagttttcagtttttatgcataaaatgagacccattgggatgtctgatggacctgagagtggargcacccaatgtagtcaacaggtattcactggtaagtacaattagccagtttgaaattgggagagattttgtcaacctcataaggtgagtgaggaacccatggtaaggctaaagtgattggagcagcttagctctctgacctcttgagagtgacccaccagtgtgtccttctaggattccactgaggagaggaattaaaattgagcaggaaagggacaacagtgacattggaaagagaaggtccagataaaaatgggagaggggagcagaaccaggaaatctcagtaaataagcgatcata

SEQ ID NO: 74481 - DNA, 601 bp, Human
gaattctttgagcactgggtagaaggggacatttctcccaaggggattttcacttgtttttgctaagaccctaaggcactaccaatccagaaccaattccaaataaaatattagcttgaggttgcagtccacataggcaatgtgaatttatgcttttttgtggctataaattttcagagcattccttcaccactttttgcttaccataaataacaggaacatcaagattttttgctgtcctctttactaaggggttattacaattatggtgtagctcttttttttttttttttttttttttgaaacggagtttcgctcttgttgcctaggctggagtgcaatggtacgatcttggctcactgcaacctctgcctgcctggttcaagcaattctcctgcctcagcctcccaagtagctgggattacaggcacctgccaccatgttcagctaattttttttgtatttttagtatggatgaggtttcaccacattggccaggctggtctccaactcctgacctcaggtgatccacctacctcggcctgggattacagtgctgggattacaggcatgagccaccgctctcagccagggtgtaaca

SEQ ID NO: 74482 - DNA, 601 bp, Human
aatatacctttttctctctggctaatattaagatttttaaatttgtcacttattttacacagcttgattaaggtctatgtcggtataattttttttatgagtcttacacgtgggatttgttgagcttcttgaatttgtatgtttatacaaatttaggaatttttttcatccattatttatttgaatatattctctgtcttcactgtcctttgaggactccaattacgcatatacctaattgcctggagttgtcccatagcttactgatgctttgttcatttttttctttctttttttctcmccatgctttagttaggatagtttttattactgtttttttaagtttgctaatcttttcttcagcatgccaattattctgccttcttttacatacaaaatgtaattataactccttgcatatcattgtctactaattctgttactcatgtttactaatagaaactatgtctgtttctattgagtgttggtttttttttcctcctcattatctgttctcttttagggcttctttgcatggctggtgatttttgcttggatgccagtctttggaaactttatcttgttgagtgctatataatgt

SEQ ID NO: 74483 - DNA, 601 bp, Human
catttttttctttctttttttctcaccatgctttagttaggatagtttttattactgtttttttaagtttgctaatcttttcttcagcatgccaattattctgccttcttttacatacaaaatgtaattataactccttgcatatcattgtctactaattctgttactcatgtttactaatagaaactatgtctgtttctattgagtgttggtttttttttcctcctcattatctgttctcttttagggcttctttgcatggctggtgatttttgcttggatgccagtctttggaaacttkatcttgttgagtgctatataatgtttgtatttctgttaatattctttagatttcttgtggttgcagttaagttacttataatagaagccatttgatctttgagacatccttttcttttttttcttttttttaggtcttgtttaacagaaccagagtaatctttagggttaattttcttccaactacttaagcaattcttttctgaattatgtaaattatgtttttctactctggctcataggaaaataaatgattcccagccctgtctgggccctggggattgttttctctgtttctttc

SEQ ID NO: 74484 - DNA, 601 bp, Human
ctgggccctggggattgttttctctgtttctttcaggtggccttttttttttgttttttttagcttctggtagtttccttccatgcatgtgctaatcagtacttagctgaaatctcagaggaaccctctgcatattttcagagatctttctctgtgccagtcattcttgtttagtatcccagcctattctggctgcctttaattgccctcttctccacttcctcaattcacaaagattgctgggctccaccaatctggaatccctctccctcactgcacactgaaaattctttcagtcttwtaagcaagggtagttgttgagccctcaatgattctttctctggtctcaaggattattgtcctgcacggcctgatatcctgtgtctgaaatcaattgtttaatatattttgtccattttcaagttgttttaggtgggctgctgctacaactaatactaccacactactctctcttggttggaagtgaaagtcttaatgtttcattttttaaaattattttttcttattaaaattttttttatagagacagggtctcactatgttgcccaggcttgtcaagtgatcctcccacctcagcctc

SEQ ID NO: 74485 - DNA, 601 bp, Human
taatcagtacttagctgaaatctcagaggaaccctctgcatattttcagagatctttctctgtgccagtcattcttgtttagtatcccagcctattctggctgcctttaattgccctcttctccacttcctcaattcacaaagattgctgggctccaccaatctggaatccctctccctcactgcacactgaaaattctttcagtcttataagcaagggtagttgttgagccctcaatgattctttctctggtctcaaggattattgtcctgcacggcctgatatcctgtgtctgaaatcmattgtttaatatattttgtccattttcaagttgttttaggtgggctgctgctacaactaatactaccacactactctctcttggttggaagtgaaagtcttaatgtttcattttttaaaattattttttcttattaaaattttttttatagagacagggtctcactatgttgcccaggcttgtcaagtgatcctcccacctcagcctctcaagatgctgggattacaggtgtgagccactgcacccttatttcatttttaaaaactatattttggttgagaagatgaatgaaaaccatcc

SEQ ID NO: 74486 - DNA, 601 bp, Human
tcaatattcagataaggcttggatgctttctcttgtataaaatactatacagtgtgcaatatacacaaatttcagaccatttctcagcatttaaggtcatttagaatgaaaaataaaacagtacaggtcagtaaatgaattccagttcttatgtagaattgtcatagtcctgattcaatttaacttaaaaattggactgtttcctctgaatttcctgattcccttaagattccctagaatccagtaggcccatagatacagtggtcattcattttctcagctgtcaggtaaaaattttacyaataagcatttcttactttaaaaaaatctgtgttgtatagcataaaatagtatattatctctgtattgttttatctggatcagtaaattaaagacattataataaatgtgctaatgaaaatataagatgttttcaaggaaaaaggaaagacccttattagggccaaaaatgctaccggcacatgaaattttacacctattcttttctaccaaggcacttttctaaaggcactgtgataaaactaaaacaaatgtgcttggtagagtgaagagcctttagtttgagccactagtcttcaca

SEQ ID NO: 74487 - DNA, 601 bp, Human
atattcacggatgaatgctataaggagtggacagaaatgtaagggcagacaggtatttgcatgttctcacagtactccaaaacatttcttatttaaaaagagaaaactagtagtttacagtggagaaaacttccagatgcaccacttcacctgtaataagacatattaacatcatatgcactcatatattggaatatatgcatcacatatgatgcacttgagaagactacatcagctctgtggtgatgtggctttcagaatgcataacttcagtctaatgagaaaacatctgacaaacccmaactgtgggacattctgcagtgtgtatgatataacatcaatattatgaaagaagaaagactaggataagtctcggattggagaagactaaggaaatgtaaaactaaatgtaaggggtgggggacaaagtgttgtaattttaaatacacaaggaattccttactgagatgacttcacacctgaagtaggtgaagtaggaagccatctggatgtctagaggaagagcattcctggaggataacaaaggcaagggcttggagacaggagtatgtccgatgtgtttgaggaatagcaaggaggc

SEQ ID NO: 74488 - DNA, 601 bp, Human
aactcagtgattattgaattagtgtacatggtgagatgtttagaaacattttaaagatcatgtcttcccttgctaaaggaatacttttcatttttaattacttcctgtaacataaattaggattctgatacctctgtatatttttaaaatgtaaaggttttaaaataatttgtcaccttcaataatatctatttatgctattgaacagatgtcttaaataagcttctatttttattagttttagtatttgtaatagagtttatttttctttgaaaataactcactttttatattttcaagkattcaacatttttgtaaaagtgaattgatttcatatcttttttttttttttttgagatagagttttgctcttatcacccaggctggagtgcagtggcacgatctaaactcaatgcaccctctacctcctgggttcaagagattctcctgcctccgcctcccgagtagctggggttacaggcatgtgccaccatgcccggctaattttgtatttttaatagagaagggtttctccatgttggtcaggctggtctcaaactcccgacctcaggtgatctgcccgcctcagcctcccaaagtg

SEQ ID NO: 74489 - DNA, 601 bp, Human
aagatcatgtcttcccttgctaaaggaatacttttcatttttaattacttcctgtaacataaattaggattctgatacctctgtatatttttaaaatgtaaaggttttaaaataatttgtcaccttcaataatatctatttatgctattgaacagatgtcttaaataagcttctatttttattagttttagtatttgtaatagagtttatttttctttgaaaataactcactttttatattttcaaggattcaacatttttgtaaaagtgaattgatttcatatcttttttttttttttttgagatagagttttgctcttatcacccaggctggagtgcagtggcacgatctaaactcaatgcaccctctacctcctgggttcaagagattctcctgcctccgcctcccgagtagctggggttacaggcatgtgccaccatgcccggctaattttgtatttttaatagagaagggtttctccatgttggtcaggctggtctcaaactcccgacctcaggtgatctgcccgcctcagcctcccaaagtgctgggattacaggcatgagccactgtgtctggcctggatttcatatcttattt

SEQ ID NO: 74490 - DNA, 601 bp, Human
taaattaggattctgatacctctgtatatttttaaaatgtaaaggttttaaaataatttgtcaccttcaataatatctatttatgctattgaacagatgtcttaaataagcttctatttttattagttttagtatttgtaatagagtttatttttctttgaaaataactcactttttatattttcaaggattcaacatttttgtaaaagtgaattgatttcatatcttttttttttttttttgagatagagttttgctcttatcacccaggctggagtgcagtggcacgatctaaactcamtgcaccctctacctcctgggttcaagagattctcctgcctccgcctcccgagtagctggggttacaggcatgtgccaccatgcccggctaattttgtatttttaatagagaagggtttctccatgttggtcaggctggtctcaaactcccgacctcaggtgatctgcccgcctcagcctcccaaagtgctgggattacaggcatgagccactgtgtctggcctggatttcatatcttatttaaatcctatattcagattgttttgttttaaaatcttaaaatttttctctttattatctt

SEQ ID NO: 74491 - DNA, 601 bp, Human
ttttcctgaggtattaggcaggtagctatgttttaatctttacagaaatagaaatttcaaacatctttttccttgaagtcttgacaggaggactggaacatttctaccaatctctaggtttgaagttaacaaaaataagtatagatatctggtacgtaattcagcaaatgtttgttgaacgaatgaataaactcatcagatcctgtgtcgtgtgtgtgtgtgtgagagagagagagagatgccaacactcctggcattttctccttgtctgccttgcactggaaatcatgatctaaacatyacagatttaattttgtagggatgtagctctgggtcttcactaccttacttttgagcttcttctcagaaagctttcaaaacgtgtttctttcgttctcctacatctatcccatataattcatgttcattgatttatagatttttgcacatacaagacattcacattaaacccaagaaaaacagactcttaagatggcccatggttgctaagtttcttcagagaaagtatgtgagggttaaaagagattggggttctagtgtatttggtatttcaggtctcaaaacaagtcatcaaaataca

SEQ ID NO: 74492 - DNA, 601 bp, Human
tctgtaaaatacatgtgattagtcttgtagagactggcttttgtctcacatgtctataatcagtcataatcagtccattcttgttcttgtgctaaagtgatctttttgacacacataaatattcgattgtggtataccctacttaccattgttcacaatataaggaccttcctcctccaatcggctttttatttgctccttactgcttttccctttacaaattcaagaacaaaacacacattaaattgttagttgtatatttgagagtcagtgtactatcatggttaaaaagggggactcyagcaaattggtctgggttcaaaacccatctccgcatttatcagatatataaccttaggaagttaacctaacttctctggtccttagctacaaaatagggatagttaattgttcttactttctagcgttatcttgataattacataaataaattttaaagcatttagaatattccctggcacaataatttattattattttatagttatgataaagtgttttcagagactgtataaaacaagagtcctaatttagtgtgaaagtttcaaagaatgggagaaagggcattttaagtagccgt

SEQ ID NO: 74493 - DNA, 601 bp, Human
tgtatcttcaggcctgcctcttacttcgttggttccctaattgccattcatcctgcctgtatcagggaccactttacccgtcttctctgaagttcttggttattttatctgaagtttgttttttttttttttttttttttggtaaatttctgtgattattctgatttaccacatttggctttgaaatactgtatttaaatgttgagaatgtcatgccttaggaattcatagctagtctaaactaaataatgaaggaggaatatactgggaaaatccagccaacttaagtggctccattacrtcttccagtttaattctttattactttctgagaccaattccttttggggatttggtttggtacagaggattagcttacttatctctgtatttttaatttaattttattttattttaagacgtagtctcgtggtgtcggccaggctagagtgcagtggcatgatgatcttggctcactgcaacctccacctcctgggttcaagcagttctcccacctcagcctcctgagtagctgggattacaggtgcatgccaccatgcctggctaattttttgtatttttagtagagacagggtttcac

SEQ ID NO: 74494 - DNA, 601 bp, Human
ctttacccgtcttctctgaagttcttggttattttatctgaagtttgttttttttttttttttttttttggtaaatttctgtgattattctgatttaccacatttggctttgaaatactgtatttaaatgttgagaatgtcatgccttaggaattcatagctagtctaaactaaataatgaaggaggaatatactgggaaaatccagccaacttaagtggctccattacgtcttccagtttaattctttattactttctgagaccaattccttttggggatttggtttggtacagaggatyagcttacttatctctgtatttttaatttaattttattttattttaagacgtagtctcgtggtgtcggccaggctagagtgcagtggcatgatgatcttggctcactgcaacctccacctcctgggttcaagcagttctcccacctcagcctcctgagtagctgggattacaggtgcatgccaccatgcctggctaattttttgtatttttagtagagacagggtttcacgttgttggccaggctggtcttgaactcctgacctcaagtgatctgcctgccttggcctcccaaagtgctgg

SEQ ID NO: 74495 - DNA, 601 bp, Human
cattggaaacactgtacacttaggctacactaaatttatttaaaaattttcattctcgaataatgagttaaccttagcttaccgtaacttttttactttataacctttttaattttttaaaatcttttggactctttaatacttgacttaaacacgtacagctgtacaaaaatattttcttcccttatattcatacttagcttttttctatttgaatttttttgtttttttactttttagatgtttttgttttgttgaaaactgatacacacactcatgtatttgcttaggtctatcaagrcatcactaggcaataggaatttttcagcttgtttataatcttacgggaccaccgttgtatatatggtccatcattgactgaaatgtcatgctgcacatgactgtcgtttattaaaatttttatttaccaaattaactttttaacatacgttgtaaccagtaatttcaatgtatttcgatataattgacatatcctctttgaaatttatagaaattgatttttatgtaccctaatttctctttcagggagaagatgggtatagtttaaccctttcatatcatccatccatccattcctact

SEQ ID NO: 74496 - DNA, 601 bp, Human
ctctctctctctctctctcacacacacacacacacacacacagtgactcttgagaaaatctggtattgatggaaaaggaacatttcttcattttctttcgtctggaacatatgtttaattttgccttcaaaccaaacctttttgcaagatattaagcataaaaattttaattctatacaattaatttcaattttagaattctaggagtctataatggtcttgatgataagtgttatacaaacagtgtcaaaagaagagtttatcaatttgagcttatttatgtgtataaaatttgatgagmgatgccttgatattcacctgaaactttattgaataattattgaattatgcattttccatgtttattctttcttagaattagagctcaatagtaagagttctataaagataattaaatgtatctttaactttcaaaaaacaaacttctaaaatcttatgtgtagtgaatcttaatttgcaagctctaaagtgattttttgccactgtttcctttttgaaattactcactaagaaacatctgttttccccctagtagggactacttagggagctggtggataggcatgcgggatcctggtct

SEQ ID NO: 74497 - DNA, 601 bp, Human
ggtagtatcgccgcagaaacgaaaacctacaatttgtgtgtattgctgtgattatataatgaaagttaagtttgcttggaaaatgttaatgaaatatttattactgatgaaatgcatttattctaattaggaagataggaagctttcagactgaaatctaaaagtatataaagagaatgaatgacaaagagatatatgtcttctcaaaagcagaaatactatatgtctacattttaaaatcagaattagtatatatacttacacacatactcacaaatgttggccaccattctgatccagytggttggcacagaagtaacagaatggtttgattcacaaaaccttttttaaaaaaacattaattaagaacatagtatggcataggaattaagaacttggactctaaagcaatacaaatatgtgtgtttggatcctgactttgcctgttagcaagaacttctccaagtctcagtttccttttctgtaaaaataggagtaataatatattggctaccttatacattggctgctgttgctgttacttttttaaaattacaaaatagcacaggtaaattatacaaatttttaaaaatacacttga

SEQ ID NO: 74498 - DNA, 601 bp, Human
acaaactcttaaatttaacattaaactacttttattattcctgtaaagctgtgtttactaaccaccttcatgtagtggcacatagagaaaattgtatataatattacacactgtggtaagtgaatcagcctacggttcttgatctcaagtaattggcctagggacctaccacctctttaccttcatgctctgcttcccctccctacttactccctcctcccattttgagagggcaggtagatacccaggcatatctgtaactcatggatgtataatcagtgtgagaaagtagactaaaatrtgtgttgtctggagttaactattcaataaacataaatatctgatgaaaaatgttttaagtgttttgtttgacaatattcacattatggattgttctaagtcatgcatttatgttggccagcatcttatatttgcagcctttagaaacaactgtactttttcatttatagcttataatgacagaaaatcatgattcttaagaattttatataaatcttttacctcctttttttgatggttgatttgtattactattaggaaaaccagattttaagatatcaagcattatttgggataaaga

SEQ ID NO: 74499 - DNA, 601 bp, Human
tctatagagtattcctgatacctttgtgtagctccagtgatgtttcatgtttcctttagagcatttaccacactgtgccttaaaatataatgagttgtataattcattctctttccccactagattgtaagccccttgatgacatggctcatgtcttatttaattaggatgttttgatggttgtctaatataagacaggaaatacgcaaatatgcacacacacatattttcatttactcagcttcagtatttacttttgagtatataacactgctacattcatttctatgaggatatatawaatgaatgtatgttctgtgaacatatcttcaaataatttacatctacaaggaaaaaaaaatggataaattcaaaggcattgtacaagtgccatgaagttcacatcacaaatacataaattatataccatgtctatataattttatttttttaacttgctaagtgaaagagtagtgctgctgtaactcaagttagtgtgacttttagaaaacttatagtattaaaaattaatttcatttctacagtttggttttatcgaattgtgatattctcttaagaaacatggaatatattatagaat

SEQ ID NO: 74500 - DNA, 601 bp, Human
gatttacagatttgtggagtgtaaatgcaatgctctgctctgttttctttatgctctaatataattaatttgtttctagatgctggcatcaccatctacatcaggtcagctgtctcagtttggggcaagtttatacgggcaacaaagtaagaattttgtatttattctgggatactttatttaaagagaaaaataagtaactaccaaataaagaacaaccagtacttcctttgtgggtttattgtatgacttaaaaggaaaaatgtttaattttcagagttttattttacttacatagcaraacctcattatttcagaccttattgatcctatggttgctattacttggatatagcatagattgaaatttatttcaacatcttttacatctgtaaattttttgcagtatttttgaagaatttgctaaactaaaaatagacattctctgtgttttcaattaaaggaagttaaaagcttttttagtttatttgactggctactctgtgtgtgtgtgtgtgtgtatgtgcacgcctgtttattaagtaaactcattacttagcagtttgtaaaatgttctttgtttcacaagtatttcttaaat

SEQ ID NO: 74501 - DNA, 601 bp, Human
cttcctttgtgggtttattgtatgacttaaaaggaaaaatgtttaattttcagagttttattttacttacatagcaaaacctcattatttcagaccttattgatcctatggttgctattacttggatatagcatagattgaaatttatttcaacatcttttacatctgtaaattttttgcagtatttttgaagaatttgctaaactaaaaatagacattctctgtgttttcaattaaaggaagttaaaagcttttttagtttatttgactggctactctgtgtgtgtgtgtgtgtgtatgygcacgcctgtttattaagtaaactcattacttagcagtttgtaaaatgttctttgtttcacaagtatttcttaaatatttcttcttttgctttagctcagtctggatatagaatctagatttttgactcacggtttaatgcttgttccgttttgcaggcttctacttctatttttttaaagtgttgtaatacttttaaagcgcttagcacagagcctagtgcatagtaagtgctcaataaatgttagctattatcacataaaatttttataaaactaaacaataaaatatctttatattt

SEQ ID NO: 74502 - DNA, 601 bp, Human
gaaaatgctggaacagagacctgtatggtcttcagttctagtatagtatgattgtatccaaatatgtaaataattggacttttcatccaataattcacgtgaatactgtacatggaatgataactatagaaaccaatgaacatactcttgtattcaagttgcataatgtttcctatttgttatatttgagtgtgtgataagctttcaggtgaattaagtcctcacttaacataagttttttgaaactgcgacttgaagcaaaactacatataacaaaaccaattttttgttctcatcaacwttacaatggaatgaagttgaatgaaacaacactattcaaggacctgctgtatgtatttttgcctgaaatcacagtttccaagaatgatcagtggcattaagtgaagacttactgtacaccttataagcttcaagacccatgagctcccttaagctgtctcctagattagaatcaacagggaaccaggaattaatttctcctggatagtcaaagcattggaattaagtggttgatagttgcatttaccttttcttagttaccaacaggatctaggaccttgtaagattggagaaaaaggaa

SEQ ID NO: 74503 - DNA, 601 bp, Human
gctattccacaggtaaagattctgtggcactcctctaaagatccagccagatgttgagactctcagctgattcgagcacagcagccacttctcatagttgtggaagccacttagctccatccatgtttcttgtcttatacattcttagcacctagaaggcaaagcctgttcctccgccaggtgtataacttgtcctcattttcatatatctcgtcattctctcagactgaactattgtaacatttatacccacctgactccccaccactgccaccaccaaacacctggctgagtctcataygttatttaattcatatactatcttctgtctcctccaggaaaatttttctgcttccagactcactctattcccaagtctgagttagtgtggtccctcctacaagcagtcaagcacgctatgtctactgcatgtaaacaccttggtcatagcacttatttatttttaagtagtcttttatatctctagaacaagagaagggaaagtattcttgctgaggagttagatatgagtagtaaaggacagatttgaggaaaggaatagagaaagaagaaagaagattataaatcagatatgtagtgt

SEQ ID NO: 74504 - DNA, 601 bp, Human
atgccagtgagttcctagaggaagctggctgctttgcaaatggaaaaggggacactttaaggcatcagttaaggactactctctcctgcccctataaagattttaggggactttatttaagtatgaatattcagggatttggttgctatgattttattttttcatgtaacttaatattttttatttctagcaaaaaattgaataaagaatgacgtattttgccataagtgtttaagtgatgtgctgttaatcagtttgtgcagtggaaataattaatggaataatttcttagatcatattctttaagggtttctgaaaaatgatcaataaggaatttgactaacaccctgccagataagaggtaggaatctatttagaatgtgttcgtatagtcctcctaatattgtgttgttattatcaattgttagattgaaagaaaaatttgactcaaaattataaccttttaaactttttttaaaatttgtttttattctttgtaaaaaggtgataaccttttttataagatgattataagaaggaattgagaggaagtagtatagtgctttgttgataagtgcccaataaattttaattttactgt

SEQ ID NO: 74505 - DNA, 601 bp, Human
ttcactgaggaagaaaatacctatgctctttttatttcagtgcaaattgttaagtacagtacaagtggtttttatactgcagctcgcatactggttgtcagtggggtggatatcaagggttaatcatttcctggggagctttttcaaaaggcacctgtcttcctcaaaggaatatgtgcaatttaaaattcctccccagatgattgtgatcattgctccctcgccacacatccattgctctaatgagcataaagtaaaacagatgacatagactatacatttagtatgcagaggatagaaygatatgccattgaaatgaaattattctaaatatgtgtgtgaaatacatttatattttatgtcacagtcacaccagtagttctctcatcttagataccaccttttatcagttgcactataatttgccctttattgtttgtttactttttcttttcaaagagctagaatgactaaagaattaataaaaattagaactgcaatttgaaagtatatttgagattctagggttggaccaattgattatttaaagagaattttaatgagtgattgtagagagcttatttagtataatggacttctt

SEQ ID NO: 74506 - DNA, 601 bp, Human
gatagaacgatatgccattgaaatgaaattattctaaatatgtgtgtgaaatacatttatattttatgtcacagtcacaccagtagttctctcatcttagataccaccttttatcagttgcactataatttgccctttattgtttgtttactttttcttttcaaagagctagaatgactaaagaattaataaaaattagaactgcaatttgaaagtatatttgagattctagggttggaccaattgattatttaaagagaattttaatgagtgattgtagagagcttatttagtataatgracttctttttcaggggtattttgcctatgaatcctaggaatatgatgaaccactcccaggttggtcagggcattggaattcctagcaggacaaatagcatgagcagttcagggttaggtagccccaacagaagctcgccaagcataatatgtatgccaaagcagcagccttctcgacagccttttactgtgaacaggtaagatgtttattgatactgtgtataattgtctttctgggtatactcagatttgccttttcatattttcactttgttcttgaggtgtggcttctctctaataa

SEQ ID NO: 74507 - DNA, 601 bp, Human
tactttgagtaccttctcaagtaagatttggttttgtgcattggagacttaccaacaaaagactttttaagatcacatctatagtatttgaaaaccgtatcatgtttagggattcaaaacaaaaaaacgggtttttgtactttttcacttctctttgtactgtctgttgcatatactttgcgaataagaggagttactcattttgttaggattttcaagctgtttgggtaatttgtatgagaattatgtctgaaatataacactttcttgcaaaagtagtatttaagcttgattgcctacatgtatatatatgtattttttaaatggagaaatgtaggggcaaaactaccttgatctagttgttatcatcatacctgtttgattcactttattctgtctagtaaaatctgaattaaaataggtttagcacatttactgtttaatcctcattccataaactccaggttttgcttttatttagatatctataattttactgctcttttaaattttaaaaaacttatttgtgaagggttatcaaaattctcatctccttgatacctttctaaccttatatctttatcataactttatcatatct

SEQ ID NO: 74508 - DNA, 601 bp, Human
tcaggcatttggaatgaataactccttatcaagtaacatttttaatggaacaggtaagcttattctggagctagtaccctacaaaaagtatgatagatttatgaaatataaagcaattcaacatactggtctttaaatacggtaggattttttattatgttagatggtagattttaattcagtgaaaaataggaataggattcaatacagtgaatagttgagagagatgtaaattttttttacttagcatggtaacgtagtaatttgtgttataacatcaggattatttccttaacacctrgagagagcctacacattaacttagttagtatttatgcctcaaaatattttgcttcatagcttttactgtcctcagccctgtcactgtgagaactatagcttagactaggttgggtggtatgacattctggctatggagatccagattgaagagaacctttaaaattgtatggaacacttacgttttttcttaatagttttaataatactaatgttggcatttaacctttatgaattgttgattcagttttatgtataaaatttagttacatggaaaaccaactctgattttgacagtaaa

SEQ ID NO: 74509 - DNA, 601 bp, Human
gaaatcaggctacatctgcatatcatagtttaattgtagtttttttctaaatgtgatgtaaattaacagtaaagatgtctgacagtgccatcttagattctgcattatggttttatacagtgctataaaacttgagaattattttttaaattctgttttaactaagcatattttatgctaggaaaattcccaattctttcataaaaatatagattgggggtttattaactttattaggttgaaacatagtctcaaataataaatggcaaatttaaattccatcttggaggacctaaagatrtgtattaaaagttaatatatattcaaaatgtatgactcatttataatcaaagaatttgagaaattataaattgaaacaggatataaatttttaatttctactgtcttattcagtggtaattttttattcaaagttcttaagctgcagaaataaatttataaactgcagtttttgtaaacagccaggtataaatgatttatcctttacccttgtaatttgaaattgtcacctgtctttgaatgttaataaattaatggtgtctattgtttttctgtcaacaaagtaatcttgagataacag

SEQ ID NO: 74510 - DNA, 601 bp, Human
ggtaactctgtacttccagaaacttggcattattcttaactcctctttcttttataccccataatcaggcttttcccaaaatatatacagaatctaaccaaagctcactacttttaactgctaccacccttgtttgaatcattctctcttgcctgaatactccattagccagtcactgggggtccctgattgtccttataccccttcccgtacaatctcttcatataacagccaagacaatccttttttaatacattactcctctgctcaacacccagtaaatgtttgtggtttcattatkattaaaaaccccaaatcttttttttttttttttttttttgagacagagtattgctcttgtcgcccaggctggagtgcagtgatgcaatctcgggtcattacaacctccacctcccaggtccaagcgattctcctgagtagctgggattgcaggcatgtgccaccatgcccagctaatttttgtatttttagtagagacgggatttcaccatgttggccaggctggtctcttaactcctcacttttcaagtggtctgcccaccttggccttccagagtattggaattataggtgtgagcca

SEQ ID NO: 74511 - DNA, 601 bp, Human
ctgggcatcttcaccttgtcgacctcaagacataggtaggagaatctatttgtgtttagaccttttaaaaagaaatttacaattgagaatcagttaataaggcttttttcattttattatccagacttccatgttccatctgagtacttaacgaacattcacattagggataaggtgagtgtagtttattattctactcagtcagcatgaatttatctatttttcacatgtttttcagttcaggcagcatactatttttgaaataattagtaatggtctcagggatatgctttcatatgtycatgttaacttgttaaatggtaaatgttaggactggtaaaaaataaaaattcttacatttaacaacaggttacaaccataaccgcagttgatgagaataaactagattggaacatttgataaatatccttctgataatcttattttatgaccttaccagtaaaaagattttcgttacaagtattacagatacagtgtttttaatgagatggtctgtatctttaaaaactatttatgacctttgacttttctctgtattttttcatttccatttttttaaatcacctaaaattctaattct

SEQ ID NO: 74512 - DNA, 601 bp, Human
caacaggttacaaccataaccgcagttgatgagaataaactagattggaacatttgataaatatccttctgataatcttattttatgaccttaccagtaaaaagattttcgttacaagtattacagatacagtgtttttaatgagatggtctgtatctttaaaaactatttatgacctttgacttttctctgtattttttcatttccatttttttaaatcacctaaaattctaattctaaagtagttattaacaacagattacagcttaatctctcttttttcaatctaagaaagaaaatrgtggcactttttgctttagaagaactgagagtttgtttctattaccaaaaaatattcacaatggtacctaaattttagccttgggaaactacaatttagtgaaaaaatatatttttgttatatatttgtgtataaatatctatgtgtatgtgtatatatacaacagcattctgagtgtgccttacagttctgtggtcaagtggatgttgatgtggacaggcaagtaaagggatacctttctcaatgtcttctaatacttgagtagataaaaggcaagaaatacaagatggagaggtctcc

SEQ ID NO: 74513 - DNA, 601 bp, Human
aaaatttgagactattgaacctatgttttacagtttggtaagcagttatgtttctaccttggggagagaaatgtaaagcaatcatctttcagacatctatttaaacaaactgaaaagccatttctttatgatttttgtattcatcatctgtgatttgctgaaagcatacaactgacttgtgaatcattcactgtcagatatagattcagtttaacattttttataagccgtctatatatttggcactctacaaggtgctttcatataccttcactcattttatttactttcttagtaaccytcataggtgtcattgtccacatttgacaagtaaagctaagagattttaaataactaggacacagtcatattaatgagtaataaaaccaggacttgaatacaagtcctagatctctgagcacaatgctattgttaggttcttttccccattgggtattaaatccttttagtggatcttgcttggaagtctttattgagcttttcttccagtcagcatatcaattagatgtatcagaaataattgtttaaatgacttcagtcatttaaatgaggaaattcccttttagaatcttaactacct

SEQ ID NO: 74514 - DNA, 601 bp, Human
ttatgtttctaccttggggagagaaatgtaaagcaatcatctttcagacatctatttaaacaaactgaaaagccatttctttatgatttttgtattcatcatctgtgatttgctgaaagcatacaactgacttgtgaatcattcactgtcagatatagattcagtttaacattttttataagccgtctatatatttggcactctacaaggtgctttcatataccttcactcattttatttactttcttagtaaccctcataggtgtcattgtccacatttgacaagtaaagctaagagatkttaaataactaggacacagtcatattaatgagtaataaaaccaggacttgaatacaagtcctagatctctgagcacaatgctattgttaggttcttttccccattgggtattaaatccttttagtggatcttgcttggaagtctttattgagcttttcttccagtcagcatatcaattagatgtatcagaaataattgtttaaatgacttcagtcatttaaatgaggaaattcccttttagaatcttaactacctatctgtgtaatcatgtaataacagttatctactacaaagtgggga

SEQ ID NO: 74515 - DNA, 601 bp, Human
gcattttgatttttttctttgaaaaaaaaagataatatctagttgacttactacatgagcccagttaaattctctgaaactgctgcacctgcctttagagctgaaagttctcacacctctttgaagaactgtagcaaaagaaatgatcctgtttcaggttgaaatgtgaaagaatactaagggcaacacatttctaaatttgacttttaaaattttaacataaatttgaatctctggatgaaggtaaggatacactgttgcaacaaatagagataatgaagactaatgaagtcagaaaacmtgaaaattgttaaagaatttagagcatgtctgagggtagctctgaggattaaatgaggtaatgtacatgacagcccatacctaagtgttgagcacttggtaagaacttggacttgaatgacctaagtctaacactcccattttacagataagaaaactgaggcaagaaaggcaaactctgaacatatccacatggagggattcagcaaaagtgtaaggaaaataattgctgtaaagtaatcaaaggacgttctctgatactatgctgtttgggttattactcaagagatacaaaacaatt

SEQ ID NO: 74516 - DNA, 601 bp, Human
tcctctgttgcccaggctggagtgcagtggcacaatctggcttctctgcctcctgggctcaagcaattctctgcctcagcctcccaagtagctgggattacaggcgcccgccaccacaccaggcgaattttttatttatttatttgttttatttttagtagagacgaggttttgccatgttgaccaaggtggtcttgaactcctgacctcatgatccacctgcctcagcctcccaaagtgctgcgattacaggtgtgagccactgcgcccagtcagagaaaccaccagattcttaacaagygatttctcttttcaacttaagatgctgcaaatctcagatatcatctaaaagtttcatctgaagtaagttaagtgatgtaattgggcattttgatttttttctttgaaaaaaaaagataatatctagttgacttactacatgagcccagttaaattctctgaaactgctgcacctgcctttagagctgaaagttctcacacctctttgaagaactgtagcaaaagaaatgatcctgtttcaggttgaaatgtgaaagaatactaagggcaacacatttctaaatttgacttttaaaatttt

SEQ ID NO: 74517 - DNA, 601 bp, Human
aatattaatttcattcattcacatctacatgcttatctgtatctatatattggtctatctatctcttctactcatcatccgtgcccagatccaccattcatccatctttccattcatccatctatccatccatttaatcagtatttacggaacacctaccatgtattagatgccatttaagtactgaaaacctacttcttattgccagacaaataaatgctccctaaaattttcaaatgaaaaccacaaagtagaagtcacaaattcaaatgtctttagaatgcattcaggtaaggaaatraatgaagtggtattccagtgagttggtatctaaaaggagaagacacaagtcagctctagagagttttaggcacagttttgccaaatcttccaaaattttaagagaatccatacatttgggttttaatgtgaatttttgatttttaatgctggtgaaatgatctggatgttttcacaaacactacatgagccaaacacaacatagttattatttagacacctagctatctctagaggctaccagtttgcaacctctgctctagactctgagtacagtcttcaaaagtgccaagtttaagaa

SEQ ID NO: 74518 - DNA, 601 bp, Human
aggtgccatttgcaggccaaggagaggcctcagaagaaactaaacctgcagacaccttcgccttggacttctagcctccaggattgtgagaaaataaatttctgttgtttaagccacctagagtcaggggtattttgttaagacactcctagtaaaccaatacaataagaagtggaaataatagctgatatggtgattcaacaattaacgttcctaaaatgttttttattaaagacaagttagccatattaaaataattaaaatcatttgagaggttttgttttttatttttctaggctgmctaataagtagctgaaactgacttaacaagagggaaaatgcttttaaaatattatttctacaggtaaagttatctaccactacaactcttccctgggctctgtaatctacccataatccaatgagaatagaatatatttttagtatatgtacattctctcactaaaatattaatttcattcattcacatctacatgcttatctgtatctatatattggtctatctatctcttctactcatcatccgtgcccagatccaccattcatccatctttccattcatccatctatccatccattt

SEQ ID NO: 74519 - DNA, 601 bp, Human
tctgcaagatatttcgatgcaggtaacctacagatattaagaaatgatggcttatgtttaaaactatagaagtattaggggatgaattgtgtccccaccaaatttatatgttgaaaccctaaaccccagtacctcagtatgtggagatacggcctttaaagaggtgattaagttaaaatggggccattagagcgggccctaagccaatatgactggtgttcttatgagaagacattaacagacagacaacagaaacagaggtaccactatatgaggacatgcaaaaaggtgccatttgcargccaaggagaggcctcagaagaaactaaacctgcagacaccttcgccttggacttctagcctccaggattgtgagaaaataaatttctgttgtttaagccacctagagtcaggggtattttgttaagacactcctagtaaaccaatacaataagaagtggaaataatagctgatatggtgattcaacaattaacgttcctaaaatgttttttattaaagacaagttagccatattaaaataattaaaatcatttgagaggttttgttttttatttttctaggctgactaataagtagctg

SEQ ID NO: 74520 - DNA, 601 bp, Human
atgtggggtagaaaccaagaatatgttttcataaccagctctgcaagatatttcgatgcaggtaacctacagatattaagaaatgatggcttatgtttaaaactatagaagtattaggggatgaattgtgtccccaccaaatttatatgttgaaaccctaaaccccagtacctcagtatgtggagatacggcctttaaagaggtgattaagttaaaatggggccattagagcgggccctaagccaatatgactggtgttcttatgagaagacattaacagacagacaacagaaacagaggkaccactatatgaggacatgcaaaaaggtgccatttgcaggccaaggagaggcctcagaagaaactaaacctgcagacaccttcgccttggacttctagcctccaggattgtgagaaaataaatttctgttgtttaagccacctagagtcaggggtattttgttaagacactcctagtaaaccaatacaataagaagtggaaataatagctgatatggtgattcaacaattaacgttcctaaaatgttttttattaaagacaagttagccatattaaaataattaaaatcatttgagaggt

SEQ ID NO: 74521 - DNA, 601 bp, Human
agattccctcagctctattccttctaaattctaattctttccatgtggggtagaaaccaagaatatgttttcataaccagctctgcaagatatttcgatgcaggtaacctacagatattaagaaatgatggcttatgtttaaaactatagaagtattaggggatgaattgtgtccccaccaaatttatatgttgaaaccctaaaccccagtacctcagtatgtggagatacggcctttaaagaggtgattaagttaaaatggggccattagagcgggccctaagccaatatgactggtgtycttatgagaagacattaacagacagacaacagaaacagaggtaccactatatgaggacatgcaaaaaggtgccatttgcaggccaaggagaggcctcagaagaaactaaacctgcagacaccttcgccttggacttctagcctccaggattgtgagaaaataaatttctgttgtttaagccacctagagtcaggggtattttgttaagacactcctagtaaaccaatacaataagaagtggaaataatagctgatatggtgattcaacaattaacgttcctaaaatgttttttattaaag

SEQ ID NO: 74522 - DNA, 601 bp, Human
gtgtgcatcgattcactctgatatttgtttaaaatgcagattccctcagctctattccttctaaattctaattctttccatgtggggtagaaaccaagaatatgttttcataaccagctctgcaagatatttcgatgcaggtaacctacagatattaagaaatgatggcttatgtttaaaactatagaagtattaggggatgaattgtgtccccaccaaatttatatgttgaaaccctaaaccccagtacctcagtatgtggagatacggcctttaaagaggtgattaagttaaaatgggrccattagagcgggccctaagccaatatgactggtgttcttatgagaagacattaacagacagacaacagaaacagaggtaccactatatgaggacatgcaaaaaggtgccatttgcaggccaaggagaggcctcagaagaaactaaacctgcagacaccttcgccttggacttctagcctccaggattgtgagaaaataaatttctgttgtttaagccacctagagtcaggggtattttgttaagacactcctagtaaaccaatacaataagaagtggaaataatagctgatatggtgat

SEQ ID NO: 74523 - DNA, 601 bp, Human
gagctcacatgatcctcccaccttagcctcccaaagtgctgggattgcatgcgaaccaccacgccccgcctcttccttattttccgtctttcctccatgattgccaaataatctctttgtacatctgccccatctgtcatcttcattccccttgaagcatcaaaaacttttcatgagtttctatttcaggataaagtctaagtttctttctaggcacttgagttcttctcaaactggattttatccctgcctcccaaccaaacaacagcatctttacagaaattgggataccaatctagtwacaagcagagtggtgaggagacttgattggaactgcatttatgtagcattttatgtaaaatggagtaaacatccactattcatatgaaataattggaggattacttgtaaaaatcagggtgggatggggcaaaaaaccaaaccatcctttggtgcaggtttttgaaaatgagaagaaaaacaaaacggaaaagaattgtgcacaacctccagttaattaaatacatttctagagaggtaatttctttttttcttttttctttttttttttttttttttgagatggagtctcactctgtca

SEQ ID NO: 74524 - DNA, 601 bp, Human
tgagtagccaggaccacaggtgcacaccaccatgcccagctaatttttgtattttcttttttttttgagatggagtctagctctgtcgctgaggctggagtgcagtggcatgatctcggctcactgcaacctccgcctcctgggttcaagcgattctcctgcctcagcctcctgagtagctgggattacaggcgcctgccaccacgcccagctaatttttatatttttagtagagatagggtttcattgtgttggccaggctggtctcgaactcctgacctcgtgatccacccgccttggmctcccaaagtgctgggattacaagcatgagctagcgtgcccagcctaatttttgtattattttgtagagatagggtttcgccatgttgccccagctggtctcaaactcctgagctcacatgatcctcccaccttagcctcccaaagtgctgggattgcatgcgaaccaccacgccccgcctcttccttattttccgtctttcctccatgattgccaaataatctctttgtacatctgccccatctgtcatcttcattccccttgaagcatcaaaaacttttcatgagtttctatttcagg

SEQ ID NO: 74525 - DNA, 601 bp, Human
tagcatagtcaaaatgagtaacaacagtagtaacagctaaatctaattctgtgagcatgaaagttcccttttcgaaaataatatttttcttgcctgttcccttttttccttattttattgcctttacctggagtcccttcattttgtgttggattactttgaaagccttctaagtgtcttccttattttcttttgagacagggccttgctctgtcacccgggctggagtccagtgacgtgatcatggctcactgcagtctcaacctcctgggctcaagtgattctcccacctcagcctcaygagtagccaggaccacaggtgcacaccaccatgcccagctaatttttgtattttcttttttttttgagatggagtctagctctgtcgctgaggctggagtgcagtggcatgatctcggctcactgcaacctccgcctcctgggttcaagcgattctcctgcctcagcctcctgagtagctgggattacaggcgcctgccaccacgcccagctaatttttatatttttagtagagatagggtttcattgtgttggccaggctggtctcgaactcctgacctcgtgatccacccgccttgga

SEQ ID NO: 74526 - DNA, 601 bp, Human
gtagcatagtcaaaatgagtaacaacagtagtaacagctaaatctaattctgtgagcatgaaagttcccttttcgaaaataatatttttcttgcctgttcccttttttccttattttattgcctttacctggagtcccttcattttgtgttggattactttgaaagccttctaagtgtcttccttattttcttttgagacagggccttgctctgtcacccgggctggagtccagtgacgtgatcatggctcactgcagtctcaacctcctgggctcaagtgattctcccacctcagcctcrtgagtagccaggaccacaggtgcacaccaccatgcccagctaatttttgtattttcttttttttttgagatggagtctagctctgtcgctgaggctggagtgcagtggcatgatctcggctcactgcaacctccgcctcctgggttcaagcgattctcctgcctcagcctcctgagtagctgggattacaggcgcctgccaccacgcccagctaatttttatatttttagtagagatagggtttcattgtgttggccaggctggtctcgaactcctgacctcgtgatccacccgccttgg

SEQ ID NO: 74527 - DNA, 601 bp, Human
tctagactctttagaattagaagtgattgtatttgctatagaaataaattcaaccttataacaaaaagggcagccaatccatgagttggtgccaaaagcttttcttaaaggcacgacagcaccacattacatctgtataggacctgataatctacaacatgctttctcagttggaataggggctcagagacattaaatgactcactcgtgttgtataggaacaggtagtaaagttgagcttccaatacctgtctctaaatcctgttttctctctatcacaccttagctgtcctagtgtggkaaatgatgtcatgaattgcatattcagtgtaatgacaaaaaataaaaatagatgtctacggaaaatgataggcatatttatagaatttttcagatgttggtttgctactgtagcatagtcaaaatgagtaacaacagtagtaacagctaaatctaattctgtgagcatgaaagttcccttttcgaaaataatatttttcttgcctgttcccttttttccttattttattgcctttacctggagtcccttcattttgtgttggattactttgaaagccttctaagtgtcttccttattttc

SEQ ID NO: 74528 - DNA, 601 bp, Human
ccagagttccataagcaggcttgacgtcaacacaatttttcttttctcaaaagaaaagacaaagtatggcaaaattcctgaaccaaaatgaattcttttttccttttcttttttttaaatgtgacttaggaagccaagtgtgatgatgtgtgcccttagttccagttactcaggaggctgaggcaggagggttgcttgggtccaggtattggaggctatagtgcatcataatagtgcctgtgaatagctactgcacttcagcctgggcaacatagaaagaccctgttttttttttttttttaatgttatttagaaagagaaagaaagctatatttatagcacaaatgatatttgcttcttaattgtttttgtgacagcatggtcattaaaacattagtatttattgatatagaaatgtctagactctttagaattagaagtgattgtatttgctatagaaataaattcaaccttataacaaaaagggcagccaatccatgagttggtgccaaaagcttttcttaaaggcacgacagcaccacattacatctgtataggacctgataatctacaacatgctttctcagttggaataggggct

SEQ ID NO: 74529 - DNA, 601 bp, Human
aatgcatagtcaaaatgaataacaacagtaagttctataatattcattgtatatacttgaataaatctaccagcaccagaaagccccagagttccataagcaggcttgacgtcaacacaatttttcttttctcaaaagaaaagacaaagtatggcaaaattcctgaaccaaaatgaattcttttttccttttcttttttttaaatgtgacttaggaagccaagtgtgatgatgtgtgcccttagttccagttactcaggaggctgaggcaggagggttgcttgggtccaggtattggaggytatagtgcatcataatagtgcctgtgaatagctactgcacttcagcctgggcaacatagaaagaccctgttttttttttttttttaatgttatttagaaagagaaagaaagctatatttatagcacaaatgatatttgcttcttaattgtttttgtgacagcatggtcattaaaacattagtatttattgatatagaaatgtctagactctttagaattagaagtgattgtatttgctatagaaataaattcaaccttataacaaaaagggcagccaatccatgagttggtgccaaaagc

SEQ ID NO: 74530 - DNA, 601 bp, Human
aactaataataaatcaaatcaaaaaataataaatcaaagctttagtcttgattaatatatcaatatttatcattagccataaatttagagcactttgtaattcttggttcccaacagacctgaaatatggaatgacaaatgcatagtcaaaatgaataacaacagtaagttctataatattcattgtatatacttgaataaatctaccagcaccagaaagccccagagttccataagcaggcttgacgtcaacacaatttttcttttctcaaaagaaaagacaaagtatggcaaaattccygaaccaaaatgaattcttttttccttttcttttttttaaatgtgacttaggaagccaagtgtgatgatgtgtgcccttagttccagttactcaggaggctgaggcaggagggttgcttgggtccaggtattggaggctatagtgcatcataatagtgcctgtgaatagctactgcacttcagcctgggcaacatagaaagaccctgttttttttttttttttaatgttatttagaaagagaaagaaagctatatttatagcacaaatgatatttgcttcttaattgtttttgtgacagca

SEQ ID NO: 74531 - DNA, 601 bp, Human
aaccagtgaagtattataaaatatgagaactaataataaatcaaatcaaaaaataataaatcaaagctttagtcttgattaatatatcaatatttatcattagccataaatttagagcactttgtaattcttggttcccaacagacctgaaatatggaatgacaaatgcatagtcaaaatgaataacaacagtaagttctataatattcattgtatatacttgaataaatctaccagcaccagaaagccccagagttccataagcaggcttgacgtcaacacaatttttcttttctcaaargaaaagacaaagtatggcaaaattcctgaaccaaaatgaattcttttttccttttcttttttttaaatgtgacttaggaagccaagtgtgatgatgtgtgcccttagttccagttactcaggaggctgaggcaggagggttgcttgggtccaggtattggaggctatagtgcatcataatagtgcctgtgaatagctactgcacttcagcctgggcaacatagaaagaccctgttttttttttttttttaatgttatttagaaagagaaagaaagctatatttatagcacaaatgatatt

SEQ ID NO: 74532 - DNA, 601 bp, Human
tatgtaactttgggtggtttttagatattagacaaccacaaaagatacacatctgattataaacctaggatagggttgcttaccaaaatggattctcccagtagctgggattccctatatccctagatttttttttttttttaagatggagtctcgctcttgtcacacaggctggagtgcagtggcgtgatctcggctcactgcaacctccgcctcccgggttcaagcaattcttctgcctcagtttcccgagtagctgggattacaggcacacgccactgtgtccggtgaatttttttttgtatttttagtagagacagggtttcaccatgttggccaggctggtctcaaactcctgacttcaggtgatctgcccgcctcagcttcccaaggtgctgggattacaggcatgagccaccgcatctggccccctatatccctaggtttttaaaatctcaattttggggcactttggtgctgccagagcacccagagtaagtgggaatgggcaaatcttgcacccagctgttcaccttatttcaactctcaaagccaaggatcagtttgagaagtcctgctttgcctatgttgaatctccacc

SEQ ID NO: 74533 - DNA, 601 bp, Human
tctttggcttgcagtttagcaactttttcaaacattgacaaacatccaggttatgcctggataaatactgaagatctcaacagaaaatctagatattaagaaataatttgaaatatacactgaacttcttcctaggttgtagattgttggtgtctagtatatgtaactttgggtggtttttagatattagacaaccacaaaagatacacatctgattataaacctaggatagggttgcttaccaaaatggattctcccagtagctgggattccctatatccctagatttttttttttttttaagatggagtctcgctcttgtcacacaggctggagtgcagtggcgtgatctcggctcactgcaacctccgcctcccgggttcaagcaattcttctgcctcagtttcccgagtagctgggattacaggcacacgccactgtgtccggtgaatttttttttgtatttttagtagagacagggtttcaccatgttggccaggctggtctcaaactcctgacttcaggtgatctgcccgcctcagcttcccaaggtgctgggattacaggcatgagccaccgcatctggccccctatatcccta

SEQ ID NO: 74534 - DNA, 601 bp, Human
aaactgaaaaagaacgttttcctccagaaacagctgtgatggcaatattgtatttactaccagcagtgagattgaaaaaagtgtattcattccatgaagtactttcttgaatttgaaccccctgtatcttttggttattttcatcaaataattgcacctcatatgaggtgacttttccggaagaaggagtccaccaaacatgcaagctggttgaagtcgtcttctctttactgactccaaacctagcaggaggtaaaggatctgcaaggcaaatacacacacacacacaaaaaaaaaaaaagaaagaaaaagaaaaaaaaagaacatggcttgaagacttttgcaaataactgcttattttactgcagtccaggttcatttttctcaaaaatctgttatttgtgaaataaattgccattttgcttcacttccaaacctaccctttcactttcttaaaaaaaaaaaaacccatttagctactagtcatatgaattcctttttctactgaaactttttttgttgttgttaaggtagctctgatcttgaaagtccaagcaaagttatattttctttggcttgcagtttagcaactttttcaaac

SEQ ID NO: 74535 - DNA, 601 bp, Human
tccattggtataaactgaaaaagaacgttttcctccagaaacagctgtgatggcaatattgtatttactaccagcagtgagattgaaaaaagtgtattcattccatgaagtactttcttgaatttgaaccccctgtatcttttggttattttcatcaaataattgcacctcatatgaggtgacttttccggaagaaggagtccaccaaacatgcaagctggttgaagtcgtcttctctttactgactccaaacctagcaggaggtaaaggatctgcaaggcaaatacacacacacacacamaaaaaaaaaaagaaagaaaaagaaaaaaaaagaacatggcttgaagacttttgcaaataactgcttattttactgcagtccaggttcatttttctcaaaaatctgttatttgtgaaataaattgccattttgcttcacttccaaacctaccctttcactttcttaaaaaaaaaaaaacccatttagctactagtcatatgaattcctttttctactgaaactttttttgttgttgttaaggtagctctgatcttgaaagtccaagcaaagttatattttctttggcttgcagtttagcaa

SEQ ID NO: 74536 - DNA, 601 bp, Human; identical to SEQ ID NO: 25934

SEQ ID NO: 74537 - DNA, 601 bp, Human; identical to SEQ ID NO: 25935

SEQ ID NO: 74538 - DNA, 601 bp, Human; identical to SEQ ID NO: 25936

SEQ ID NO: 74539 - DNA, 601 bp, Human; identical to SEQ ID NO: 25937

SEQ ID NO: 74540 - DNA, 601 bp, Human; identical to SEQ ID NO: 25938

SEQ ID NO: 74541 - DNA, 601 bp, Human; identical to SEQ ID NO: 25939

SEQ ID NO: 74542 - DNA, 601 bp, Human; identical to SEQ ID NO: 25940

SEQ ID NO: 74543 - DNA, 601 bp, Human; identical to SEQ ID NO: 25941

SEQ ID NO: 74544 - DNA, 601 bp, Human; identical to SEQ ID NO: 25942

SEQ ID NO: 74545 - DNA, 601 bp, Human; identical to SEQ ID NO: 25943

SEQ ID NO: 74546 - DNA, 601 bp, Human; identical to SEQ ID NO: 25944

SEQ ID NO: 74547 - DNA, 601 bp, Human; identical to SEQ ID NO: 25945

SEQ ID NO: 74548 - DNA, 601 bp, Human; identical to SEQ ID NO: 25946

SEQ ID NO: 74549 - DNA, 601 bp, Human; identical to SEQ ID NO: 25947

SEQ ID NO: 74550 - DNA, 601 bp, Human; identical to SEQ ID NO: 25948

SEQ ID NO: 74551 - DNA, 601 bp, Human; identical to SEQ ID NO: 25949

SEQ ID NO: 74552 - DNA, 601 bp, Human; identical to SEQ ID NO: 25950

SEQ ID NO: 74553 - DNA, 601 bp, Human; identical to SEQ ID NO: 25951

SEQ ID NO: 74554 - DNA, 601 bp, Human; identical to SEQ ID NO: 25952

SEQ ID NO: 74555 - DNA, 601 bp, Human; identical to SEQ ID NO: 25953

SEQ ID NO: 74556 - DNA, 601 bp, Human; identical to SEQ ID NO: 25954

SEQ ID NO: 74557 - DNA, 601 bp, Human; identical to SEQ ID NO: 25955

SEQ ID NO: 74558 - DNA, 601 bp, Human; identical to SEQ ID NO: 25956

SEQ ID NO: 74559 - DNA, 601 bp, Human; identical to SEQ ID NO: 25957

SEQ ID NO: 74560 - DNA, 601 bp, Human; identical to SEQ ID NO: 25958

SEQ ID NO: 74561 - DNA, 601 bp, Human; identical to SEQ ID NO: 25959

SEQ ID NO: 74562 - DNA, 601 bp, Human; identical to SEQ ID NO: 25960

SEQ ID NO: 74563 - DNA, 601 bp, Human; identical to SEQ ID NO: 25961

SEQ ID NO: 74564 - DNA, 601 bp, Human; identical to SEQ ID NO: 25962

SEQ ID NO: 74565 - DNA, 601 bp, Human; identical to SEQ ID NO: 25963

SEQ ID NO: 74566 - DNA, 601 bp, Human; identical to SEQ ID NO: 25964

SEQ ID NO: 74567 - DNA, 601 bp, Human; identical to SEQ ID NO: 25965

SEQ ID NO: 74568 - DNA, 601 bp, Human; identical to SEQ ID NO: 25966

SEQ ID NO: 74569 - DNA, 601 bp, Human; identical to SEQ ID NO: 25967

SEQ ID NO: 74570 - DNA, 601 bp, Human; identical to SEQ ID NO: 25968

SEQ ID NO: 74571 - DNA, 601 bp, Human; identical to SEQ ID NO: 25969

SEQ ID NO: 74572 - DNA, 601 bp, Human; identical to SEQ ID NO: 25970

SEQ ID NO: 74573 - DNA, 601 bp, Human; identical to SEQ ID NO: 25971

SEQ ID NO: 74574 - DNA, 601 bp, Human; identical to SEQ ID NO: 25972

SEQ ID NO: 74575 - DNA, 601 bp, Human; identical to SEQ ID NO: 25973

SEQ ID NO: 74576 - DNA, 601 bp, Human; identical to SEQ ID NO: 25974

SEQ ID NO: 74577 - DNA, 601 bp, Human; identical to SEQ ID NO: 25975

SEQ ID NO: 74578 - DNA, 601 bp, Human; identical to SEQ ID NO: 25976

SEQ ID NO: 74579 - DNA, 601 bp, Human; identical to SEQ ID NO: 25977

SEQ ID NO: 74580 - DNA, 601 bp, Human; identical to SEQ ID NO: 25978

SEQ ID NO: 74581 - DNA, 601 bp, Human; identical to SEQ ID NO: 25979

SEQ ID NO: 74582 - DNA, 601 bp, Human; identical to SEQ ID NO: 25980

SEQ ID NO: 74583 - DNA, 601 bp, Human; identical to SEQ ID NO: 25981

SEQ ID NO: 74584 - DNA, 601 bp, Human; identical to SEQ ID NO: 25982

SEQ ID NO: 74585 - DNA, 601 bp, Human; identical to SEQ ID NO: 25983

SEQ ID NO: 74586 - DNA, 601 bp, Human; identical to SEQ ID NO: 25984

SEQ ID NO: 74587 - DNA, 601 bp, Human; identical to SEQ ID NO: 25985

SEQ ID NO: 74588 - DNA, 601 bp, Human; identical to SEQ ID NO: 25986

SEQ ID NO: 74589 - DNA, 601 bp, Human; identical to SEQ ID NO: 25987

SEQ ID NO: 74590 - DNA, 601 bp, Human; identical to SEQ ID NO: 25988

SEQ ID NO: 74591 - DNA, 601 bp, Human; identical to SEQ ID NO: 25989

SEQ ID NO: 74592 - DNA, 601 bp, Human; identical to SEQ ID NO: 25990

SEQ ID NO: 74593 - DNA, 601 bp, Human; identical to SEQ ID NO: 25991

SEQ ID NO: 74594 - DNA, 601 bp, Human; identical to SEQ ID NO: 25992

SEQ ID NO: 74595 - DNA, 601 bp, Human; identical to SEQ ID NO: 25993

SEQ ID NO: 74596 - DNA, 601 bp, Human; identical to SEQ ID NO: 25994

SEQ ID NO: 74597 - DNA, 601 bp, Human; identical to SEQ ID NO: 25995

SEQ ID NO: 74598 - DNA, 601 bp, Human; identical to SEQ ID NO: 25996

SEQ ID NO: 74599 - DNA, 601 bp, Human; identical to SEQ ID NO: 25997

SEQ ID NO: 74600 - DNA, 601 bp, Human; identical to SEQ ID NO: 25998

SEQ ID NO: 74601 - DNA, 601 bp, Human; identical to SEQ ID NO: 25999

SEQ ID NO: 74602 - DNA, 601 bp, Human; identical to SEQ ID NO: 26000

SEQ ID NO: 74603 - DNA, 601 bp, Human; identical to SEQ ID NO: 26001

SEQ ID NO: 74604 - DNA, 601 bp, Human; identical to SEQ ID NO: 26002

SEQ ID NO: 74605 - DNA, 601 bp, Human; identical to SEQ ID NO: 26003

SEQ ID NO: 74606 - DNA, 601 bp, Human; identical to SEQ ID NO: 26004

SEQ ID NO: 74607 - DNA, 601 bp, Human; identical to SEQ ID NO: 26005

SEQ ID NO: 74608 - DNA, 601 bp, Human; identical to SEQ ID NO: 26006

SEQ ID NO: 74609 - DNA, 601 bp, Human; identical to SEQ ID NO: 26007

SEQ ID NO: 74610 - DNA, 601 bp, Human; identical to SEQ ID NO: 26008

SEQ ID NO: 74611 - DNA, 601 bp, Human; identical to SEQ ID NO: 26009

SEQ ID NO: 74612 - DNA, 601 bp, Human; identical to SEQ ID NO: 26010

SEQ ID NO: 74613 - DNA, 601 bp, Human; identical to SEQ ID NO: 26011

SEQ ID NO: 74614 - DNA, 601 bp, Human; identical to SEQ ID NO: 26012

SEQ ID NO: 74615 - DNA, 601 bp, Human; identical to SEQ ID NO: 26013

SEQ ID NO: 74616 - DNA, 601 bp, Human; identical to SEQ ID NO: 26014

SEQ ID NO: 74617 - DNA, 601 bp, Human; identical to SEQ ID NO: 26015

SEQ ID NO: 74618 - DNA, 601 bp, Human; identical to SEQ ID NO: 26016

SEQ ID NO: 74619 - DNA, 601 bp, Human; identical to SEQ ID NO: 26017

SEQ ID NO: 74620 - DNA, 601 bp, Human; identical to SEQ ID NO: 26018

SEQ ID NO: 74621 - DNA, 601 bp, Human; identical to SEQ ID NO: 26019

SEQ ID NO: 74622 - DNA, 601 bp, Human; identical to SEQ ID NO: 26020

SEQ ID NO: 74623 - DNA, 601 bp, Human; identical to SEQ ID NO: 26021

SEQ ID NO: 74624 - DNA, 601 bp, Human; identical to SEQ ID NO: 26022

SEQ ID NO: 74625 - DNA, 601 bp, Human; identical to SEQ ID NO: 26023

SEQ ID NO: 74626 - DNA, 601 bp, Human; identical to SEQ ID NO: 26024

SEQ ID NO: 74627 - DNA, 601 bp, Human; identical to SEQ ID NO: 26025

SEQ ID NO: 74628 - DNA, 601 bp, Human; identical to SEQ ID NO: 26026

SEQ ID NO: 74629 - DNA, 601 bp, Human; identical to SEQ ID NO: 26027

SEQ ID NO: 74630 - DNA, 601 bp, Human; identical to SEQ ID NO: 26028

SEQ ID NO: 74631 - DNA, 601 bp, Human; identical to SEQ ID NO: 26029

SEQ ID NO: 74632 - DNA, 601 bp, Human; identical to SEQ ID NO: 26030

SEQ ID NO: 74633 - DNA, 601 bp, Human; identical to SEQ ID NO: 26031

SEQ ID NO: 74634 - DNA, 601 bp, Human; identical to SEQ ID NO: 26032

SEQ ID NO: 74635 - DNA, 601 bp, Human; identical to SEQ ID NO: 26033

SEQ ID NO: 74636 - DNA, 601 bp, Human; identical to SEQ ID NO: 26034

SEQ ID NO: 74637 - DNA, 601 bp, Human; identical to SEQ ID NO: 26035

SEQ ID NO: 74638 - DNA, 601 bp, Human; identical to SEQ ID NO: 26036

SEQ ID NO: 74639 - DNA, 601 bp, Human; identical to SEQ ID NO: 26037

SEQ ID NO: 74640 - DNA, 601 bp, Human; identical to SEQ ID NO: 26038

SEQ ID NO: 74641 - DNA, 601 bp, Human; identical to SEQ ID NO: 26039

SEQ ID NO: 74642 - DNA, 601 bp, Human; identical to SEQ ID NO: 26040

SEQ ID NO: 74643 - DNA, 601 bp, Human; identical to SEQ ID NO: 26041

SEQ ID NO: 74644 - DNA, 601 bp, Human; identical to SEQ ID NO: 26042

SEQ ID NO: 74645 - DNA, 601 bp, Human; identical to SEQ ID NO: 26043

SEQ ID NO: 74646 - DNA, 601 bp, Human; identical to SEQ ID NO: 26044

SEQ ID NO: 74647 - DNA, 601 bp, Human; identical to SEQ ID NO: 26045

SEQ ID NO: 74648 - DNA, 601 bp, Human; identical to SEQ ID NO: 26046

SEQ ID NO: 74649 - DNA, 601 bp, Human; identical to SEQ ID NO: 26047

SEQ ID NO: 74650 - DNA, 601 bp, Human; identical to SEQ ID NO: 26048

SEQ ID NO: 74651 - DNA, 601 bp, Human; identical to SEQ ID NO: 26049

SEQ ID NO: 74652 - DNA, 601 bp, Human; identical to SEQ ID NO: 26050

SEQ ID NO: 74653 - DNA, 601 bp, Human; identical to SEQ ID NO: 26051

SEQ ID NO: 74654 - DNA, 601 bp, Human
tccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaaggtgagcaaggccgcaatcctggtccycgacggctgggactgggctgaaagggatcgggacccgcacgctccagtgccgaagcggtggtgtggtgaggggggagggggcgatattaacatctgagatgagagccaacactggtccggtggagaaaggagtgtgttagggaatccgcagctggagccgagaggacgcttttgtagaaactattacctccaactaagacctctctccttattttatttttattgctatttttgaaggagctggtcagcatttgcctagactctcgggacaacacggtaaatagctttcaaggatttggg

SEQ ID NO: 74655 - DNA, 601 bp, Human
cttacctgttctgacttttggcggttaattatgttattaaactgacttgcagtggccctcgttgcctttttgggaatgtatcatattttataaatcttgttatctccagttcctacttggtatttgtaacttaggaatttgacacttcattgtttaaactgatgaaggcaatatcaagaactgttgtgcatacacagatttattagacttaagaggctagagagtacaagtggtgtttttttttttttttttttttttttaaagacagagtcttgctatgtccccaaggctggagtgcggkggcacagtctcggctcactgcaacctccacctcccgggttcaagtgattctcccacctcagcttcctgagaggctgggactacaggtgcacgccaccacgcctggctaatttttgtatatttagtagagacggggtttcgccatgttggccaggccggtctcgaactcctgacctcaagtgatctgcccgccttggcctcccaaagtgctgggattacaggtgtgagccaccgtgcctggcctttttttttttttttttttaacaacctcacactaaggagcaattgtaaatctgctgcc

SEQ ID NO: 74656 - DNA, 601 bp, Human
ggttcaagtgattctcccacctcagcttcctgagaggctgggactacaggtgcacgccaccacgcctggctaatttttgtatatttagtagagacggggtttcgccatgttggccaggccggtctcgaactcctgacctcaagtgatctgcccgccttggcctcccaaagtgctgggattacaggtgtgagccaccgtgcctggcctttttttttttttttttttaacaacctcacactaaggagcaattgtaaatctgctgcctccttcattttaagtacattaaacataccaattttaraatgaaaaaatgaaggctgattgactgtggtggcagataagtgactgtatgctcttgtttattgaaacagtgttgtttttatgctttcttaacatttcaagtctcaatgtctgtgtttacaagtggtgtattaagagcatgaaggctggagccagatgacctgaatttgaattggtggcctcatgcactttatttaaccatttttttttctgtcatggtacctaattcataggttggttttgaatattaaataagttaatatgtttcgaatacttacaacattgcctgaagtctattaca

SEQ ID NO: 74657 - DNA, 601 bp, Human
ggagtaattcgggcaattgagtccagtgttgagtacagtgtccctaaaacaccatctctttgtatctatttgggaagagtgccaaagtaaagacaattctgtgctgtgctcccaagagggcttaagtagatctgggattgggtccaggaatttataggtaatcacaatgtatcactctttctttcttgtaaagccaatagaaatatctaattttagttttaataaggttcttgataaatcgaaaatggtattatctcctagatgacttggtcaacatgttaaggtatttgggcaatttttwaaaaatcttaaactggcctgttttgttgaaggtttaaataagtaagttaagcagctcctattatgagacttacggtaagttcattctgaggatatggaaagtatcaggcagcattattatttgcaagaaactggggtataagaggtaacagtagtttaaggagatgacaagtacttcgtgggatgtgaagaaaatgttggagggttagctgctgaaagggtattgttaatagcgctttactgtcttgatttgagccctgtggccaactaatatatgtcaatttcttgcctggagattgaa

SEQ ID NO: 74658 - DNA, 601 bp, Human
aggagatgacaagtacttcgtgggatgtgaagaaaatgttggagggttagctgctgaaagggtattgttaatagcgctttactgtcttgatttgagccctgtggccaactaatatatgtcaatttcttgcctggagattgaataatacattaggaaacatttagattagatccattttagggctcttactgtgaataatggaaatctgccagagttagtacatgccctgtcagaaaatgtcatgcctctattttagtactgtttctaaataggaggaaaaactacagacacattacctctstggttaatattactactttggtcactccaactctcttctcacctttgaatagacacagtctaagcagaatcttaagattttagagctgccatgttggcgttagcctgtagctacttaggaggctgaggtggaaggatcttgaggccaggagttcaagtatagcttgggcaatataccaagatcctgtctcaaaaaaaaaaagagagagaggttttaagtttatgggagattatttaataaacttgaaattagcgtatcaaaggacattgcccgggtttctttggagacttgtgaataatt

SEQ ID NO: 74659 - DNA, 601 bp, Human
ctctgagtgtttctttacagtagataggatcctgtaagtagaattatcagttcaaaggctagaaatgagtttaaagttcttagttatacatgacacttaattgatttccataaggattataccacattacactttgatatttgaccagtgtcttaaccttgtgtctaaagggctaactgggagaaagaaaaggcggtaaaattggaggagagcaattaagcaatgtcaaggagtttatacacatacagtaaactgatagtagtagaatactatggcctggagccatcaattggtttattartgctcttcactcactcctgcagttaggcaaatcccatgttggtggcagaaattttctggaccattgaatattctagcatttgagccagcaagttgctatgtagtgatcctgcataagtcatgactaactttaattaacatgctttaaagtatatgatgatgggaagtatttaggagctgggatactataatgttttgtattggaggcctttcatgatttttagggttaaactgaaaaagctaatgtccaaactgtaattgaatttcagatgaagctgttattatgcattgatttttatta

SEQ ID NO: 74660 - DNA, 601 bp, Human
cctttggttcctagtgagtttggccaatagaaggcactagccaaagattactgctagaaggagggagaaatcaaatcatttattctcctagcctccaccctggccagcccccattaggcagtggcttcattctctcttccagttctatagtcagcccctcttacaaggctgatgttctggccaaattcctgaaacagttctctgtctttatcccttgagagcaatagcttctccctgcttctagaccctaagtatgttttctccatgcttaatacattatttctgctccaaaccttgatcsctttggctagtccatcccttcatttcattctctgggattttctttttgagtgtcctgctgggaccatgactgatataagacatggtaggtttggtggtagacctttgagtttgaagcagttgaaaacaaataaataaacaaaaacaggtacttgatatgagtctgaagggtagaggagatggaaggcctggagatgtgaatgggatcccctagcagagagaaagggagtgaagggcagtgggccggaagggggtcttgagaggcaccgattgttaatttcaggcaaataaggaatttaag

SEQ ID NO: 74661 - DNA, 601 bp, Human
tttaagctatttacaccagcctgagttttctgcctattgccatttttttcttttttatagccccaataacaaattgagtagaaaacagtttttattcttcccgagggtgttccacgatgaaccatggtaaggagttgggaatgctagtgtgagaaaaatgcatggcacatagtaagcattctatacatgcagattttatattattccaatctctgctcaagaaacatttttattcagcacttctttctgaacagcctatctaaaatcatccctatcactctaatattttaccactcttacytaagcttctttttcttcagagaatgtatcattcactaaatgacattacattgcatattttatgataacttagctcctctatgggaatatttataggtttcatgacagcaaggactttgtccattgtgttcactgttgtatcctcagctcctggaagagtgcctggcctatggtaatgtccagtgaacatttgttgaacgagtgaatgaatgagtgttgaataaataaatggagtgagggaggtcaaatggaaggtatgggacagactcgagacagaggaatagcaggatgcaggtgtgca

SEQ ID NO: 74662 - DNA, 601 bp, Human
ggctaacatgaggaagccttgaaataatgaaacagttatatatcttgattgtggtggtaattacataaagttatacatgtgataaatttgtaagatctggacatacactcacaaatgagcacatatgtaactggtgaaatctgtatatgctctatgagatgtactaatatcaatttcaccttttggatttttcttgttttaatatgtaagatatcaacattgggggaggcaggatcaaaagtacctggaactttcctgtatatttccttgcaacttcgtataaatctgtagttatctccargaaaaatgtttttaaaaactttattaggtttttcaaagcttgctttgttttgttttttgtatgtgtgtgtggcactctgctatgtattttaacagtggatagatatagtctttgtcctacagggactgtttcagaaaaacaataactacaattgcagggaaagtaagttatcgaagcaaatttgaagcacctaggaacatacacaaaatacacaaagacctcaataaaacaccattagctgcaaactcaaatttattatgaagcacgttgtatattggactatattcttaccaggtttat

SEQ ID NO: 74663 - DNA, 601 bp, Human
attgttaaaggcaacattttaatgactcttcagagaatcagataaaaaaggaaattaccactgtaagaggtaagggcaaaatattaattgataaagtaatattcttccattcttttagtaattattaagtagcatatctggaaatggtataaataagtctgaacaaaatagaaagtataagataagcttacaaggtttgagtaaaacaggagcggagtagaggaaaagaatggatgaagtattaatgtgaagatgaatacatgttcagatatttccaccagtcaatcatcaaacatgtatkaaggtaaacatgtaaggaaggcactgtgttcctcattttaagagtacaaaacaaagttattttgctaagaagtctgtaatacaagtgaaaataacaaacatgtaagaagctaaagggcaatatatgagttaatactataatagaagctttgaagtattaacgtattagtttataaatgaatgagaaagagaactgtattgaaataaatgtccttgcattcagataaaggaaaaagctcttgggctggagggagcactgatttcatgaaggaagacaaaaatttaatataagtccaataga

SEQ ID NO: 74664 - DNA, 601 bp, Human
attcctgcccatccaaaatcattcttgcggtttcttttttctgtccgtcaatctgtcaggcacatgttcccagaaaaaagtctgtatatcagtggattcctatatattcgtaaacgtcaggcttattcttttgttttttatcttcttcagtgtaatagatttgatgcttctgtactctgtaagataattacacagagctgaatgtaatgttacgtgctgatggggagaactggtgttttaaattcttttaaatctggagcttttatggtcaacgttagaagcaccatggcagacttatgcyctggctttagaagcctgtatgagattttgtgacttgctggctttatgagacttttacacctcagattggcctttccctccaagaaagataccaccagacaacaacaattttaacactaatgtcttccttttgattacattagatttgcaaattaaacagattaatagtagtgttctgtgttcctctcagctcttctgtttaatactcttatctgacaaagtgtaaatagaagacataattaattactcattacttgcatgtcaagttgcataaaaaattacatccccaggaggcctatta

SEQ ID NO: 74665 - DNA, 601 bp, Human
aatttctgtctaatggcaactatttttatgttagccctgtcttttatatactgaccagatcattctcattaaaaattgttgtttatctaatttcatacccataccacccagcattctatttgtacagtgttttatgtctatgatcaccaatcatctttcatatgttatatttgagcataatttattctttctttctatgaacatttatagagcatcaattgtgtgccaaatactgtgctaatcattcagtgtctccttggatttcacttatctgtaggtaaaagtgattacatatttatartaataactccaattacagtgcagttggctcaaccagtacacacccaatatcagcctttttcctatgaagagccctcacaggtgttgctcagtgcccagtggggctttgctgtggaaccctagttctctgcccttccagcctcgaagttttcctgttagacatctgccctgctcgaccaggtgctaccactgccaatcccagcaccttccttgatgtacccaaaatcttcccatgccttgaaaactaagcctttcttagtatgtcaagctgttgctttggggttttctttgttagtttggt

SEQ ID NO: 74666 - DNA, 601 bp, Human
cttataactcccatttatgtgcaggttacaatatccattagacatagaagtcccccttaccacacatgaaaacacatacacccacctacccactcatctaccccaccctacccaccacacacacgtaagaggacttcaaaaagttcaaggacaaatggaattaaagataaaaattaaaaagatgaacttgtttttcaacatatcatcaagttcaagacacttattataaattatgataccagccatttagtctgtccctaaagaactgaggctcctaagaatttaaccatgttgatgcagtttttttttttacattattaagtgaggaacaatggataccctttacagatttttttaacattcagaaacaaaaagaagtcagaatgagccaaatcaggacgataagttggatgtctaacgaattcccactgatattctcacaatattgcccttgtttgatgagaggcatgagcagaagcattgttgtggtggagaagcattgtcatgatgaagctttcctgggcatttttcctcaaaggctttggttaactctcaaaacactcataataggcagatgctattgttctttggctatctggta

SEQ ID NO: 74667 - DNA, 601 bp, Human
acactcataataggcagatgctattgttctttggctatctggtatgtcaacaagcaacatgctctgagcattccaaaaaattgttgccatgaccattgcctttgactagtccacttttgctttgattgtaccatttccacctcttggtagccattactttgattctgctttgttttcaggatcatactagtaaagccatgtttcatctccggttacaattcttcaaaggaatgcttcagggtcttcatcccactcgtttccataaaagctatgctcttgtctgcagctgatctgggctcaytggttttggcatccatcaagtggaaagtttgttcaatttttttcagtcagagctgtgtaagctgaacaaactaagatgtctatggtgttggctattgtttgtgctgttaactgttggtcctcctcaaatagggcactaaatttttttttaaaaaagggcattaacaaggttaaatttttctacacaaattgatgtagatggtctgccacaatgggctgcatcttaaacattgtctcattccttcttaaaatgagtcatccatttgtaaactgatttctttgtggcattgtccccataaac

SEQ ID NO: 74668 - DNA, 601 bp, Human
cactcataataggcagatgctattgttctttggctatctggtatgtcaacaagcaacatgctctgagcattccaaaaaattgttgccatgaccattgcctttgactagtccacttttgctttgattgtaccatttccacctcttggtagccattactttgattctgctttgttttcaggatcatactagtaaagccatgtttcatctccggttacaattcttcaaaggaatgcttcagggtcttcatcccactcgtttccataaaagctatgctcttgtctgcagctgatctgggctcacyggttttggcatccatcaagtggaaagtttgttcaatttttttcagtcagagctgtgtaagctgaacaaactaagatgtctatggtgttggctattgtttgtgctgttaactgttggtcctcctcaaatagggcactaaatttttttttaaaaaagggcattaacaaggttaaatttttctacacaaattgatgtagatggtctgccacaatgggctgcatcttaaacattgtctcattccttcttaaaatgagtcatccatttgtaaactgatttctttgtggcattgtccccataaact

SEQ ID NO: 74669 - DNA, 601 bp, Human
caagtggaaagtttgttcaatttttttcagtcagagctgtgtaagctgaacaaactaagatgtctatggtgttggctattgtttgtgctgttaactgttggtcctcctcaaatagggcactaaatttttttttaaaaaagggcattaacaaggttaaatttttctacacaaattgatgtagatggtctgccacaatgggctgcatcttaaacattgtctcattccttcttaaaatgagtcatccatttgtaaactgatttctttgtggcattgtccccataaactttttataaagcatcartgatttcaccgttcttccactgaagcttcaccataaatgtgatgtttgttcttgccttaattttagcagaattcatgttgctttcacagggggtcttttcaaatggatgccttatctttcttagtgcttcaaactagattgtatttatacacattataataagttagtaagagtttattttggtgcaaaaagtttttgaaatccatctatagttttctcataaatgcattttccatgaacttttcaaagacctcttttccatcataaatctaaaaaatgttaagatttaagtagcttcac

SEQ ID NO: 74670 - DNA, 601 bp, Human
aacaaggcttagggctatgaaataaccaagcaaatgagtttgattccaaagctcattctaataaccactaagtaaatgtcagtgcactgttgtatatttttaccgtattttataaaaggtccctaaagacccaaatcctctgtgcatttagttacaagcaccattctgcatttccccccaatacattttcccctggtttatacctatcttctttgttctattatttttgaaattttgagtagtaaaggaatttgggagagggaggatgaagagagagagaaaggaagacagaatcacaccrattaagatgaatttagaaagtaagaccactacggctcacattggtggcatttccctatgtgtctttgcaatgctcttatctgacacaggtctcttaaaggttgggttgaatatctgttcctcagttattgctcttttactccccaaaatcttcccctacaaaggactaaaaatagtgatcagaaatgacctttccctccttagtcccaggtttgtttgggatttcatgtaataaactagagcatgggtgtcctcttccactgattgccatgttcatttcatggccttagtcaggtgcctt

SEQ ID NO: 74671 - DNA, 601 bp, Human
tctaatctccaagtggcttgaagtgtagtgtaaatccagtaaagctccaaaataaataaaataaaataaaacgatattatagtatgcatattcaaatgtattaataaaattgtgtgaaacctttttttaaagaaatgtaaatctaagttaagtgttcttgctgttacagattaatagatccacaactttctaatttcaaatttgaaaagctaaacttgtgcaccaaaatattttcagctgaaatatttttaaacattatattttttctattattacttgagctttttaaacttagtaattyaaactaatcttggaacacttgcaaaatgtgatggaaatgaagaagaaataagctgtaaattcaagatggctgaagtttaatttctgtgccgaccttgggtatgtctagggaggaaaattggcactctcttaacaaaacaaaccagagcttagtttctacatagaacaaggtttgaaatgaatatggaatgaaggtaaatatttagaagattaattctttgagcttcctcaataccttagttttgcaagactttgaaaccatcttctccagggacaaaagaaagtaattacctctcctcca

SEQ ID NO: 74672 - DNA, 601 bp, Human
aagaaataagctgtaaattcaagatggctgaagtttaatttctgtgccgaccttgggtatgtctagggaggaaaattggcactctcttaacaaaacaaaccagagcttagtttctacatagaacaaggtttgaaatgaatatggaatgaaggtaaatatttagaagattaattctttgagcttcctcaataccttagttttgcaagactttgaaaccatcttctccagggacaaaagaaagtaattacctctcctccacatgacgtttaatcatgctctatttttcgaagaacagctgtgmaacactggctgggctacaaattaaacatacctccttcaacttgcttagatttaaaagataatgaatatgttgggtgacagaatctgaattcaaaaagactttaataggccagagctataagctgaaaacaagatgaaagtaatcaaggataaatgtaaggtcctatacttgagtccaagaaaccaagtgagtaaatacagggtggggaagataggacttaatggcaacagactgaattaagcaccagagaatttagaagctatatttgataagaagctaaatatgagttggtggtttcat

SEQ ID NO: 74673 - DNA, 601 bp, Human
taaagatgggtcagtgaacacccatccctgcactaaagggctatgaagggcagtgcttgctgttattgggtaggcaatataaaaaatatgtaaggaataatattaattctgaatcctggcccattagagattggagcaatcattgctagcaaacatattttctgccttcaagtaatttatagctaattgacagagtgtagaatatcacaattaggtacatcagaaaaatgactttagtaacttggcaggaccaaaaccagccaggtgcaatataacacaagataataatgagtaggtcatgctcatcttcaaagcagaagtcacagctcctaggcgacaaatatcacaaaaaaacttattcatgtttttctgttttgttccttgtgatatttccatatggtatccctgaagataagttgtatctaattagagtgtagaaatactttcggttgctagttgttagcctaatctttactatagaagctgttgtttgtctttttctgaacttttacaatgacatttaatacttaagttaccagtggtatatggtgccctagctgagtgagggggggaaaattgtaatggcagattctaagttagg

SEQ ID NO: 74674 - DNA, 601 bp, Human
aaacactattgcagtaaacagaaggaagttatgatcatttattaaagtatagtacaatgtcatcacagctacagttaatacatatttttgagcatctactttagacaaagcaatgttccaagctcctgaaagatgaaaatacatacaatctttagtctcatccttcaaagtaagaaaatttataggcaaacgtttctgaagcaagaatcaaatagcagtgcaagataataagaagcactacaaaaaggtacaaacaaatccccagtctaggatgactgagggaacccttacataaaggaargagtttaaaaattggcatgagcctgatgaatggaaaaaagagggaagaagatttcagaacaatgtgagcaaaatttcagatgcagcaaaatagaatcttgagaagaataaataaagcaaattagctagtagagtcatggactttagctaaggctaaagtgggaccacagtgagggtaatatctatttttttcagactcctaaattaatatcttcaacctgagcttcccatggaactccagattcacatatacaactgtatacttatgttctccacttaaatgtctaatagatgtctcaaa

SEQ ID NO: 74675 - DNA, 601 bp, Human
ttgttagcacttttgccactgaatcactgcataattgattgattgattgatttttattgattgtcttcctttctacaatgtaggcaagggttttttcctgttcccagaatggctacatccacagcagttagaacattcacagtcccaagtagaactcaaaaaatggagttgaatgaatgttgcatttgaaaggaatgaatccatgttaagaatatagataaatatgaagtttattcatgagctctggatttatcctctagataaatttctccaaactgtttattctctgcccatcatattygtttcttttaaaatatatctccttaattgttatattagatttcacattgagaatgttatatcacataattcctgtttacggctgaaactttaattgttggaagtgcttaagtggacctgttatatttttaagatgacatagagggttgtcccttagttgaaaataaaggatgcttgctgcaggggctggaaagcatagagataacaacttctcattctatgagcaactcccgtgggggctgtgaaatcttagggcagagaaccactgaggtggcaaatcctgctctcactgaggaagcct

SEQ ID NO: 74676 - DNA, 601 bp, Human
atcctagaatacggaaaattcttaaaaatgaaaactgaggcatatcaatcaacaacaaaaaacgtatttctggctgggcatggtggctcatgcctgtaattccaacactttgagaggccaaggagggtggatcacctgaggtcaggagtgcaagaccagcctaaccaacaaagtgaaaccccatctctactacaaatacaaaacttagccaggcgtggtggcaggcacctgtagtcccagctactcaggaggctgagacaggagaattgcttgaacccgggaagtggaggttgcagtgagmcgagatcgccccactccactccagcctgggcaacagagcaagactccatctcaaaaaaaattttaaaaatgtgtttcctcctcaaggaagtgtatgttatctcaattatatgacacatattttaacagaaggtttttgagtaaaattcttgcagacagtctttgtatgaactctagatattcacagaaactagtacgtgcctttagaatttttaaagaaaaaattataatgctttcctccctgttgctctgcattcttaaaatcccagcctcctttatgtctgaattaatcagtgaaata

SEQ ID NO: 74677 - DNA, 601 bp, Human
aacaaaaaacgtatttctggctgggcatggtggctcatgcctgtaattccaacactttgagaggccaaggagggtggatcacctgaggtcaggagtgcaagaccagcctaaccaacaaagtgaaaccccatctctactacaaatacaaaacttagccaggcgtggtggcaggcacctgtagtcccagctactcaggaggctgagacaggagaattgcttgaacccgggaagtggaggttgcagtgagacgagatcgccccactccactccagcctgggcaacagagcaagactccatctcaaaaaaaattttaaaaatgtgtttcctcctcaaggaagtgtatgttatctcaattatatgacacatattttaacagaaggtttttgagtaaaattcttgcagacagtctttgtatgaactctagatattcacagaaactagtacgtgcctttagaatttttaaagaaaaaattataatgctttcctccctgttgctctgcattcttaaaatcccagcctcctttatgtctgaattaatcagtgaaatataccaaaaaaaggtagtaaatacagctgttaataccaatttcacatctgtcat

SEQ ID NO: 74678 - DNA, 601 bp, Human
caagactccatctcaaaaaaaattttaaaaatgtgtttcctcctcaaggaagtgtatgttatctcaattatatgacacatattttaacagaaggtttttgagtaaaattcttgcagacagtctttgtatgaactctagatattcacagaaactagtacgtgcctttagaatttttaaagaaaaaattataatgctttcctccctgttgctctgcattcttaaaatcccagcctcctttatgtctgaattaatcagtgaaatataccaaaaaaaggtagtaaatacagctgttaataccaayttcacatctgtcataaccaattcagtgaaaacaaatctgtaacccccaaataaattccaaagtgattaaagtcataattgcaaattaaaactgtaaaataattaaaaggaactatgtgtgaatattaatttaattatagcatatagaaaacttctcaaagcataagtctaaaggcatagaattttaatctcctgtatgtcaaatttcattataaatatctaggaaggctaaaacaattcaggcaaggggacgatggtaatatatgtatgagaggtgtcataatttttgtattgttgatat

SEQ ID NO: 74679 - DNA, 601 bp, Human
cattgttgaaagcaattacaacagcaattgtttaacatcacagatgacacagtaccagttggggtgaacaagagcctgaacaaaaacataaaaggaagacctgccaatgagatatccatagaggtctttgtaaagccctgacatattgtgagggatttagaagccacatgtataagtagggctgtgtgcatgctgaagaaagaccaaagagtgccccagtccctcatctctgactgatgttgagcccctgtaccaggaggaagtgaaggcaaaggcagaatttaaaacttcctgagcattrctgaagttccccaacacacacaaagcctcttggcaaagggttgacttactggttcacagtattctaaaaaatatctgagcaatcactagctgaccacttagctaatcagagacttcagttgttgcccaatagagtaagtacagactttacagaattagccctagaaaatctctaaacaacaaacagcaacaataacaaaaatcaacaacaaaccctggggaaaacatctgactttcagatttgccacattttatgatttgcaatgtccaatttttaagagaaaaattgtggtgcatacac

SEQ ID NO: 74680 - DNA, 601 bp, Human
tgacatattgtgagggatttagaagccacatgtataagtagggctgtgtgcatgctgaagaaagaccaaagagtgccccagtccctcatctctgactgatgttgagcccctgtaccaggaggaagtgaaggcaaaggcagaatttaaaacttcctgagcattactgaagttccccaacacacacaaagcctcttggcaaagggttgacttactggttcacagtattctaaaaaatatctgagcaatcactagctgaccacttagctaatcagagacttcagttgttgcccaatagagtaartacagactttacagaattagccctagaaaatctctaaacaacaaacagcaacaataacaaaaatcaacaacaaaccctggggaaaacatctgactttcagatttgccacattttatgatttgcaatgtccaatttttaagagaaaaattgtggtgcatacacaggggaaaagaaattgtcaatagaaaatctgttacctgaggggacccagattttagacttactagacagactttaattaagctattataaatgtgtttaaagaactaacaggaatccttttcaaagaattaaaggaca

SEQ ID NO: 74681 - DNA, 601 bp, Human
tatgtcatttaaagtaattgtgcacttaaaatgaataaatttcatgtaatgtggattatatcttaaaacaactggttttaatttttttaagccaatgaagaaatgaagtgctagtttttatgtttattgcttccatgagaatattatcatctagaataacatgtaatgtattgagtatcaaactccagcatatcacctaataatcacttggccttaaacaagttacttgaatgttctcagatcctggaattttcacttaaaaatggaggaaataatacatcacaggggttttgagagaatrtattaagtaatggcacactttagatccctaatgaatattaatttccttcattccttccatcaggggccatacactcaagagaaaaataatagtcagggacaattcttaaattacgaatagggaattcaataaatacaacaaaccaaagattatatataaattttatgtttttgccaatggaggggaaagataactaaatgaggcaaggagaagaagaaaaggtggatagggaaactgcacgaaaagagagagagaagtcagatgaacaagcacaatgaaatagactcaaagaataacaac

SEQ ID NO: 74682 - DNA, 601 bp, Human
atcctggaattttcacttaaaaatggaggaaataatacatcacaggggttttgagagaatgtattaagtaatggcacactttagatccctaatgaatattaatttccttcattccttccatcaggggccatacactcaagagaaaaataatagtcagggacaattcttaaattacgaatagggaattcaataaatacaacaaaccaaagattatatataaattttatgtttttgccaatggaggggaaagataactaaatgaggcaaggagaagaagaaaaggtggatagggaaactgcaygaaaagagagagagaagtcagatgaacaagcacaatgaaatagactcaaagaataacaacttatgtaattttaaaagacatattgggccaaattaaatggtatttggatcattctaattaaaattaaaaccaggctacatttgcttgttcagaaaaattcatctaaaggtggaattttgctagtggcccacagggctttatatctcaatttggtttggaatctgatgaggtgattaagtagaaaaccatagaaacataaatgtcaccaatagaactaagcaaatacgtaacctctactgc

SEQ ID NO: 74683 - DNA, 601 bp, Human
gaatgtattaagtaatggcacactttagatccctaatgaatattaatttccttcattccttccatcaggggccatacactcaagagaaaaataatagtcagggacaattcttaaattacgaatagggaattcaataaatacaacaaaccaaagattatatataaattttatgtttttgccaatggaggggaaagataactaaatgaggcaaggagaagaagaaaaggtggatagggaaactgcacgaaaagagagagagaagtcagatgaacaagcacaatgaaatagactcaaagaatarcaacttatgtaattttaaaagacatattgggccaaattaaatggtatttggatcattctaattaaaattaaaaccaggctacatttgcttgttcagaaaaattcatctaaaggtggaattttgctagtggcccacagggctttatatctcaatttggtttggaatctgatgaggtgattaagtagaaaaccatagaaacataaatgtcaccaatagaactaagcaaatacgtaacctctactgcactatcaaattttttcttgcactaaaaatttaaagcttttttattgacttttcatt

SEQ ID NO: 74684 - DNA, 601 bp, Human
atggtatttggatcattctaattaaaattaaaaccaggctacatttgcttgttcagaaaaattcatctaaaggtggaattttgctagtggcccacagggctttatatctcaatttggtttggaatctgatgaggtgattaagtagaaaaccatagaaacataaatgtcaccaatagaactaagcaaatacgtaacctctactgcactatcaaattttttcttgcactaaaaatttaaagcttttttattgacttttcattgtattaattgtatgctaaagaaacttagaccaaaatatackttcatttgaatgagtttcaatcactggtcttagaaagaacattcaataatatttgataggattttaccgctgtgaatggattttttaaagaaggagacatactatatagaatagcagtataaaagaatataatcactgaaagactaatttgtagttttgaagacatagcataataaagttcttacaatataataacctagtacatcataggctgataccatactagacagtacatcgcaggctgaatactgttctttcatgagatttatctttgaaaataaaagtcatctagtttctaca

SEQ ID NO: 74685 - DNA, 601 bp, Human
ttttaaattcttgctattaagcattgatattggggcttaataatggtttctctcaatgtcctactcagagcaatttaagtcacataatcccgaccagaagcgtatctccatggttgttttctatatccctagtacagcagtgataaagccatgaatgctgaatgtgccgtgttttttcagccaacaatgggcaaatgacatttctaaagctatgtatcagttcctacttctcatcattaatcccctgtcccttccaaacctcaactgttgctttaaaaaaaattaagaagacaacaataayctcttaatgacaccctgcagcagctttatggtggaaagggaaaggggtcatgtttactggcacatattttctttgagtgttttctccctttcgcagctcccatggaaaatttgctaacatatgtacttgcttttgttaatggcaatagtagatttaatgtgtttaattccctgctcccttttcttcctctaagtggaaaagacctctcaagcagtgtttatgtttcaccttcaaagttttagctggaaaaatgtttttccgtatttaatgaaagtttggtgactttctaaatttaagcaa

SEQ ID NO: 74686 - DNA, 601 bp, Human
ggccaccaattttatcaaattaggaaccctccactttataacccttttgactttaattatctccttaaagtcctgtctccaaatgccgttacattgggggttagggcttcaacatatgaatttgagaggaacacaatttagtccacagcatttgcatatcacagaaaacaaatccatagaaatgttaatacaataaagaatttgagtggtttaaaacctttttatttttgtgaatgctacaattaaaatatttctgcgtgcaaaaaattgtgagtttttcttgtatagagtaaaattttcygatcttaaaagcaagacctatgacaagtagaaaatattaatgaacgctgaaagcattatatccttgtcattttcagataagaaaactgtagttagtgatgcttttcaaaattgttacatttgtgaaccagcaaatgtatgcacacaggattatctgagcctaaacatagtgtcataaccttaaattgaataagttagattaaattatttttaccagaaaatttatggctgatttccatacaataatccatttagtcaattcaacaatttacagggctgaaaatatttattgtaacttgaa

SEQ ID NO: 74687 - DNA, 601 bp, Human
acccttttgactttaattatctccttaaagtcctgtctccaaatgccgttacattgggggttagggcttcaacatatgaatttgagaggaacacaatttagtccacagcatttgcatatcacagaaaacaaatccatagaaatgttaatacaataaagaatttgagtggtttaaaacctttttatttttgtgaatgctacaattaaaatatttctgcgtgcaaaaaattgtgagtttttcttgtatagagtaaaattttctgatcttaaaagcaagacctatgacaagtagaaaatattamtgaacgctgaaagcattatatccttgtcattttcagataagaaaactgtagttagtgatgcttttcaaaattgttacatttgtgaaccagcaaatgtatgcacacaggattatctgagcctaaacatagtgtcataaccttaaattgaataagttagattaaattatttttaccagaaaatttatggctgatttccatacaataatccatttagtcaattcaacaatttacagggctgaaaatatttattgtaacttgaaattcattttatttcaagcaattaaatcacccagaatcctc

SEQ ID NO: 74688 - DNA, 601 bp, Human
aatttgagaggaacacaatttagtccacagcatttgcatatcacagaaaacaaatccatagaaatgttaatacaataaagaatttgagtggtttaaaacctttttatttttgtgaatgctacaattaaaatatttctgcgtgcaaaaaattgtgagtttttcttgtatagagtaaaattttctgatcttaaaagcaagacctatgacaagtagaaaatattaatgaacgctgaaagcattatatccttgtcattttcagataagaaaactgtagttagtgatgcttttcaaaattgttacwtttgtgaaccagcaaatgtatgcacacaggattatctgagcctaaacatagtgtcataaccttaaattgaataagttagattaaattatttttaccagaaaatttatggctgatttccatacaataatccatttagtcaattcaacaatttacagggctgaaaatatttattgtaacttgaaattcattttatttcaagcaattaaatcacccagaatcctccagatacaaagtgtgttaaatgtaacctttaaaatgaatgaatgagctgaagacaataagggaagtccagggagcaga

SEQ ID NO: 74689 - DNA, 601 bp, Human
caaatgtggtcccatggtgtattagtctgttttcatgctgctgataaagacataccagagactggataatttataaggaaaaagaaatttaataaactcacaattctgtgtggccggggaggcttcacaatcatggaggaaggtgaaaggcacatctcaaatggcggcagagaagagaagacagcttgtgcagggaaagtcccctttataaaaccatcagatctcatgaggcttattcactatcacgagaatagcatgggaaagacctgccacctcccagtgggtccctcccacaacacgmgggaattatgggagctacaattcaagataagatttgggtggagacacagccaaaccatatcacatgggtatcccacaccatggtaccagagaagtctcgtggcagaaaataagaattatatggtctaggcccaaagtgagataccataaggctggactggggcaaagctaattgaaacatttattggaacttattagcacagcagtggctgggtaagagatggtctgagaggataagaaatggccaatataccctgtcttagtctgctcaggctactataacaaaatgccatagactgag

SEQ ID NO: 74690 - DNA, 601 bp, Human
tggctaccgcaatggcatgggcagcctaaagtgaccaagtggtagctgtagtttcaacttaaagtgagacagagtaaaggttccactttgtcttctggtcaaaacaatctctttctagaaattaacaccatgaatcctgcaaaacctgtttgtggggatggggagcacagatttcacaagtgggtcactgggaatgatagtgagatgagccaattctacttttgccccttggttctgggaccaatgtattttagctactccagacagcaccatataacagccatcgattgagtgcatgtaycacatccaagagaacagcaacccaacccataaggtattatacccaagtttttgtcttcactggggcctctagtaaccattcaattattctggttctaaatgatgagatatagacagacaagtgggctgtgtgtttatatgcccattcttcagtcttctgtatcataaaactagtctcctagactgagaaaatttagtgtaagaaaccatacaaatatatgtatcagatgtcttataagccctaggacaataatgatattagcagtgaccccagaggaagaaaaggcaaatccgtatgaga

SEQ ID NO: 74691 - DNA, 601 bp, Human
ccaatgtattttagctactccagacagcaccatataacagccatcgattgagtgcatgtatcacatccaagagaacagcaacccaacccataaggtattatacccaagtttttgtcttcactggggcctctagtaaccattcaattattctggttctaaatgatgagatatagacagacaagtgggctgtgtgtttatatgcccattcttcagtcttctgtatcataaaactagtctcctagactgagaaaatttagtgtaagaaaccatacaaatatatgtatcagatgtcttataagcmctaggacaataatgatattagcagtgaccccagaggaagaaaaggcaaatccgtatgagaaggtgtcaattcatgagaggattaatttctgctcctccagggaaactgagtctaatataatcaacctgccaccaactggctatagccatattcttgaagaatggtgttacaatgagggcttagcatcattttgtgtgctggctagttggcagtagttagataagctttaaagaaggggagcccaggccaggcatggtggctcatccctataatcccagcactttgggaggccaagatggg

SEQ ID NO: 74692 - DNA, 601 bp, Human
tactccagacagcaccatataacagccatcgattgagtgcatgtatcacatccaagagaacagcaacccaacccataaggtattatacccaagtttttgtcttcactggggcctctagtaaccattcaattattctggttctaaatgatgagatatagacagacaagtgggctgtgtgtttatatgcccattcttcagtcttctgtatcataaaactagtctcctagactgagaaaatttagtgtaagaaaccatacaaatatatgtatcagatgtcttataagccctaggacaataatgrtattagcagtgaccccagaggaagaaaaggcaaatccgtatgagaaggtgtcaattcatgagaggattaatttctgctcctccagggaaactgagtctaatataatcaacctgccaccaactggctatagccatattcttgaagaatggtgttacaatgagggcttagcatcattttgtgtgctggctagttggcagtagttagataagctttaaagaaggggagcccaggccaggcatggtggctcatccctataatcccagcactttgggaggccaagatgggtggatgatttgagat

SEQ ID NO: 74693 - DNA, 601 bp, Human
gcatgtatcacatccaagagaacagcaacccaacccataaggtattatacccaagtttttgtcttcactggggcctctagtaaccattcaattattctggttctaaatgatgagatatagacagacaagtgggctgtgtgtttatatgcccattcttcagtcttctgtatcataaaactagtctcctagactgagaaaatttagtgtaagaaaccatacaaatatatgtatcagatgtcttataagccctaggacaataatgatattagcagtgaccccagaggaagaaaaggcaaatccrtatgagaaggtgtcaattcatgagaggattaatttctgctcctccagggaaactgagtctaatataatcaacctgccaccaactggctatagccatattcttgaagaatggtgttacaatgagggcttagcatcattttgtgtgctggctagttggcagtagttagataagctttaaagaaggggagcccaggccaggcatggtggctcatccctataatcccagcactttgggaggccaagatgggtggatgatttgagatgaagagttcgagaccagactgaccaatatggtgaaact

SEQ ID NO: 74694 - DNA, 601 bp, Human
ttagcagtgaccccagaggaagaaaaggcaaatccgtatgagaaggtgtcaattcatgagaggattaatttctgctcctccagggaaactgagtctaatataatcaacctgccaccaactggctatagccatattcttgaagaatggtgttacaatgagggcttagcatcattttgtgtgctggctagttggcagtagttagataagctttaaagaaggggagcccaggccaggcatggtggctcatccctataatcccagcactttgggaggccaagatgggtggatgatttgagatgargagttcgagaccagactgaccaatatggtgaaactccatctctactaaaaatacaaaaattagccgggcatagtggcgcacacctgtaatcccagctacttgggaggctgaggtgggagaattgcttgaacctcggaggcggaggtttccatgtgctaagatggagccactgcactccagcttgggtgacagagtgagaccctgtctcaaaaaaaaaaaaaaaaaaaaaagaagaaaaaagaaggggagccctgctgtagaacctgcatagatatctccctattattgtagtcactctgt

SEQ ID NO: 74695 - DNA, 601 bp, Human
catttaccactgtgaacacagatcaccagtgtgcacaagcatacatctgtgtgtgtagtacactgtttttagaagatcccatattctatagaagttaatttcctttattgctttttattcatagagtgactctgaatgtgttctcatagaaataaatctgaatatatgtgatgtgtgttgtgaagatgtgtgtgaattcatacagaaatacgtaggttcaggtataaatgaacatatttgggcatatatatttgtgtttgcatgtgaaaattaaggtttagtgacaagtgctgaactcaaytgtgttgcacttgtgtctttaaatataataaaacattttcttttaaatgttggaaaataattattaggcatgtatcattaactgataaaaacataaatttcttaagaaatgctatagccttaaaagttactaaattacaaaaaaaattaaattggagttattgaaaaaaaattgctctaactcagccctcttttatagtaaagtattaactataaaacatgtgaatccaaaatattattcttaaattgatgtgatattaatgtatgtttaggaaaaatcaaaagggaattcttcattgaa

SEQ ID NO: 74696 - DNA, 601 bp, Human
tatattgttcaaattttataaattctacataatcagggtgacaaatgacaaatgttgtcatttgcctttatgtttgttatttcactgacaccaagcagtactataatgctttagttattctaactatttaatatagtagagaataataagagaatagtggactcaaaccaagtatcatataaatgataagctaagtaaaggatagttttaaaataagaagattaacgtcaacataactacataaaactaaaaagaacctgtactgtcacagtcagtacaaaaatacacccaccaaatgcastgtagagtcagcaaagatcatctgccatgttaaggcaatgctgacaatttaaatcttgagctttttagttttatttgattggtaaattgtgttatattccatatgtaccataaacatttgatttcttattcatctgagagtttatatctgatttgacttcactaagaataaaattcaaaccccttactatgatatataagtccctgaatggcgtggtctcttcctatctggcttgttgccaccttgccacactaccctttgacatcacactccagcttcatcggcatttctggcagttct

SEQ ID NO: 74697 - DNA, 601 bp, Human
ctacaggcgcccaccaccacgcttggctaatttttgtatttttagtagagacagggtttcaccatgttggccaggctggtcttgaactcctgacctcaagtgatctgcccgccttgccctcccaaagtgctgggattacaggcgtgagccaccgtgccctgccagaagtcaaagtttctgtgtcaatgttttcacaaacattatctctgaggtgtggaaatatgtcttatttcccattttaaaagtgatatataacaccgttagcttctcttagccttggtatctttaaccgtaaaatgargtatagatataaacatttgtccaatctctccaactagattataaacctcaagagataatgaataataaataatgccactttgtatctctagtacttaacagagtgcctactgactagtagatgctcaataaaagttgagaataattatatttccatttcttcactttcttgaataaggtggatttctgtattatcctataattattatgtttaaaataatatattattttatagtaataactaagtcagatgatctaagttaaaactttcatcggaatctaagaagagaagaatttgatg

SEQ ID NO: 74698 - DNA, 601 bp, Human
ttcaactttgaatcacatatgaacaacgttcataacatttaaggggtcttgttaaaatgcagatttcgatttatgtattacaagtttctgggtgatactaacactgctgttctgcagaccacatcttgagtagcaaagcattccagaagcattcaagatcccagaacaggacacctcatctagcaggtcctccacaaatgtttattagtcaatcagaatctagctaggtgcagtggcactaaacgtctttttttcttttctccttttttctcccttgccctagcttaaagctgtgcatagaaagttattttattttatcctggtaaattgagcacttctgtttgttttatagaggtgtgccctttctgttgagtatctttctaagagccattatggtgtgactcatctttctgacagtatttattttaaattttaatttattcagctgcttcaatcacattcataagttatcttttagaataccttctctccttcacacttaccttggccagaaacctgatcatctgaatacttgtaagagaaccaagaaagtatagactaattgtttattttaaaaagcacaatgaaggaagaaatggat

SEQ ID NO: 74699 - DNA, 601 bp, Human
aataccttctctccttcacacttaccttggccagaaacctgatcatctgaatacttgtaagagaaccaagaaagtatagactaattgtttattttaaaaagcacaatgaaggaagaaatggatgtgatttttttcttggaaacgggaatttaatcacctaatagagtctcttagaaaagtaccattcccaaatctgttcttgattttgaatactaaattgctctaaatccacctaatggttgtttaaacctatgacaccatggagaatgtgagaacaataccgtctatgaacctcttcaaraataagctcaaaaatgaactccaccaattgatgtggaaagtatttcatgcatgggacgttctaaccagggaaatgggaaagagctggcatagcaaaggtggaggggctaaggaagaacactgagagatgggacagagatggcttgccaattcacgcgtcacatgagaacaccaaaagattttggaaaatccataaataacctaaattctcttttttcctggcccgtccagctacctcccccccaaaaaaagaagccctaaacagcctctttgctatgtctcagctaatcagcttatcagc

SEQ ID NO: 74700 - DNA, 601 bp, Human
cttatattttaatctctaatttatttgtctgtctgcaccacttgaggccaggaactatttcttattcattcttgcctcttctgcacctaggagagtgtctagctcatattcattaaataaattttgttgagcagtactgaaaggcacagatttaagactttggaacctttcccaatactatgcccttgtcgtgttgaatgaacgaatgaatcatgagtttcaagcctaatgtttcccacatgtcatgattaatggtcaaactaaatcttggttcctctttctctctctctctctctttctttttttttttttgagacagagtctcgctctgtcgcccaggctggagtgcagtggcacaatctcggctcactgcaaggtctgactcctgggttcacaccattctcctgcctcagcctcccgagtagctgggactacaggcgcccaccaccatgcctggctaattttttatatttttagtagagacggggtttcaccatgttagccaggatggtctcgatctcctgacctcatgatctgcctgcctcggcctcccaaagtgctgggattacaggcatgagccaccgcgcccagccggttcctc

SEQ ID NO: 74701 - DNA, 601 bp, Human
tcttgggaaaaaaatttcattacgcataagaagtatagctaaatacttaactgaagttagaacaaaatcatgttttctaacagttcaggtgaatttcaagccatccaggccacaagataatgatgtcctccaagtctgacctacagggaacttttcttctaattaataaacagactacagcaagaaaattaatttatgcaccgcatttacttgttgatgcccttcgagagcatagcatttcagtaggcactgtgtacacgagatacagcagaagaatacgtcaaagctagttctttggtgttttttttttcccagagaaaatagaggtaatccaacattagacagaatttgtcgagattactagatgtacattcaaaacatccattcaacaaaccaattgaattagttgcatataagagtgtcccctctgggccgggtgcagtggctcacgcctgtaatcccagcactttgggaggctgaggtgggtggatcacgaggtcaggagatcgagacaatcgtggctgacacggtgaaaccccgtctctactaaaaatacaaaaaattagctgggcgcggtggcgggcgcccatagtcccagcta

SEQ ID NO: 74702 - DNA, 601 bp, Human
gggcgtttgtaagagttgaatgagttagcacagaaaaagcacttagtgtctaccacatactaagtatgcaataaatgttaactgtgctgctgctgatgatgtactttttaaacactttaataaaaaatttcaaatatatgcaaaattagagacagtggtatgcatatactgaacacccagctttagcaattatcaaattttgccattattgtttatttatctatttctctttggtctatttttcattaatgtagtattttaaagcaaattccagacattatcatcagtttccctttaaatkcttctctaaacaatgatgactttctacatagaaccacagttccttttacatccctatcttgcaaatacgtctaaataggatatttcatttaacttacttattttcctatctttccttctgggctgtaaatccttgaaaccagtggttgtgatatttaattcatttaagctgtaattcactggctagaacacggtagtagtgcaataaatgtactttttaaagagagagagggaagtaaaaaagagagaagggagagagttaaggagagagggaataggaagggctcacataacaaaataa

SEQ ID NO: 74703 - DNA, 601 bp, Human
caatgtcctttgcatatttaggaaatgtttgctataataaagaagctgggcaataagatattaaatattttgaaaagggtaaatatttagtgatttatcaaaggaagcacaaagcactgagtactttagcagaagaaatggattaaagatgtgagacccatgtcacataaaccaaagaccatttctcctccagataataatgagattgtcacatctatcaatttctatgtatgtattccattgtacatcctctctccctaaattttaaaaagttatgatcatgttgatatgcaaagggaayttatgtgtttgtttaactttttgaggagaaagtgagaaagagaaaatattttacattccaggagagaagcactttagagaaattgaagcaaaaactgggaagaagtcagggccaactggtggaaagtcccccaggatgcaagagaggagcactgagccctgacctacttctcactaattgctgcaaacctcccataaattccttgcccttcctggtcttcagattcctcttctataaaacaagatggctggggaaagactctctgaggtttcttggagtttttacaatttaccgatcttg

SEQ ID NO: 74704 - DNA, 601 bp, Human
ccactggagtaaaaagatggaaatttttaaacagcatttgattggtattccattttcctttaatatttgaaaatgttatgttgatcatattttaggtaggaatggatctattaactaccatggaatcaatttgtagttatccatgaaaataaaacaggaagaatttttaaataaatattcactctttatttacaaagatttattaagtctctgctatgtgccagtcctagagaaataaactagtgatggcctggatcgtttaggagcttacaatgttttgggagacatgcacatagaatgwttaaacgaatcaggagatggtgagttccacagctgatgtatacacaaacaaataatgggtgcatgaaagagggtcaccttatctcttctgataaggttatgaaggtatcccagaagaaaaacatctgagctgagtcttaaaaatgcaagagaatattcccagatgaagaaaggggagcaggccatctcaagcagaggagacatcagttgattttcagcaagtatgtagagtgtttaaggactgattgacaggtcaacgtggcccaagtgaaaatggtgaaagttagttggacccaactgt

SEQ ID NO: 74705 - DNA, 601 bp, Human
gtagttatccatgaaaataaaacaggaagaatttttaaataaatattcactctttatttacaaagatttattaagtctctgctatgtgccagtcctagagaaataaactagtgatggcctggatcgtttaggagcttacaatgttttgggagacatgcacatagaatgattaaacgaatcaggagatggtgagttccacagctgatgtatacacaaacaaataatgggtgcatgaaagagggtcaccttatctcttctgataaggttatgaaggtatcccagaagaaaaacatctgagctkagtcttaaaaatgcaagagaatattcccagatgaagaaaggggagcaggccatctcaagcagaggagacatcagttgattttcagcaagtatgtagagtgtttaaggactgattgacaggtcaacgtggcccaagtgaaaatggtgaaagttagttggacccaactgtgcaggtcgtgaagtcagattgtgaggatggctcccatctcatctgggagaaagagatggcttcctcaggcatcaagtgctttcttcttaaagctgcagttatttcaccgctatttaaatttgtgttttcccg

SEQ ID NO: 74706 - DNA, 601 bp, Human
gagtcttaaaaatgcaagagaatattcccagatgaagaaaggggagcaggccatctcaagcagaggagacatcagttgattttcagcaagtatgtagagtgtttaaggactgattgacaggtcaacgtggcccaagtgaaaatggtgaaagttagttggacccaactgtgcaggtcgtgaagtcagattgtgaggatggctcccatctcatctgggagaaagagatggcttcctcaggcatcaagtgctttcttcttaaagctgcagttatttcaccgctatttaaatttgtgttttcccratggtcagagactacagtcagactgcctcttggatttcagtgatctttgatttacctgtttacacctttcacatatttgttgttgtttgcattttgacttgtagaagctctttacaaacatgagtagtcatcctttgtcatttttgttgtgctcatactcccacggtactttgctagttttgttattttgtctatgattttaccccatacacaaggtttattttataagtttagctaacaaatacttattatgtaccaagttttattctaatgtttttttacaaatgttaacacatttaa

SEQ ID NO: 74707 - DNA, 601 bp, Human
gcccaagtgaaaatggtgaaagttagttggacccaactgtgcaggtcgtgaagtcagattgtgaggatggctcccatctcatctgggagaaagagatggcttcctcaggcatcaagtgctttcttcttaaagctgcagttatttcaccgctatttaaatttgtgttttcccgatggtcagagactacagtcagactgcctcttggatttcagtgatctttgatttacctgtttacacctttcacatatttgttgttgtttgcattttgacttgtagaagctctttacaaacatgagtagtsatcctttgtcatttttgttgtgctcatactcccacggtactttgctagttttgttattttgtctatgattttaccccatacacaaggtttattttataagtttagctaacaaatacttattatgtaccaagttttattctaatgtttttttacaaatgttaacacatttaatcttcataacaatcctatggggaaggtattaacatgcctatgttacaggtaagaaaactgagctacatcttgaaggtcacataacttcccaaggccttactgtggtaggtgtgaggccagggaatgcta

SEQ ID NO: 74708 - DNA, 601 bp, Human
gccagggaatgctacaaagccctgctttgagcctccactaagctgctttctttcaaatttgtcttctgttcctttatgatacctgtattttatatcttattaaacaaggccttgcccagctcagattataaaataacctcctagacattcttataattttatacttctgtgacttttgggtttagaactttaatcaatctgcaatgtattcttgtgcatgatttgagttagaaaccttctcaaatgttacattatttattgcagtaaccactgtttctctcatttatttgaaatgataaatttattgcaaaatagattttcatatatacatgcattttttgtaacttttttattatatttcactgttcaatttgttcattccttcactaataccatacattgctctaattactgttactttttagcattgaaattgatgtttaagtgttccctttttaaaatatacttgtcactgttctcatttatttataaattcctccaaataaatatatacaattagtgtcttacattttataaagttggtttgttttggtggagtagattaaatattgacttgggatgcaatatacttataaaatta

SEQ ID NO: 74709 - DNA, 601 bp, Human
aaagccctgctttgagcctccactaagctgctttctttcaaatttgtcttctgttcctttatgatacctgtattttatatcttattaaacaaggccttgcccagctcagattataaaataacctcctagacattcttataattttatacttctgtgacttttgggtttagaactttaatcaatctgcaatgtattcttgtgcatgatttgagttagaaaccttctcaaatgttacattatttattgcagtaaccactgtttctctcatttatttgaaatgataaatttattgcaaaataggttttcatatatacatgcattttttgtaacttttttattatatttcactgttcaatttgttcattccttcactaataccatacattgctctaattactgttactttttagcattgaaattgatgtttaagtgttccctttttaaaatatacttgtcactgttctcatttatttataaattcctccaaataaatatatacaattagtgtcttacattttataaagttggtttgttttggtggagtagattaaatattgacttgggatgcaatatacttataaaattaatttgaagaaaactg

SEQ ID NO: 74710 - DNA, 601 bp, Human
acattttataaagttggtttgttttggtggagtagattaaatattgacttgggatgcaatatacttataaaattaatttgaagaaaactgatattgtcaaaataattaactttttcatactagaatatagggtgtcttttcatttattaaggtctttcttgtatttcactacatttttagtttttttcttaagtcttacacaatgtttggtaagcttatttctaagtattttatcattgttttccacttttaatgagatttcaaattccattaaaatttttaattggatcctgctgatatmcagaaaaactattaatgtttgcatgtctttcatgtatataattgctatattaaattatcttattaattctagtagtttttcaattagttatcttggaatttttcttagtcatatccgtgaaaattgttagctttatctcttcttttgcaatgtttacactttttaattatattgtctcattgtggatatgtacttataatgaaaactattcgtgataatattcttaattttctagttcctggttttaattgaaattctttgtatatttcaccagttagattgttcttacacagtagtttg

SEQ ID NO: 74711 - DNA, 601 bp, Human
ttaatttgaagaaaactgatattgtcaaaataattaactttttcatactagaatatagggtgtcttttcatttattaaggtctttcttgtatttcactacatttttagtttttttcttaagtcttacacaatgtttggtaagcttatttctaagtattttatcattgttttccacttttaatgagatttcaaattccattaaaatttttaattggatcctgctgatatacagaaaaactattaatgtttgcatgtctttcatgtatataattgctatattaaattatcttattaattctaktagtttttcaattagttatcttggaatttttcttagtcatatccgtgaaaattgttagctttatctcttcttttgcaatgtttacactttttaattatattgtctcattgtggatatgtacttataatgaaaactattcgtgataatattcttaattttctagttcctggttttaattgaaattctttgtatatttcaccagttagattgttcttacacagtagtttgatttttattcctagactagttattccattctcacatttaaatgacactttcgctgctttaggttctcaatct

SEQ ID NO: 74712 - DNA, 601 bp, Human
tgtcttaggctcttagatgctcacatgctagaataagacaaaaagaattaggccattcctttttctctttattccctgttctttctatctggaaaaacagatattggaaattcttcatctattccctatgtctcataacttttctattaaatgtatatatttttgtcttttatgcctcatgttttgggagtttatcttcacccacattaattttaatatgtatgcctgatgaatttattaaaaatttctacttttaatgagattgcaaattccaataaaatttctaattgtatcttgctgwtatatagaaaaactattaatgtttgcatgtctgtcttgtatataattgctatattaaattattttattaattctagtggttttttaattagttttcttgggaatttttcttagtcatatctatgaaaactgataattttatctcttcttttgcaaagtttatacattttaattatattgtctcattatggatatgtacttataaaacaatttgtgataatattcttaattttaaattaagaatctttttaatatcttaaccttacatgtataaatttattaggtctgataattttattat

SEQ ID NO: 74713 - DNA, 601 bp, Human
tgcatgtctgtcttgtatataattgctatattaaattattttattaattctagtggttttttaattagttttcttgggaatttttcttagtcatatctatgaaaactgataattttatctcttcttttgcaaagtttatacattttaattatattgtctcattatggatatgtacttataaaacaatttgtgataatattcttaattttaaattaagaatctttttaatatcttaaccttacatgtataaatttattaggtctgataattttattattagaccttcactaaaatgttaaaktttagctatcatggttttaatttcaaaattttttttcttgatcttaggttatttctttttcatagcaatttgttcttgctttatgacttttgagtttttttctgttttagcattatcatggtttcctctaagactgatcaactttctccttttacataagcatatttgttgattttcctcaaatatctggtgaaacttgatttccattcttatgttattaatatttataaatgaagtatcggtttatcaatgtaggtaactacagtggttttaacaattgttatgaaaggctggttttgc

SEQ ID NO: 74714 - DNA, 601 bp, Human
ttgattttcctcaaatatctggtgaaacttgatttccattcttatgttattaatatttataaatgaagtatcggtttatcaatgtaggtaactacagtggttttaacaattgttatgaaaggctggttttgcagcaggcttcttccctgactaggagagagaaatgtgtgggtctggttttccttttcttgttatgcaagcaggaagaaccagaaaagcaggggcactctcatgattgcaaaagcaagtgctcatctgggtggtacttttaagtgctttggcaaaggatgaggtaaaattmaaagacaacagcatcactgttttcagaacttcattcagagccattacgacaaataatttggttgcaagggtgtttgatacctgaaataacataaggattcttagcactctcgttgtctgttcacaattgtctgcaaaaagcaaggcaaagcatagaggtcatgcatggtgttatttttcatttgtgggaggagaatacatgttcttattttgatattaaaattaggaaagactagtggtcaaaattgaaagtatagagctttactgtgacataattcagtttcttataaggggatcatat

SEQ ID NO: 74715 - DNA, 601 bp, Human
actctcatgattgcaaaagcaagtgctcatctgggtggtacttttaagtgctttggcaaaggatgaggtaaaattaaaagacaacagcatcactgttttcagaacttcattcagagccattacgacaaataatttggttgcaagggtgtttgatacctgaaataacataaggattcttagcactctcgttgtctgttcacaattgtctgcaaaaagcaaggcaaagcatagaggtcatgcatggtgttatttttcatttgtgggaggagaatacatgttcttattttgatattaaaattargaaagactagtggtcaaaattgaaagtatagagctttactgtgacataattcagtttcttataaggggatcatatataagagtaccccaaagtactttgtattgtgcttgcaacttttctgtaagttaaaattatttaataaaaaaggatttttttataatcaagaaatctaaagatggaaaattatgattagatttaggtttaacttaaagtgacagaaaacacaaaatattactgtttcaaataagatagaatttatatcttgcctacataatgtaagcggtcatccaagcctggaat

SEQ ID NO: 74716 - DNA, 601 bp, Human
acaccgtttgaacagggcagtgtttgtagaatctcttgaagctcatccattccaaagacatccgtgagtgcttaccatgcacgaagcactgtgctggggcttgagatagaaatgttgagaacaacacacttggtctctgtgctaatggagttttaggctaatgggaaaagtggggattcaaaacataaggaaacatatttgaatattaataaaagctaagagactgttaagagggaaattatcacatgttctgagaatgtgtcacggaaggactttgccaagccagggcaggatgatgatratctaagaaggctttcctgagggcatgatacatgtgttcaaatccacaggatgaatgggaatatgcaaaggagaggctagagtaggaatatcaaagaaggcagcatatgcacaaatgtcacagggaaaagaataataatccagttaagaaactgaaagttctttatggctggagtacagcaaacaaggaggaaaacaggagaaaatgagactagaaaggttctcaaggttaaaataatgtagaatcaaatgcaggccacatacagttatttgtgtcattaaagggttagaggcagagagc

SEQ ID NO: 74717 - DNA, 601 bp, Human
gtaagagaggagttgaaggtgattcccacatttccagattgtacaaatggatgggtggtggaccatttattttctgaaacagagaaatatcaactaccaattagaggaaagatgttgatttttggtttgatttaagagccttgagtttgcggtgcctttctgacgttcaagtaggcatttcagataggaagttaaacatgcaaatctggaacaccgagaaaatagcaagcctagagatacagatttgagaggtttttgcacataggtagttggtaactaaatcacagtttcagagaggagyccctacagagatagcaggcagagagatgagaaaaaacaagaatctgggacttgaatctaaaaggcaggcagaagaaggttggcagaaggcagcaatggagactgaggagggtgggtgagaaggtagggatctgttgggagtttgtactatgatagaagccgagggattctaaagcactaaacaggcaaattcctccttgacttgacttgacttccttccttaagtcaaggaagaggagggctgaaagaaaaaattgagagtacagaagggttctgaaatgttactgcaaagataagatgt

SEQ ID NO: 74718 - DNA, 601 bp, Human
cagagaaatatcaactaccaattagaggaaagatgttgatttttggtttgatttaagagccttgagtttgcggtgcctttctgacgttcaagtaggcatttcagataggaagttaaacatgcaaatctggaacaccgagaaaatagcaagcctagagatacagatttgagaggtttttgcacataggtagttggtaactaaatcacagtttcagagaggagcccctacagagatagcaggcagagagatgagaaaaaacaagaatctgggacttgaatctaaaaggcaggcagaagaaggktggcagaaggcagcaatggagactgaggagggtgggtgagaaggtagggatctgttgggagtttgtactatgatagaagccgagggattctaaagcactaaacaggcaaattcctccttgacttgacttgacttccttccttaagtcaaggaagaggagggctgaaagaaaaaattgagagtacagaagggttctgaaatgttactgcaaagataagatgtgacaagtatctcttaaagatggtggtagtcatgatggtggtggctgtgtctgtgtatctttgttatgcatcaatatttg

SEQ ID NO: 74719 - DNA, 601 bp, Human
atcatggatgcttagtaacaatatattatacacttgaaaaatttctaagagtagatcctaagtgttcccaccacacacaaaaaaagtgtgtgaggtaatgcaatgttaattagcttgatttaaccattccacaatatacacatatatcaaaaaattatgttgtacggtataaatatatacaattttgtcaattaaaagtaaatgaatgaatgaatgaattaaaatatttggagcactctgaagctgaattcagaaataatgctaaagaagacttgactttgttaaagacagaatttttatrgaatatatggaaatagtaattattgcttaaaaactgtattcaatattttgatattgacctcaataaaaaaatgtgtaatcaatttttgaacttctagtcactcaggggacagaatggttaccatttgttgtcctaaagcaagggtagcataggggcttgtcccaggaacaatcagttggtcttcaaccaaaaaagtggatatttccatcagggacatttgcctggacaccaccatgttagattctaaaaatcaaacatgtgtcccaccctaactttgcctttagtccctgaaagaatgga

SEQ ID NO: 74720 - DNA, 601 bp, Human
aatatatggaaatagtaattattgcttaaaaactgtattcaatattttgatattgacctcaataaaaaaatgtgtaatcaatttttgaacttctagtcactcaggggacagaatggttaccatttgttgtcctaaagcaagggtagcataggggcttgtcccaggaacaatcagttggtcttcaaccaaaaaagtggatatttccatcagggacatttgcctggacaccaccatgttagattctaaaaatcaaacatgtgtcccaccctaactttgcctttagtccctgaaagaatggacstaggtttgagagaggagaacagtgagggtcatccctcttcatctcaggagcaattaactagttattttgctcactttgggaagaatttgccttcaaaaattataccttttggaaaactataccatataattatttatcttccttcaaaatatgaattatttgatctttttctcacttcaacttttcaaaaatttcacataaggagccctattcaattatctccttctgtaattaaaacattttagtaggtgtgcaaccaaattgccaaactaagacagatcttgttattttaaaagaaca

SEQ ID NO: 74721 - DNA, 601 bp, Human
tgctcactttgggaagaatttgccttcaaaaattataccttttggaaaactataccatataattatttatcttccttcaaaatatgaattatttgatctttttctcacttcaacttttcaaaaatttcacataaggagccctattcaattatctccttctgtaattaaaacattttagtaggtgtgcaaccaaattgccaaactaagacagatcttgttattttaaaagaacattataatttcaattgttctaataattgttattattcgatagagcaaattatgaatgcaattttcaaarcaaatgaaaacataagaaattcatgatttttctatactgctacaaatttggataacttcaaagtgattatcttacatttggcttttactttggaaaatattaatattagaaaaactgcaaaattttggaatctagattaaagaacgatagattatgatgataactgtttatgattcttattttattatttcttttttgaacctgcttttccaatctagataagcatgtctagtctcataccatattcatactgcatattataacatggtgttaataatcttaagtaatattccatggcca

SEQ ID NO: 74722 - DNA, 601 bp, Human
aattatttatcttccttcaaaatatgaattatttgatctttttctcacttcaacttttcaaaaatttcacataaggagccctattcaattatctccttctgtaattaaaacattttagtaggtgtgcaaccaaattgccaaactaagacagatcttgttattttaaaagaacattataatttcaattgttctaataattgttattattcgatagagcaaattatgaatgcaattttcaaagcaaatgaaaacataagaaattcatgatttttctatactgctacaaatttggataacttcraagtgattatcttacatttggcttttactttggaaaatattaatattagaaaaactgcaaaattttggaatctagattaaagaacgatagattatgatgataactgtttatgattcttattttattatttcttttttgaacctgcttttccaatctagataagcatgtctagtctcataccatattcatactgcatattataacatggtgttaataatcttaagtaatattccatggccaatcaaccttttttggacactaatactcattatgagactgagcttaacagctgttttttgt

SEQ ID NO: 74723 - DNA, 601 bp, Human
aagttccttataggtgctggatattagatctttgtcagatacacagtttgcaaaattttcctcccattctgtaggttgtcagtttactctgttgatagttttcatttgtttgtttttgttgttgttgttgttgttattgtttttgctgtgcagacactctttagtttaattagatcccaattgttaatttttgcttttgtcacaattatttttgatgtcttcaccatgaaatctttgcctattccaatatccaggatggtactgcctaggttgtctttcagggtttttacagtttggggcttttttttttttttttttctgaggtggagtctcactctgtcgcccaggctggagtgcagtggtgccgatctcagctcactgcaacctctgcctcctgggttcaaacaattctcctgcctcagcctcctgagtagctggaactacaagtgtgtgccaccatgctcggctaactttttgtatttgtatttttttagtagagacagggtttcaccgtgttagccaggatggtcttgatctcctgacctcatgatccgcccgccttggcctcccaaagtgctgggattacaggcgacagccacca

SEQ ID NO: 74724 - DNA, 601 bp, Human
tgatgacccgtaagtcatgattttatactatttggcatagcttcacaaaacacaattttcatatgtattgaaaactaaagcaaaggaaaagtataaaaatttttgtgtaactgaactgacatgatatcagtcataaaatctctgcttgacaatctcatctgtcattctttcaaaaataacttatttattaatgtcaacagtgatgctgctttgcactgtattgaatataaatctgttgttcttttggcatttgggctaaggttggctaaattatcttagtaaataaattagcaaagcacctttttttttttctttttggcaatctctctctataattcctctttacctgtatcagtttttctcttttcctcatatttctcaaatatatatcaccattggttcttctttctcttgattgagaatttctgagaaatgttggtccatagtaaccagtattccaaggttagatgaaataaccaggacttagtgagaaatgattgttcagtaccatggatagcagaacacttatttccccaaatactaacacatactcctccaaattttagctgcaccattgaaaacatttctttcaacatgtctt

SEQ ID NO: 74725 - DNA, 601 bp, Human
ggcaggaggagagctgctacagttgcggtttcttctgagcagcaagacttgcagccagggccagcttggcaatctggaactgatctgtgtgtgccattgctgagtgccccatcctcctcccctgagatcgtggtgcaacagagccctccctgctccattcctaggcagaaatctgggtatttggaacacctgcttgcctggaccggtggtctgagccacaccacccttccttgatgtatatggtggtacagagagggtctctgtgctccatgcccaagcagatttctaggcattcagagcrctcattcacctggttcagcagcctgagccacctaccctccttgtgcaaagactggtacagagggaccctctctgctacatgcccaggaagatctccaggcattcagagcgcctgcttgcttagttcagcagccagagtcaccccacccctcatgtgcagagatctttgtgcagcggggctctctctgctccacacccaagaagatctctagacttttggggcattgctcaccaggaccaccaagactgtccaaagatcttggtgcaaggaatccctctctgttcacactcaggcagatca

SEQ ID NO: 74726 - DNA, 601 bp, Human
agacacgcctcaaaagaagacacacaagaaacatgaaaagatgctcatcatcactaatcatcagagaaacgcaaaacaaaaccacaatgagatagcatctcacaccagtcagaacggctgtgactaaaacatcagtaaacaacagatgttggcgaggctgtggagaaaagggaatgttcctacactgttggtgggaatgtaaatcagctctgccaatacagaaagtagttttgagatttctcaaagaagttaaaacagaagtgtcatttgaccatgcagtctcattaatgagtatatatcaaaaaaaaaaaaattctaccaaaaagacacatgtactcacatgttcatcacagcactatttgtgataacaacatcaaggaatcaacctaggggcctatcagcagtggaatggataaagaaaatatggcacatatagactatggaatactatgcagccatagaagagaacaaaattatgtccttttctgcaacatggatgcagctgaaggccattatcctaagcaaattaacacaggaacagaaaaccaagtcctgaccattctcacttataagtggcagataaacatccagtactcacgga

SEQ ID NO: 74727 - DNA, 601 bp, Human
atggataaagaaaatatggcacatatagactatggaatactatgcagccatagaagagaacaaaattatgtccttttctgcaacatggatgcagctgaaggccattatcctaagcaaattaacacaggaacagaaaaccaagtcctgaccattctcacttataagtggcagataaacatccagtactcacggacataaagatggcaacaacagacaatggggactactcaaggggagagggagagggtggggcaaggtttgaaaaactaactgttggctactgtgattaatacctaggtawtgggatcatttgtatcccaaacctcagcatcacacaatatatccagataacaaacctgtgtatgtacccccaaatcaaaactaaaaattgaaaaagaaaaaaaaagttttaaaggcaaatcctccattgatatacttactttgttacatataacgccatagacaatttattcccctcccccgcccaaatttgtttgccgaaacgtaatccccaatgtgacaatatttgaaggtaaagccttcaggaggttatttgttcccttataaaggaggccccagagagatcctcctcccctcccac

SEQ ID NO: 74728 - DNA, 601 bp, Human
agagcacacattactcatatttgggatactcatgacacatcatctagccccctcctccctgcatgttagcacacggtgagcacacccactttccagtgacttcttggtgttttgcttacagaagcctacattcagcatatgaatcatctagccctccgcaagaggctgcctggaaagaataaggttttagagaaccagccctatggattgatcattggttctgaccacacaactattatgacaagtgaaatagaataacaacaaacggctatgatttttgtctttgtggatggatttcatrggggggagggcagcagtagaaagtataaatgacatgaaagaaagaatattaagctccaaaattgtgcttaagtaaatctggaataaaaaactgcagcaggttcttattgctcaattccagcccatttgcagagaataaaaaggcaaagcaatgtgggtgaaaagcaaggaatttgccaccttagctttgaatactatttcatttatgagtttaactgtttccccaccagccttcactaatttcacttgatctccatcaagaaagatggagaaggttttgatgagcaaggcagcactgaca

SEQ ID NO: 74729 - DNA, 601 bp, Human
cccaccagccttcactaatttcacttgatctccatcaagaaagatggagaaggttttgatgagcaaggcagcactgacaaaattagatgtaggattaaaaaagaaaaccaatccacaatgtaatgaattactaaatttaaagacaactagtgaattcctgggcaagcatgatggatgcattcaaacatagattcttgaatttgccacaatcctatgccccatagctatgacttttcaccaaaaagcaaatttttaagagccaaatttgccatcgatgtgagtgggttgcatcttatagtcttgaacaaaaaggacaattataggtacattgagttcctggttccttggaaactaatggtttcattctctgcagattgatcacgtcaaattcatcaggttcatttccaaaaataaaaatcccctgtatgagggaaattgtggatttcatgtcagtcttctcaggaaatatttattttatttcaaaatataattccagttgatctgcctagcagaaacaagtgaaattgcttctgttatcattgagatagagtgatttccattttcaaatattccaaatggcatttacttgtggtaactgtaa

SEQ ID NO: 74730 - DNA, 601 bp, Human
acatagattcttgaatttgccacaatcctatgccccatagctatgacttttcaccaaaaagcaaatttttaagagccaaatttgccatcgatgtgagtgggttgcatcttatagtcttgaacaaaaaggacaattataggtacattgagttcctggttccttggaaactaatggtttcattctctgcagattgatcacgtcaaattcatcaggttcatttccaaaaataaaaatcccctgtatgagggaaattgtggatttcatgtcagtcttctcaggaaatatttattttatttcaaamtataattccagttgatctgcctagcagaaacaagtgaaattgcttctgttatcattgagatagagtgatttccattttcaaatattccaaatggcatttacttgtggtaactgtaataatagagtaatacatttacagcaatgtgatagcaatatagaactactctgaaacacatgctgtatatctcatttctttagcctataagatatcaaaatgccaaacattacatacatatgtaattctcctacttaccacattccaggtaacttgcttacactgtatgttaaaaatgattttttc

SEQ ID NO: 74731 - DNA, 601 bp, Human
ttacagcttggcatttgccttatttgaacagtttgaacacttagcagtctatgagtggctgaagtatggccactgggattggccaagactcagttattgttacaggtgcatactcctaagcttggttttcagttttgtctgacttttaagctaggttacagttcatccacatggactcatatatagaagtatggagtccttctcagaccatatttagtttgctttaacagtataatggtgcataccatggacagggaagaggaggaaatgaagagacataggtcaaagggagcaaacttgyggttatataggatgaacagaccaagagatctactgtacagtaggaggactatcattaataacattgtattgcaatactgaaaatttactgagagtagatgctcttactatagaaataaaaatatggaaagtgatggatatgttaaattgcttacctatagtaatcatttcattatggctatgtatagcaaaacctcatgttatacaccttacatttatacaatgaaaatagtattgtaccagtgttaatttcttagtttggcaaatgcaccatggtaatctaagatgttacagtagggca

SEQ ID NO: 74732 - DNA, 601 bp, Human
ttgctttaacagtataatggtgcataccatggacagggaagaggaggaaatgaagagacataggtcaaagggagcaaacttgcggttatataggatgaacagaccaagagatctactgtacagtaggaggactatcattaataacattgtattgcaatactgaaaatttactgagagtagatgctcttactatagaaataaaaatatggaaagtgatggatatgttaaattgcttacctatagtaatcatttcattatggctatgtatagcaaaacctcatgttatacaccttacatttayacaatgaaaatagtattgtaccagtgttaatttcttagtttggcaaatgcaccatggtaatctaagatgttacagtagggcaaattgagtaaagaatgtacaggaactctctgtactatctttgctactcttctgtaagtctaaaattatcctaaaataaaatggttctgcccctaacaaacttttgtcatcattttcactgccccagaggatcagactaagttacctccaaggctccttttaattttaaattgacaatttatgattcaagtaaggatcacttcctgtgtgaaacattat

SEQ ID NO: 74733 - DNA, 601 bp, Human
ccatgcaaatggacacaaaaagcaagcaggagtagctattcttatataagacaaagcaaactttaaagcaacaatgttaaaaaaaataaagagaaacattatataatgataaaaggccttgttccacaggaaagtatcacaatcctatatacatatatatatatatgcacctaacactggagctcccaaatttataaaacaattgctactagacctaagaaatgagatagacagcagcataataatggtgggagacttcaatattccactgacagcactagacaggtcattaagacagaamgtcaacaaagaaacaatggatttaaactataccctggaacaaatggacttaacaaatatttacagaacattctccccatcaaccacagaatatgcattctactcatcagcacatggaacattctccaagatagaccagatgataggccacaaaacaagtctcaataaatttaagaaaactgaaattatatcaagcactctctcagaccacaatggaataaaattggaaatcaactccaaaaggaactttcaaaaccatgcaaatacatagaaattaaataacctgctcctgaatgatcat

SEQ ID NO: 74734 - DNA, 601 bp, Human
tccaagatagaccagatgataggccacaaaacaagtctcaataaatttaagaaaactgaaattatatcaagcactctctcagaccacaatggaataaaattggaaatcaactccaaaaggaactttcaaaaccatgcaaatacatagaaattaaataacctgctcctgaatgatcattgggtcaacaatgaaatcaagacaaaattaaacaattatttgaactgaacaataatagtgacacaacctatgaaaacctctggggtacagcaaaggctgtgctgagagaaaacttcatagcctygaatgcctacatcaaagagtctgaaagagcacaaatagacaatctaaggtcacacctcaaggaactagagaaacaagaacaaaccaaactcaaacctagcagaagaaaggaaataactaagataagagtagaactgaatgaagttgaaacaaaaaagcatgcaaaagataaatgaaacaaaaaactggttctttgaaaggataaataaaactgatagaccattagtgagattaaccaagaaaagaagagagaagatccaaataagctcaattagaaatgaaaaaggagatattacaactg

SEQ ID NO: 74735 - DNA, 601 bp, Human
atatttgttttgttaactataggcacaatattaaacagcagacctcaagaacttatgatcttgcataactgaaactttatagcctttaaaataggaactcttcattttctcttccccccagcctctggtaaccacaattctgctctctgcttctgtgtttgactgttttagatacctcagataaggggaatcatgcaatatttgtccttctatgactggcttatttcacttagcaaaatatcttcaagtttcattcatgtagttgcatatcgtaggacttcctccttttaaggctgaatartaacccattatatgcatataccacattttcttcatttattcatccatcagtggacatttcattgtttccatatcttggctattgtgaataacagctgcagtgaacaagagagtgcaaatatttcttcaagatcctgatttcaataattttggataaatacctagaaataagattgctggatcacatgctatttctatttttaattgtgtaggtacctccacatagttttcatagatgcagcaccatttttcattcccaacaacagggtaaaaaggttccaatttctccacatccccacca

SEQ ID NO: 74736 - DNA, 601 bp, Human
aacttgcacgttctgcacatgtaccccagaacttaaagcataatttaaaaagaagggtggtaaaagtgggcatctttgtcttgttctagattttagagaaaaaactttccattttcagcattgagtataatgttaactttgagcatttcatgtatgtcctttagtatattgagttagtttccttctattcccaacttgtttagaatttttatcataaaagggtattgaattttatcaaatttcttttctacatttattgagatgattgtgtggtttttaccctttattctattaacatggwatatcacattagttgattttcatatgttgaatcatccttgcatcccagggataaatctcacttggtcatggtgtctgatccttttaatatgctgttgtatttggttggctagtattttgttgaggatttttgcatctatgtttatcagggttattggcctgtagtttgtttttcttacagtgtctttgtttggcattggtatcagagccaaggtattttacttggtattttaatatttggcctaataagatgagtttggaagtattctgcttcctagattctttggaagaaattgagaac

SEQ ID NO: 74737 - DNA, 601 bp, Human
ccagaacttaaagcataatttaaaaagaagggtggtaaaagtgggcatctttgtcttgttctagattttagagaaaaaactttccattttcagcattgagtataatgttaactttgagcatttcatgtatgtcctttagtatattgagttagtttccttctattcccaacttgtttagaatttttatcataaaagggtattgaattttatcaaatttcttttctacatttattgagatgattgtgtggtttttaccctttattctattaacatggtatatcacattagttgattttcatawgttgaatcatccttgcatcccagggataaatctcacttggtcatggtgtctgatccttttaatatgctgttgtatttggttggctagtattttgttgaggatttttgcatctatgtttatcagggttattggcctgtagtttgtttttcttacagtgtctttgtttggcattggtatcagagccaaggtattttacttggtattttaatatttggcctaataagatgagtttggaagtattctgcttcctagattctttggaagaaattgagaacatctttaaatgtttggtaggagtca

SEQ ID NO: 74738 - DNA, 601 bp, Human
taagatgacctttttcctatgcggatgcttccttccatttctcctgcccttggacatcagactccaggttcttcagccttcggactcttggacttgcatcagtggtttgctcggggctcttgggcctttggccacagactgaaggctgcactgtcggcttccctgcctttaaggcttttagcctctgactgagccaatactggcttcttttctccccagctcacagacagcctattgtgggtatttgccttttgatcatgtgagacaattctccctaataaactccctttcatatattcawgtatcctattagttctgttcctctggagaaccatgaataatacagcacataactggaacttgaggtttttaaaatccatttagctatttctaagtcttcatggagagtttaatccatttacctttaaagtaatcattgctaaggaaggatttactattgccttgttgttaattgttttctgtctgacctgcaattcttttatctctggttatcttcctttgtattttttaaaattttttatattgatattttatattgaaattttatattgatattttatgtaggtattatctttgtggt

SEQ ID NO: 74739 - DNA, 601 bp, Human
tctgttcctctggagaaccatgaataatacagcacataactggaacttgaggtttttaaaatccatttagctatttctaagtcttcatggagagtttaatccatttacctttaaagtaatcattgctaaggaaggatttactattgccttgttgttaattgttttctgtctgacctgcaattcttttatctctggttatcttcctttgtattttttaaaattttttatattgatattttatattgaaattttatattgatattttatgtaggtattatctttgtggttaccaaaggtttayataacacaacttttattatgttatctattttaagctgataacaacttattttcaatcacatacaaaaatccctgcccccacatactttgttatattattgatgtcacaattcacatgtttttatattatgtatcttttaaaatatttttataggtgtggttatgtcagtacttttctggcttttaacttttatcctgaaagtaaaagtaatttacacaccaccattacagtattacagtgttctgttttgtctatatatttatcttcaccagaaatttttgtacttccctttccttttgt

SEQ ID NO: 74740 - DNA, 601 bp, Human
attttttatattgatattttatattgaaattttatattgatattttatgtaggtattatctttgtggttaccaaaggtttacataacacaacttttattatgttatctattttaagctgataacaacttattttcaatcacatacaaaaatccctgcccccacatactttgttatattattgatgtcacaattcacatgtttttatattatgtatcttttaaaatatttttataggtgtggttatgtcagtacttttctggcttttaacttttatcctgaaagtaaaagtaatttacacascaccattacagtattacagtgttctgttttgtctatatatttatcttcaccagaaatttttgtacttccctttccttttgttctgtcatttcacatcattttgtttcaacttaaagaactcccttaagcatttcttgtaaagcagttccggtagtgatgaatttcctcagcttgtgtttctttgggaaagtcattatctctccttcatttttgaatgatggtgttggccatatatagtgttcttagttgacagattttttttctttcagcacttttaatatatcatcctgctctctagtg

SEQ ID NO: 74741 - DNA, 601 bp, Human
ttttcttgttgctttcaaaattctatttatctttggtttttgacaatttgattataatgcatctcagtgtggatgtctttggatttatcttatttggagctcttaggcttccttttttcctccagatttgggtaatttccaaccattatttctttgaataagctttctttccatttctgtctctcttcttgtgaaattcccataatgcatatataggccacttgatggtgccctataagtcccttaagtgagcttttatcactctttttcatttttttctttttgttcctctaactgaatwatttctaatgttgtgtctccaagtttgctgatcctttcttctgcttgatctagtctgctgttgaatccctctagtgaatttttttagttattgtattcttcagctcattgatttctgagctggtttcttggtagtcttttttaatgttttctatttctttgttgaaattctcactttgttcatgcatgttctattgacctcattgagcatctttctgatggttattttgaattttccatcagagacataatatatctccattgcattaagtttgatttctggagattaatcttgtacttt

SEQ ID NO: 74742 - DNA, 601 bp, Human
caaaaggagttgacctgtgtattggttgttgaatcactgggtttatgatgggaacgaagatccaagtcttcctattctgccatcttgctgatgttactgtcctctaattcttgaatgccttctatgtaacagagaattttcatgcacactatctcatttacttttcttaaaattctgaacaccaagttgacaaaaactaaatcgtaaagtataagatttagtaaaaatgtaggctcaaaatttttaatcacaaagctggtaagaggatttgaactcaggtacccaaagcagagtgtagtgytcctctacccagggtgtcaaggagatgtgtcaatgtgtagcacatggtttatgttcctcgggtttatttaaagcctctgagcctcatgtgtgtgttgctgtagtagtggaaaccactatcttgctaagaaggcttcacattggattgacagcaaattaccttttccattcattcacctattttcatgctgaaaatacttctcaatatttttgagtcaataaacaagaatgacttgttaaggctaggcttaccctagatggctcaggatcttgctggtggaactatttatgcctgcaaact

SEQ ID NO: 74743 - DNA, 601 bp, Human
atccaagtcttcctattctgccatcttgctgatgttactgtcctctaattcttgaatgccttctatgtaacagagaattttcatgcacactatctcatttacttttcttaaaattctgaacaccaagttgacaaaaactaaatcgtaaagtataagatttagtaaaaatgtaggctcaaaatttttaatcacaaagctggtaagaggatttgaactcaggtacccaaagcagagtgtagtgttcctctacccagggtgtcaaggagatgtgtcaatgtgtagcacatggtttatgttcctygggtttatttaaagcctctgagcctcatgtgtgtgttgctgtagtagtggaaaccactatcttgctaagaaggcttcacattggattgacagcaaattaccttttccattcattcacctattttcatgctgaaaatacttctcaatatttttgagtcaataaacaagaatgacttgttaaggctaggcttaccctagatggctcaggatcttgctggtggaactatttatgcctgcaaactatgaaataaaacctttgaaaactaaggccttgctaccagcatgtgtcttgtggatcagc

SEQ ID NO: 74744 - DNA, 601 bp, Human
aaattaacatggactacaagaaaggcatgtttcagaacttcaagcacattaacattggttttttcaaatcatgtggatctaacacacagccactggtgaaaatgctgcgtgctatgactttattcagtttttttgttttgttttgggtttttttttggagactgagtctcactctgtcacccaggctggtgtgcacaatctcggctcactgcaagctccacctcctgggttcaagggattctcctgcctcagcctcctaagtagctgggattacaggcacatgtcaccacgcccagctaattttttttttttttttgtatttttaatagaggggggtttcaccatcttggccaggcaggtctcctgacctcaagtgatctgcccaccttggcctccgaaagtgctgggattacaggtatgagccaccgtgcccagctgactttatttagtctttattataaattgaataaaacctttgtaaatagagatattttgtttcttgtaacctgtgtggattattgtaaattagcatgatatacttgtttcagaccaccaataacagccatcttatgaacagaggctttcaaataataggcaaatg

SEQ ID NO: 74745 - DNA, 601 bp, Human
tgaaaatgctgcgtgctatgactttattcagtttttttgttttgttttgggtttttttttggagactgagtctcactctgtcacccaggctggtgtgcacaatctcggctcactgcaagctccacctcctgggttcaagggattctcctgcctcagcctcctaagtagctgggattacaggcacatgtcaccacgcccagctaattttttttttttttttgtatttttaatagaggggggtttcaccatcttggccaggcaggtctcctgacctcaagtgatctgcccaccttggcctccsaaagtgctgggattacaggtatgagccaccgtgcccagctgactttatttagtctttattataaattgaataaaacctttgtaaatagagatattttgtttcttgtaacctgtgtggattattgtaaattagcatgatatacttgtttcagaccaccaataacagccatcttatgaacagaggctttcaaataataggcaaatgtgtgaaaagagacttaaacatttctgtaaagaattctatgaaaattttcaacattgtcattagaacttgtaccattaaaattttctaataataaaa

SEQ ID NO: 74746 - DNA, 601 bp, Human
taatgcagtcatatccactgctgcctatactcaccaaccagttagccatactctaaccagagggaccttcctgccccttgagttttaagattggtttaaagtcttattccactttgatggaaatccaaatcccccttggagtttttgttaatttggtgtaaacattcattcttataaattcttcttccctcaggagccaacttccacaaatactgcttctgtgccctaacacctccaggtgaaacccagccctttctacaagttccatggatgatccactcatacaaagcatttgtgaacrttgggactcagggtgacggagaactatttgctattcagaatgtgaactccccaatggtgcattagatatttccagtcttgaatgtcctctgccctcctcaccatctggatgtttccattggcagattgccccttcttcatcccagcatcatatcatcttgggggctctcatcttataccctttttttattccagatttctttattctttattctttattcaaatccgttgtaatttgaatcccagtttggatgtctggtttttgtttgcttgcctaggttcctcaattcaccccatcagt

SEQ ID NO: 74747 - DNA, 601 bp, Human
aacacctccaggtgaaacccagccctttctacaagttccatggatgatccactcatacaaagcatttgtgaacattgggactcagggtgacggagaactatttgctattcagaatgtgaactccccaatggtgcattagatatttccagtcttgaatgtcctctgccctcctcaccatctggatgtttccattggcagattgccccttcttcatcccagcatcatatcatcttgggggctctcatcttataccctttttttattccagatttctttattctttattctttattcaaatccrttgtaatttgaatcccagtttggatgtctggtttttgtttgcttgcctaggttcctcaattcaccccatcagtatttccttctatcccaagtggttagttaccaagtatttttccaataaaactttccacccccaataggaattctggagccagcaagtaacatcataaagtttttgcttctattacagaaggtaaatcagatcatcccacacccctgctgaataacccataagtgtcttcccatcgcctttagcataaagcctctaacttttttagaagggtctacaaagtttcccatg

SEQ ID NO: 74748 - DNA, 601 bp, Human
cccaatggtgcattagatatttccagtcttgaatgtcctctgccctcctcaccatctggatgtttccattggcagattgccccttcttcatcccagcatcatatcatcttgggggctctcatcttataccctttttttattccagatttctttattctttattctttattcaaatccgttgtaatttgaatcccagtttggatgtctggtttttgtttgcttgcctaggttcctcaattcaccccatcagtatttccttctatcccaagtggttagttaccaagtatttttccaataaaastttccacccccaataggaattctggagccagcaagtaacatcataaagtttttgcttctattacagaaggtaaatcagatcatcccacacccctgctgaataacccataagtgtcttcccatcgcctttagcataaagcctctaacttttttagaagggtctacaaagtttcccatgatgccacctctactggccattcaaatgttattttggtttctcatccacattgtgctttctccagcacccaggccttcacattcaccgtccttaggtcctgttctttctctccaactaatcatc

SEQ ID NO: 74749 - DNA, 601 bp, Human
tcaccatctggatgtttccattggcagattgccccttcttcatcccagcatcatatcatcttgggggctctcatcttataccctttttttattccagatttctttattctttattctttattcaaatccgttgtaatttgaatcccagtttggatgtctggtttttgtttgcttgcctaggttcctcaattcaccccatcagtatttccttctatcccaagtggttagttaccaagtatttttccaataaaactttccacccccaataggaattctggagccagcaagtaacatcataaastttttgcttctattacagaaggtaaatcagatcatcccacacccctgctgaataacccataagtgtcttcccatcgcctttagcataaagcctctaacttttttagaagggtctacaaagtttcccatgatgccacctctactggccattcaaatgttattttggtttctcatccacattgtgctttctccagcacccaggccttcacattcaccgtccttaggtcctgttctttctctccaactaatcatcaggtcaactcttaccagcccataggtctctgcctaactagcacttact

SEQ ID NO: 74750 - DNA, 601 bp, Human
gggagttaaagggcagtgcttacaaaaggtcacaatatactgcctaaatatgctgtgagcttcgtaagtaggctgcactcttgttagctatcatcaggatttaattaactggtgtcacagctgaattgacatttcatgcctgtggggaaatttgactgaactcatccattccgaaataaatgattagcaccaccatctttcacattatctttcaataagtgggacagctacattttcacaacttgctggggaaaaaccattttcaaactctaaataccagtaagcatggaaaagaaggatrgaaaataataaagtcaggcaaaatgatatttgtgggtgcttcattttatgaaaataaaacttgtttcagaggcagaatgaacctgttaggaacccctgtttttcataacaaattatgccagaagaatgttgcatagttttggaatttgcctgatcactgaactgttgagaacaaatgtattttatgggttcctgggttgtgggccgaccccctacccagtcagacaccagccaagcacagcttccaggtctttaaacttctcagcacagtaggccctaaaactgttcccatggtaacctt

SEQ ID NO: 74751 - DNA, 601 bp, Human
gtcaggcaaaatgatatttgtgggtgcttcattttatgaaaataaaacttgtttcagaggcagaatgaacctgttaggaacccctgtttttcataacaaattatgccagaagaatgttgcatagttttggaatttgcctgatcactgaactgttgagaacaaatgtattttatgggttcctgggttgtgggccgaccccctacccagtcagacaccagccaagcacagcttccaggtctttaaacttctcagcacagtaggccctaaaactgttcccatggtaaccttccatcaaacaggygagctgtaaaacaggtgagctcaggctgtcatttgcagacaaaacaagaaaaagaaatactgactgctcttgttcgtgatgccacaaagagaagtaatactgattactgaataaatagactgaaagtcagaatagctgttgaactaaataggaatcatggcgttagtgtcctgacaaaaaaaaaaaaaaaaaatacagcttctaaaatgtgtatgtctcaaagaaaatcaatgagaaaacagatcacaaattttgtagaaacattagttactgtttttggaggatctcctaaatatcgga

SEQ ID NO: 74752 - DNA, 601 bp, Human
cagtaacttaacggaatgttctgaggatcaaaggagaaaatatatttgaaagtgctttctaaaatataaaatttggtatatgactattattattaccctacatatcacataaaatcttggcacttctttttggcagaacaatttcttttcacttaaaactggcaggttgaattctttcctcaagtgtgttttgtttaatctccaaaattaggagctgtgcagagcttccagcctgagttcattttagaagtcaggaaataattgctgcattattatatatattgaactgtcattttacacrtgcacacatggcaacttgatgagaaaatatcatttgtacttattttaaattaatgcttaattggtgacagactttagctatcacctacactctggttgggccaagaaaatagagtatgatctagaaactgaaggacaaaagatgagtaatggtcaaggaaatggcagtgcaaggaattcaagggctataacctggcagcctacaggctggggcagacctgccaatgtattttctttggctagcaggggtttattttgttgtaattgtgctttttaatgatgttcttaaacagtgcatgta

SEQ ID NO: 74753 - DNA, 601 bp, Human
ggctcctaactcctgtcttcctctttactcccaaatagagggtatccccagtgttctgctcagtttctgatgcatgcttgttgcccaaaatatatctgaggaatggctgcataaataatggaagactagagagaggccatctctggcctttgagatcaacagccaaaatctgctctgacaatttctgagagttgtgaataattctagccaggtgtcagaaggaacctggcgagtgtagccccgggactctgattttcctgaagaaactgaaaagaaagaatacccaggtggaaaaggtacyctggtagctggacaggatgtttagtggatgcattatgtaatgtctgcagagaatcatggccataagtgctatgtaagcaccaaacatcattaatattactatttaaaagaactgagcagcctattccttcctaggtggtaacctgagcacagcagaattttaataagtctgatcatttattgggttgccagctggagcactgaccatgctctggatgtacgtcacacagtctgatttggtgcaatcaacactggctctgactcagcatcttacctgcctgaactattgcaacaccctcct

SEQ ID NO: 74754 - DNA, 601 bp, Human
tttcagatatgaagcacaatatgtatatgatttctatttatatttgtggacagtaagatttattagtaaggatcattatttttaggtctttgagatacaaaaattctgagattccaaataagtcctaaagtacatttagtataaaaaatgtatcatgaaaaatgaaacacactttggcaaattttccaataggttaaaagtaaaaggattttccatcagctctcggtgaatttgaaagcatatttataaccaggattccccattcactaagcatttaatgaataaacagccactgaccacsagcaaacttgcagctctggaggcaggactgtgttttggatccccagtacttagcaggctgtgtggttcttagtagattcttaatttgtatcgactagatgagaatatcaattagtaacttctatcatgggtatgattactctttcttttcctcgtacccaagtctcctctatccaatgaggacatctcagctgttccagatcccctcttgtaaagtctgtctacagaggattgtaaggaaagcaaaaagatagaagagaagaaaagataaaatttgcagagagagaagtttaaagagaga

SEQ ID NO: 74755 - DNA, 601 bp, Human
ttcttcttattgttcccctgtttcttcccgtagggctcgaattgacagactccacccagaatggcaaaatcacttgccttaatgccaagtgacgtagattcaaagttatgagctatattaagaatacagctgaagtttgatgtttactctttaccttgtgataacaaaaatatttttaaacccaaaaaagtaaacctcaatgatgtagtatattttgagactgagtaacaatttcaaattcatgattggaccatgtaattttctgctatgttgcttaataatgtcatcataacttgtttakttttttccagagcatgtattctcatattaagcaattcagtttggggacaatgaactgatactcctatttaacctgctcaaattcaggtataggtctttggctgagagagagaaaaagatatatttatttatcaattgttattccccacctcatcttcaaaatagctttgccttctacttcttaagaaaaaatgccaagaaaaaaaattactggcattttaaccttcattagtccatgtcataaagagttaaggctgacattgggaaatttttaggaatacttttaactccatgtgatttt

SEQ ID NO: 74756 - DNA, 601 bp, Human
cccgtagggctcgaattgacagactccacccagaatggcaaaatcacttgccttaatgccaagtgacgtagattcaaagttatgagctatattaagaatacagctgaagtttgatgtttactctttaccttgtgataacaaaaatatttttaaacccaaaaaagtaaacctcaatgatgtagtatattttgagactgagtaacaatttcaaattcatgattggaccatgtaattttctgctatgttgcttaataatgtcatcataacttgtttatttttttccagagcatgtattctcatrttaagcaattcagtttggggacaatgaactgatactcctatttaacctgctcaaattcaggtataggtctttggctgagagagagaaaaagatatatttatttatcaattgttattccccacctcatcttcaaaatagctttgccttctacttcttaagaaaaaatgccaagaaaaaaaattactggcattttaaccttcattagtccatgtcataaagagttaaggctgacattgggaaatttttaggaatacttttaactccatgtgattttttttcactttactcactgactttaat

SEQ ID NO: 74757 - DNA, 601 bp, Human
gtctttcttgctgtgtattctgtgagcacttccagggtgaagtttcaataagtaccgaccaggtcacgttgattgttcaagtcttctatgtccttactgattttctgtctatttgttctaataatgactgatagaggaatctgaaagtctccacttgtaactgtaaatttgtctatttctcctttcacttattttggtttatgctttacatattttgaagctctgttgttattaggtgcaaaagctttcaagattgctatgtcttcttgataaactgacccttttgactatatgtaatgtmcctctatattccaagcaatatgccttgtgttaatttcccttttgcctgatattaaaatagccatagttttcttttttaagtgtttgtgtggcatacctaatccacccttttgctttcagcctacttctgtctttacgtgtaaaagggtttcctgcagacagcatagagttgagtcttgctttttttttccaatctaaaaatctttgtcttttaactggagtatttaggacagcactatccaataaaaagagaatgttaaccttatatgtaatagtagattttctggtagacacattaaaa

SEQ ID NO: 74758 - DNA, 601 bp, Human
tgtttgtatttcttgtctcttctccgagatagtcacatccagaactttcaaaactttcctattcatgatctctcttgaatgattcaaagataattaaggggcataaaatattgttcaatttgaacatgagttttcattatatgagacacctaatgagggaaaaaatgatcacactaaatgtcattttttattaaagaaaaaactaggaacttatgctaggatttcttgtcaaaatatgcagtccattcttcttgtcatccactttttgctcctaccacaaagcaaaaagaaaagcagaagmacatttccagacacaaagccacaatagttctctaagaaccagaaacaagataaaaactcaaagcagggaaatgggctgaagtaatgggccctctgtgctctgggtctggaaaagacactattgagtctgggccccaatatagtcagaaggactgaaatgctccacgctagacagggcacagagccagcctctctgcttacagcaaagattcttcctgtttgacaaacaaacaaacaaacaaacaaacaaaaacatacataaagacctgaggatgcaggagacacatattcatcttactac

SEQ ID NO: 74759 - DNA, 601 bp, Human
actgtttcacatattctggtgttgagctgttacattacaatttattatatgtttatgtcgttgcattataatttacatttatgtagctttgaatgccttcccagagatgagaattcaggtaggaatttgcactagactgccaatagccttatgaagaaaacacttttattacccccatttttcacattaaaatacatactgaatcgcagaaatttcagtgacttccccaagtgtcaaaattaagattataactcaggaatatttgataacaaaacccattttcatttagcctgccatgacycatgtccttgggttgattatcaagtcagtcataaggtaaaactattaaataattgaatttgttttgcttactccaacctccaccctctgtgcccccactacactagtactcttcagaacagtagtaacacttcacgtttatgtagttctctaacacatattatctcatttgatcccaacaacaaccttatgaggtaaattaatcagattttcaaaagcaatgactcaagagacaggaggtctgggttaggtcacaagcacttactagctctatgacttcaggcagcttgtttatatctct

SEQ ID NO: 74760 - DNA, 601 bp, Human
gtagctttgaatgccttcccagagatgagaattcaggtaggaatttgcactagactgccaatagccttatgaagaaaacacttttattacccccatttttcacattaaaatacatactgaatcgcagaaatttcagtgacttccccaagtgtcaaaattaagattataactcaggaatatttgataacaaaacccattttcatttagcctgccatgacccatgtccttgggttgattatcaagtcagtcataaggtaaaactattaaataattgaatttgttttgcttactccaacctccrccctctgtgcccccactacactagtactcttcagaacagtagtaacacttcacgtttatgtagttctctaacacatattatctcatttgatcccaacaacaaccttatgaggtaaattaatcagattttcaaaagcaatgactcaagagacaggaggtctgggttaggtcacaagcacttactagctctatgacttcaggcagcttgtttatatctctgggcctcagtttcctcatcagcaaatgtgttagtccatatttacactactataaagaactacttgagactgagtaatttaca

SEQ ID NO: 74761 - DNA, 601 bp, Human
ttataaaagttaaaggggccaggcacggtggctcacacctataaccccagcacttagggaggccaaggcgggcggatcacctgaggtcaggagttcaagactagcctggccaacatggtgaaatcttctctctactaaaagtacgaatattagccaggcatagtggtgggcacctgtaatcccagctactcgggaggctgaggcaggagaatcgcttgaactcaggaggtggaggttgcagtgagcctagataaggctgcactccagcctgggtgacagagtgagactccatctcaaaataaataaataaataaataaataaataaataaataaataaataaggaatgaaatacgtaacacataaaaacttaaagaaggttatatgctaaaaaacagtttacatgctgaaaagcagtttatatgtgagcatccgtgttttaagctcaaccactactgtgatgtcctagacatcttcccaagagaactacggtagcatccttgtgtctgtggtgtcactgacctgccaggaacaaacgtataaatatgtaatgggttccatatctctttactataattactatcattttgtattatcatttc

SEQ ID NO: 74762 - DNA, 601 bp, Human
ataaccccagcacttagggaggccaaggcgggcggatcacctgaggtcaggagttcaagactagcctggccaacatggtgaaatcttctctctactaaaagtacgaatattagccaggcatagtggtgggcacctgtaatcccagctactcgggaggctgaggcaggagaatcgcttgaactcaggaggtggaggttgcagtgagcctagataaggctgcactccagcctgggtgacagagtgagactccatctcaaaataaataaataaataaataaataaataaataaataaataaatcaggaatgaaatacgtaacacataaaaacttaaagaaggttatatgctaaaaaacagtttacatgctgaaaagcagtttatatgtgagcatccgtgttttaagctcaaccactactgtgatgtcctagacatcttcccaagagaactacggtagcatccttgtgtctgtggtgtcactgacctgccaggaacaaacgtataaatatgtaatgggttccatatctctttactataattactatcattttgtattatcatttcccttgcaccatttacaccaaaccttagtctgtcctcccca

SEQ ID NO: 74763 - DNA, 601 bp, Human
aaatacgtaacacataaaaacttaaagaaggttatatgctaaaaaacagtttacatgctgaaaagcagtttatatgtgagcatccgtgttttaagctcaaccactactgtgatgtcctagacatcttcccaagagaactacggtagcatccttgtgtctgtggtgtcactgacctgccaggaacaaacgtataaatatgtaatgggttccatatctctttactataattactatcattttgtattatcatttcccttgcaccatttacaccaaaccttagtctgtcctccccagtagagcsacttgctccttttcctctcctggatctcagcttaggaatacagcatcaaattaaggagctgagaatgcatcctaagcaaataaatggaagtttcacatttgcatttcagcagggaatttctgtagataataatcaccttaacatgtcttgagtccttactaggtgtcaggcactgtgttaagaaccactttaggaacataagagaacaaagctaaggatgggcacttctgtggagacattttatggtaaggatcctgttgtgttcctcaaattatcacccaggttttagccagcttcttt

SEQ ID NO: 74764 - DNA, 601 bp, Human
gcactgtgttaagaaccactttaggaacataagagaacaaagctaaggatgggcacttctgtggagacattttatggtaaggatcctgttgtgttcctcaaattatcacccaggttttagccagcttctttaattgagccagcctgttgtgtgtttcttctctaatataatcacagcctgccttttcgttctcactgttgccaaattcaaatgtttgcacagggtagtagtcgaggctgatttgaatctcaaagtaattattcctagagatcaaagatcctagtagcaaaggaataataarccctgatgaaatgccacattgccacgctcactctttgttaaaagagaagtaagttttctcaggtgaagaatttaccaggatactctcacatgcacacgatgattgaagtgacacttttgtttctgctgttattgccgaggctgctgtttagatcaaggtgaggtcaaggagtagagggttgcagctgggcagaggacctgaagagttgccagtccgaccgccaatctttctttgaatctcattgtaagggcaaaaagaaaacatgattttttaaaccggaatcttttatctcaatcagtg

SEQ ID NO: 74765 - DNA, 601 bp, Human
tttaggaacataagagaacaaagctaaggatgggcacttctgtggagacattttatggtaaggatcctgttgtgttcctcaaattatcacccaggttttagccagcttctttaattgagccagcctgttgtgtgtttcttctctaatataatcacagcctgccttttcgttctcactgttgccaaattcaaatgtttgcacagggtagtagtcgaggctgatttgaatctcaaagtaattattcctagagatcaaagatcctagtagcaaaggaataataagccctgatgaaatgccacaytgccacgctcactctttgttaaaagagaagtaagttttctcaggtgaagaatttaccaggatactctcacatgcacacgatgattgaagtgacacttttgtttctgctgttattgccgaggctgctgtttagatcaaggtgaggtcaaggagtagagggttgcagctgggcagaggacctgaagagttgccagtccgaccgccaatctttctttgaatctcattgtaagggcaaaaagaaaacatgattttttaaaccggaatcttttatctcaatcagtgtaacgtgcagcctcccctg

SEQ ID NO: 74766 - DNA, 601 bp, Human
tggagacattttatggtaaggatcctgttgtgttcctcaaattatcacccaggttttagccagcttctttaattgagccagcctgttgtgtgtttcttctctaatataatcacagcctgccttttcgttctcactgttgccaaattcaaatgtttgcacagggtagtagtcgaggctgatttgaatctcaaagtaattattcctagagatcaaagatcctagtagcaaaggaataataagccctgatgaaatgccacattgccacgctcactctttgttaaaagagaagtaagttttctcwggtgaagaatttaccaggatactctcacatgcacacgatgattgaagtgacacttttgtttctgctgttattgccgaggctgctgtttagatcaaggtgaggtcaaggagtagagggttgcagctgggcagaggacctgaagagttgccagtccgaccgccaatctttctttgaatctcattgtaagggcaaaaagaaaacatgattttttaaaccggaatcttttatctcaatcagtgtaacgtgcagcctcccctgtgttccaatttgaaatgtgcaggtccttcaggagagtggatt

SEQ ID NO: 74767 - DNA, 601 bp, Human
ggaggcaattgtaggaagccaggctgaggtctgctgggatgggtgtgttctgtgactgttcccaagagccagaggggccagaaatgactggcaatggctttttgatggcactgtcatctccctttctcttcagaggagggtcatgttctttttcattcattattcaagggaatttgctgagcatctatgatgtgccaggttctaagatagatgttggaaatttttaaacatcctgctcttgcagagcttgtaatctaatgagaacaatagataagtgaacatataatgactgcactgtatrgaataaggcctcagcttaaaatgaatgatgagagtccagaggagttcacggaagaaggagctgagcgtgagtaacatggatgaaggggaaagaggatttggaaactggttggaaaaaacatcacagagcaggagacaaccaagcagagggttggagggttttttgtttgtttgtttgttttacttttttccattcttttaattttcatttttactgtaaaagtaacgcattcttgctgaaaaaaaaaaaaacttaaaaatgtaaagaatataaagtaggctgggtgtgggggctcacacc

SEQ ID NO: 74768 - DNA, 601 bp, Human
ctgtatggaataaggcctcagcttaaaatgaatgatgagagtccagaggagttcacggaagaaggagctgagcgtgagtaacatggatgaaggggaaagaggatttggaaactggttggaaaaaacatcacagagcaggagacaaccaagcagagggttggagggttttttgtttgtttgtttgttttacttttttccattcttttaattttcatttttactgtaaaagtaacgcattcttgctgaaaaaaaaaaaaacttaaaaatgtaaagaatataaagtaggctgggtgtgggggcwcacacctttaatcccagcactttggaaggccgaggcgggtggatcacctgaggtcaggagttcgagaccagcctggccaacatggtgaaaactcgtctctactaaaaatacaaaaattagccaggcgtggtggcacgtgcctgtaatcccagctactcaggaagctgaggcaagagaatcacttgaacccgggaggtgggggttgcagtgagccgagatcgcaccactgtactccagcctgggcaacagagtgagactccgtctcaaaaaaaaaagaaaaaaaaaaaaagaatataaagt

SEQ ID NO: 74769 - DNA, 601 bp, Human
gctaggcatcatctcagttaccacaagacctttttgagatttgtataatatcataccactatagtccattatgccactaaataaatgtgtagaaaagcaccaatggaaagaagattacataaagtggaaataagaccatctcaggctcaaaggaacctacactatcatctagttcaaccctattatttaagagtccatcatatacaggtgcagtggctcatgcctgtaatcccagcactttgggaagctaaggtgggcagatcacttgagctcagaagttcgagaccagcctgggtaacayagtgaaactctgtctccacaaaaaaaaaaaaaaaaaaaaaaattgcctatcatatacttacttcaattagctatgctgtctagtacatttttctccttattcctttagctgaagaggaatagaactggtatccatttggagggacattggactcaactaaattctcaggaatgaagattaagacagtcaggaaaaatattgggatgctaaatgagtggaaattaagggggagcagagtgtggaagtattttgtaaaaaataaaacacattacttaacatgcagaatgcagaggcattcca

SEQ ID NO: 74770 - DNA, 601 bp, Human
accactatagtccattatgccactaaataaatgtgtagaaaagcaccaatggaaagaagattacataaagtggaaataagaccatctcaggctcaaaggaacctacactatcatctagttcaaccctattatttaagagtccatcatatacaggtgcagtggctcatgcctgtaatcccagcactttgggaagctaaggtgggcagatcacttgagctcagaagttcgagaccagcctgggtaacacagtgaaactctgtctccacaaaaaaaaaaaaaaaaaaaaaaattgcctatcatrtacttacttcaattagctatgctgtctagtacatttttctccttattcctttagctgaagaggaatagaactggtatccatttggagggacattggactcaactaaattctcaggaatgaagattaagacagtcaggaaaaatattgggatgctaaatgagtggaaattaagggggagcagagtgtggaagtattttgtaaaaaataaaacacattacttaacatgcagaatgcagaggcattccacttttcctactccaacacacacccaaggaggtccaggagaaataaaaaggcatg

SEQ ID NO: 74771 - DNA, 601 bp, Human
gacctcatgatctgcccacctcggccttccaaagtggtgggattacaggcgtgagccaccgtgcccggctataatggcgtatttaaacagctatgattccaggtagtcatttgaatagttagaatcaactcataaaatattatcaaaagaaaggaaccttaacatcaccatgaaacaatctatactccttatgccctttattattctaaacattctaaataggcaaaatgggtgattaatgagctaggtcagcatttacacttatagtcagatgtctacaatgtgttaagtttaaatggakcaatgtttttttgtttgtttgtttttggggggtttattgagatggagtcttgctctgtcacccaggctggagtgcagtggcgtaatctcggctcactgcaacctccacctcccagtttcaagcgattctgttgcctcaacttcccaaggagctgggactacagaagtgagccaccacgcctcactaatttttgtatttttagtagagacgggttttcatcgtgttggtcaggctggtctcaaactcccaacctcaggtgatctgcccaccttggcctcccaaagtgctgggattacaggc

SEQ ID NO: 74772 - DNA, 601 bp, Human
atgatctgcccacctcggccttccaaagtggtgggattacaggcgtgagccaccgtgcccggctataatggcgtatttaaacagctatgattccaggtagtcatttgaatagttagaatcaactcataaaatattatcaaaagaaaggaaccttaacatcaccatgaaacaatctatactccttatgccctttattattctaaacattctaaataggcaaaatgggtgattaatgagctaggtcagcatttacacttatagtcagatgtctacaatgtgttaagtttaaatggagcaatgtttttttgtttgtttgtttttggggggtttattgagatggagtcttgctctgtcacccaggctggagtgcagtggcgtaatctcggctcactgcaacctccacctcccagtttcaagcgattctgttgcctcaacttcccaaggagctgggactacagaagtgagccaccacgcctcactaatttttgtatttttagtagagacgggttttcatcgtgttggtcaggctggtctcaaactcccaacctcaggtgatctgcccaccttggcctcccaaagtgctgggattacaggcgtgagc

SEQ ID NO: 74773 - DNA, 601 bp, Human
ctgtcacccaggctggagtgcagtggcgtaatctcggctcactgcaacctccacctcccagtttcaagcgattctgttgcctcaacttcccaaggagctgggactacagaagtgagccaccacgcctcactaatttttgtatttttagtagagacgggttttcatcgtgttggtcaggctggtctcaaactcccaacctcaggtgatctgcccaccttggcctcccaaagtgctgggattacaggcgtgagccactgcgcccagcctggagcaatgttgataatataacacattatatggyttaatagcatattatttatgtgtatatgttagaagaaggtctagaagaaggcatatcaaaatgtcaggatttgtgggaggaggagaacaaacaagacttccaatttacttcatttgttcttttattgggtgagcaatttttacaataagcatatatgttgtatcatataaagtgtattttaaataaataaaataatattgcttagttgtggataatatgcatcttcttatcatagtttgtctctttagaaaattctctatcaggccaggcacggcggttcacgcctgtaatcctagcact

SEQ ID NO: 74774 - DNA, 601 bp, Human
agaaagaaaagaaagaaagagggagggagggagagagggagggggaaggaaggagggagggagggagggaaggaaggaaggaagggaaactctctatcagatgaagagatatagttgactaaatctgcctatacggcttccagcagaattaaaaatctaaaacttgtgcaagaaaccctgatatgaaagagtataaatatgaaagaaagaatgaaaatcccaatttattaattcaatataatcttattttgtttaagtcagtgggaaataaattttggtatatggctccttttacttacaygcagaggaagttgtaccaattcagattacataatttctactgtgtataatcagtttccagtgtgaaaaggtttaaaattcatatcatatcaccagttctgtatgaatccttaaaatcttaatgggactctaaaaaacaccttacagcatagataagctgtaaacaacattgttctccattgattcatgttcctccttggagtaattccacaattttatgtatccaaaaggccaaaaagttaataagatgaataaagattaatatttattgatactctggtttaaacattctcaaactcta

SEQ ID NO: 74775 - DNA, 601 bp, Human
ttttatgtatccaaaaggccaaaaagttaataagatgaataaagattaatatttattgatactctggtttaaacattctcaaactctatgaggtatataattttattacctatatcttagcaatgaagtaaccaaggtaagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaascttttagttgaattatcaattcttgtgtgtgccaacattcaaatttaataaatgcattttattcatctatacgttctcactatttttctctatatggtatttgttacgtatccaaattttttttaaaaaaagcagggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaat

SEQ ID NO: 74776 - DNA, 601 bp, Human
taagaattttaattaaattataaagcataaataaacccccatgctaataatgagtagagtcaggatttgattccaggtagtccaaaaaaagaatgtgtgttctttccaccaagcaatactgtcttaaatattagagacactgaaggtcaaagcagcaccttaagcttttagttgaattatcaattcttgtgtgtgccaacattcaaatttaataaatgcattttattcatctatacgttctcactatttttctctatatggtatttgttacgtatccaaattttttttaaaaaaagcaggrccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaaa

SEQ ID NO: 74777 - DNA, 601 bp, Human
ggccaagtgtggtggctcatgcctgtaatcctagcactttagaaggcccaggcacgtggatcacctgaggtcaggagtccagagaccagcctggccaacatggcgaaacctcgtctctactaaaaatacaaaaattagctgggcgtggtggcccacaactgtaatcccagctactcaggagcctgaggcaggagaaatgcttgaacccgggaggtggaggttgcagtgagcccagatcatgccacttcactccagcctgggcgacagagtaagactctgtctcaaaaaaaaaaaaaaaaaraaaagaaagaacagtaaagaaggtctcatgtaaatgagaaatgttctctacaatattattttagggggctacaacagcctggcagggtgcttaccaggatatctcgatgcttagcacagtgacttgcccatagtgtagattaaaggtcccaacactaggcttccagtcccaacactgcatctaaatatatgaccttggccattctctggctttactttatttattaaatgagcactttggactaggtaatctctaaggtcatttccatttatttatttatttattttatttattttttat

SEQ ID NO: 74778 - DNA, 601 bp, Human
ctgcatccgtggtaatcttcccttaaccaactgtcagtctttcctatgggaacaggcaaacctttatgtaccaaatgtgtctttaagaaattatctataaatttgattattttgtaaatacacatagtgtgttagttcattttcacactgctgataaagaaatagccaagactgagcaatttacaaaagaaagaagtttaattggacttacagttccacgtggctggggaagcctcacaatcatgacagaaggcaaggaggagcaagtcatgtcttatacagatggcagcaagcaaagagmgcttgtgtaggaaaactccctcttataatagccatcagatctcatgagacttattcactatcacaagaacggcatgggagagacctgcccccaggattcagttacttcccacagggtccctcgcacaacacttgggaattcaagatgagatttgggtgagaacacaaccaaaccatattattctgccccttgcccctcccaaatctcatgtcctcacatttcaaaaccaatcatgccttcccaacagtcccgaaaagtcttaactaattaactcgaaagtgcacagtcaaaagtttcatc

SEQ ID NO: 74779 - DNA, 601 bp, Human
gtggtaatcttcccttaaccaactgtcagtctttcctatgggaacaggcaaacctttatgtaccaaatgtgtctttaagaaattatctataaatttgattattttgtaaatacacatagtgtgttagttcattttcacactgctgataaagaaatagccaagactgagcaatttacaaaagaaagaagtttaattggacttacagttccacgtggctggggaagcctcacaatcatgacagaaggcaaggaggagcaagtcatgtcttatacagatggcagcaagcaaagagagcttgtgyaggaaaactccctcttataatagccatcagatctcatgagacttattcactatcacaagaacggcatgggagagacctgcccccaggattcagttacttcccacagggtccctcgcacaacacttgggaattcaagatgagatttgggtgagaacacaaccaaaccatattattctgccccttgcccctcccaaatctcatgtcctcacatttcaaaaccaatcatgccttcccaacagtcccgaaaagtcttaactaattaactcgaaagtgcacagtcaaaagtttcatctgagacaa

SEQ ID NO: 74780 - DNA, 601 bp, Human
taaatacacatagtgtgttagttcattttcacactgctgataaagaaatagccaagactgagcaatttacaaaagaaagaagtttaattggacttacagttccacgtggctggggaagcctcacaatcatgacagaaggcaaggaggagcaagtcatgtcttatacagatggcagcaagcaaagagagcttgtgtaggaaaactccctcttataatagccatcagatctcatgagacttattcactatcacaagaacggcatgggagagacctgcccccaggattcagttacttcccacasggtccctcgcacaacacttgggaattcaagatgagatttgggtgagaacacaaccaaaccatattattctgccccttgcccctcccaaatctcatgtcctcacatttcaaaaccaatcatgccttcccaacagtcccgaaaagtcttaactaattaactcgaaagtgcacagtcaaaagtttcatctgagacaaggcaagtcccttctgcctatgagtctgtaaaatcaaaagcaagttagttacttcctagatacactcggggtacaggcattgacacagctgttccaaatgggaaaca

SEQ ID NO: 74781 - DNA, 601 bp, Human
aaagtgcacagtcaaaagtttcatctgagacaaggcaagtcccttctgcctatgagtctgtaaaatcaaaagcaagttagttacttcctagatacactcggggtacaggcattgacacagctgttccaaatgggaaacattgaccaaaacaaagaggctacaggccccatgcaactccaaaatccactgggacagtcaaatctcaaagctccaaaatgatatcctttgactccgtgtctcacatccaggtcatgctgatgcaagaggtgggttcccatggtcttaggcagttccactcctrtggctttgcagcatatatcccccctcctggctgcattcacaggctggcattgagtgtctgcagcttttccaggtgcacagtgcaagctgtcagtggatctaccattctggggtctggaggatggtgaccctcttctcacagctccactaggcagtaccccagtagggactctgtgtgcagtctccagccccacatttcccttttacattgccctagcagagggcatgaggtccctgccctgctgcagcaaacttttgcctgggcatccaagtgtttccatacattttctgaaatctaggt

SEQ ID NO: 74782 - DNA, 601 bp, Human
tatcagcattttggtcaaagccattcaacaagtctctagggaattccaaactttcccacattttactgtcttctgagccctccaaactgttccagcctctgcctgttacccagttccaaattgcttccacagttctgggtatcttctcagcagcactccactctcggtaccaatttactgtattcattcgtttccatgctgctgacaaagacatacccaagactgggcaatttacaaaagaaggaggtttaattgggcttacagttccacgtggctggggaagccccacaatcatggcggraggcaaagaggagcaagccatgtcttacatggatggcaccaagcaagagagcttgtgcaggaaaactcccccttacaatagccatcagatttcatgagatttactcactatcatcagaacagcacgggaaagacctgcccccatgattcagttatctcccactgggcccctcccacaacacgtgggaattcaagatgagatttgggtggggacacagccaaaccatatcacataggtatggctattttcaagtttttttcattgtttttgcttttaggttttgggattctcttttgtttt

SEQ ID NO: 74783 - DNA, 601 bp, Human
caaaatacacgacacaaagtttaagcacttaaaaaacaattagtcttagatcctcggaaaccttaaattatgtagttgcatcatcagtagtcagagatagcaatgaaaaggggaaattcatcaaagaaacactaacccttgtggtttgaactaagacgtttcaagaaccttttatcgaacgacaaggttgtaattagagttgtcctgagaaaacagaggagaaaaataccgcttagaggaataattttggcaaatagtttcctcagtagacatctagtttactctgttgaaatgtatgagaaaaaaaaaaagtggaaagaaatcaatcatctgtgaattcttacacaattaacttacataagcatgtctcttttctttactagccaatatccagagcactttttgttccagatgttaatagtaatattagagcagaaaactgaaagaatacccaaaaaggagaaaatagcagttacttggcaagcgctgttagtcttttgcctataatgataatcacatatttaattataagtaaacttcactgtatcaataattcttataatttaactatattgatgtaaactttctgagaatgctcttt

SEQ ID NO: 74784 - DNA, 601 bp, Human
ggacatagcaagtgtggatcaataaactatggttaatagacaagctacttacctggtaagcagtctgttgtcaccaatgtattgatgttgatgattttctatcttttcctgggtcaaataaataagtgatgctgaaccagcagtctacaggtattgtctcagcatattgacagagatggtctcaattttcacatctataaaatgggtataataataataaatacataataataaatacctcacagtatgtgtgagaattaaatcatgtaatgtaagtcactattataatagattattgtcwtttttatacttattttctaaacatattgaaaattctagtaggttttattttaaccttcttttttttttttttacttttactttaagttctgggatacatgtacagaacatgcagtttgttacataggtatacatgtgccatggtggtttgctgcacctatcaacctgtcatctaggttttaagccccgcatacattaggtatttgtcctaatgctctccctccccttgcccccaccccccgacagttctcatgtgatgctaatacttataacaaacattcataactaggtatgctttcaa

SEQ ID NO: 74785 - DNA, 601 bp, Human
taaactatggttaatagacaagctacttacctggtaagcagtctgttgtcaccaatgtattgatgttgatgattttctatcttttcctgggtcaaataaataagtgatgctgaaccagcagtctacaggtattgtctcagcatattgacagagatggtctcaattttcacatctataaaatgggtataataataataaatacataataataaatacctcacagtatgtgtgagaattaaatcatgtaatgtaagtcactattataatagattattgtcttttttatacttattttctaaacatattgaaaattctagtaggttttattttaaccttcttttttttttttttacttttactttaagttctgggatacatgtacagaacatgcagtttgttacataggtatacatgtgccatggtggtttgctgcacctatcaacctgtcatctaggttttaagccccgcatacattaggtatttgtcctaatgctctccctccccttgcccccaccccccgacagttctcatgtgatgctaatacttataacaaacattcataactaggtatgctttcaaaaataatcattcactgaagaat

SEQ ID NO: 74786 - DNA, 601 bp, Human
aactatggttaatagacaagctacttacctggtaagcagtctgttgtcaccaatgtattgatgttgatgattttctatcttttcctgggtcaaataaataagtgatgctgaaccagcagtctacaggtattgtctcagcatattgacagagatggtctcaattttcacatctataaaatgggtataataataataaatacataataataaatacctcacagtatgtgtgagaattaaatcatgtaatgtaagtcactattataatagattattgtcttttttatacttattttctaaacatattgaaaattctagtaggttttattttaaccttcttttttttttttttacttttactttaagttctgggatacatgtacagaacatgcagtttgttacataggtatacatgtgccatggtggtttgctgcacctatcaacctgtcatctaggttttaagccccgcatacattaggtatttgtcctaatgctctccctccccttgcccccaccccccgacagttctcatgtgatgctaatacttataacaaacattcataactaggtatgctttcaaaaataatcattcactgaagaattt

SEQ ID NO: 74787 - DNA, 601 bp, Human
cttacctggtaagcagtctgttgtcaccaatgtattgatgttgatgattttctatcttttcctgggtcaaataaataagtgatgctgaaccagcagtctacaggtattgtctcagcatattgacagagatggtctcaattttcacatctataaaatgggtataataataataaatacataataataaatacctcacagtatgtgtgagaattaaatcatgtaatgtaagtcactattataatagattattgtcttttttatacttattttctaaacatattgaaaattctagtaggttttwttttaaccttcttttttttttttttacttttactttaagttctgggatacatgtacagaacatgcagtttgttacataggtatacatgtgccatggtggtttgctgcacctatcaacctgtcatctaggttttaagccccgcatacattaggtatttgtcctaatgctctccctccccttgcccccaccccccgacagttctcatgtgatgctaatacttataacaaacattcataactaggtatgctttcaaaaataatcattcactgaagaatttgtaatatataaagtaaaaacgcg

SEQ ID NO: 74788 - DNA, 601 bp, Human
gcagtctgttgtcaccaatgtattgatgttgatgattttctatcttttcctgggtcaaataaataagtgatgctgaaccagcagtctacaggtattgtctcagcatattgacagagatggtctcaattttcacatctataaaatgggtataataataataaatacataataataaatacctcacagtatgtgtgagaattaaatcatgtaatgtaagtcactattataatagattattgtcttttttatacttattttctaaacatattgaaaattctagtaggttttattttaaccttcttttttttttttttacttttactttaagttctgggatacatgtacagaacatgcagtttgttacataggtatacatgtgccatggtggtttgctgcacctatcaacctgtcatctaggttttaagccccgcatacattaggtatttgtcctaatgctctccctccccttgcccccaccccccgacagttctcatgtgatgctaatacttataacaaacattcataactaggtatgctttcaaaaataatcattcactgaagaatttgtaatatataaagtaaaaacgcgtgtgtgtgtgat

SEQ ID NO: 74789 - DNA, 601 bp, Human
aagtactttatttatccatctattatactaaattgtgcctcgtttctcccttgtagccccagtggctccggaaatcacttctgtggaatatttcaacagtctgttatatatcagttggacatatggggatgatacaacggacttgtcccattctagaatgcttcactggatggtggttgcagaaggaaaaaagaaaattaaaaagagtgtatgtttctttgaatgccagcattgtgtgtctgtaaatttagttttatgaactattgaaaaccactaagcaatcatttattgacacgtcaawtgtttgcataccagttgtctgttttaggctctggagataagacagtgaacaaaaattgaattcttcctttcatagagcttaccgtttaatctttaacagtgagatgtaagagctccaactattgatttcatttatatttagaattatgatttgagctttttcttcaggatgccaaacattttcaagaaaactacaattaacgtgtttcccattttttcccatatatcaccgacacctaaagatttggggaccttgggactactgatttcttttctccaaaatacgcttttggatgtttat

SEQ ID NO: 74790 - DNA, 601 bp, Human
cccattctagaatgcttcactggatggtggttgcagaaggaaaaaagaaaattaaaaagagtgtatgtttctttgaatgccagcattgtgtgtctgtaaatttagttttatgaactattgaaaaccactaagcaatcatttattgacacgtcaaatgtttgcataccagttgtctgttttaggctctggagataagacagtgaacaaaaattgaattcttcctttcatagagcttaccgtttaatctttaacagtgagatgtaagagctccaactattgatttcatttatatttagaattrtgatttgagctttttcttcaggatgccaaacattttcaagaaaactacaattaacgtgtttcccattttttcccatatatcaccgacacctaaagatttggggaccttgggactactgatttcttttctccaaaatacgcttttggatgtttattgataaggggacagactaaactactgtaataaagaaacaaacaaaaagagagtggctcaaacaaaatagaagtttatacctctcccatgatagcacaggactaaccaggcacttctgctttaaggggtcacccagggaggcaaatt

SEQ ID NO: 74791 - DNA, 601 bp, Human
taagacctttctttttcaggacaggcagagccaaggcaaatctggacttaaggtgccacctagagctgaaatgtaggcagtgatctagtggtaaatatttgctaggcaaacatagccaataaaagacaaaacaaggcaaggcagacaaaggaaagtggactaaatagttaattatttaatgcaaagacatagttctatgcccataagaaacaacatcaaacagggaactgtgacccgcccacgctacccaggaaaaggacaaagcaaaaatccaatgactgaccctaacaagatggtgatytgtgagctctctgaacaagaattcaaaatacagtttaaggaaaatcagtgatgtccaggaaaacacagaaaagcaattcagaaatttatcagagaaatttttaaatcaaacaaattcttggtactggaaaatacgtttgctgaactgaaaaacacatcacagcagaatggacaaaggagtggaatgattcagggagctaaaagcctatctgaaaatacaccattggaggagaaaaaagaaaaataagactgaaagtaagtgaagtctgactataagatattaaaaaaaaaaggctgggca

SEQ ID NO: 74792 - DNA, 601 bp, Human
ttaaaaaaaaaaggctgggcacggtggctcacacctgtaatcccagcactttgggaggccaaggcgggcagatcacgaggtcaggagatcaagaccatcctggctaacatggtgaaaccctgtctctaataaaaatacaaaaaaaaaaaaaaaattagccagcatggtggcgggtgcctgtagtcccagctactcgggaggctgaggcaggagaatgatgtgaactcgggaggtggagcttgcagtgagccgagatcgcaccactgcacaccagcctgggtgacagagcaagaatctgtcaaaaaaaaaaaaggtattaaaaaaaccttaaaagatcaaacataagaattattagtattcaagggggagctgaataaggaagtttactgaaagaaataataatagaaaacattccaaaacttgagacaggtacaaatagccaggttcatgagggtctgagaataccaaacagataccactcaaataaaatcaccccaaagcgtataatactcagactctcaaaggtcaaggacaaagagaagatcctgaaagcatcaagagaaaaggagcaaataacaggtaaacaagctgcaattcacct

SEQ ID NO: 74793 - DNA, 601 bp, Human
tcattttttaagatgtctgctaatttttgtgtctgaatttgttcataacagtctcaagccatctctgttattacatgtgttcatattagcagctgtaagtaaagactaattcgtggttgttttattagtagcttaaataccatgggtagtattgttgacagtgatgtacttttagaaaaattttagaaaatctaaaaaacaaaaaatacgatctttcctcaatttacccagtaattgcatttctccagaactcaatgcataggtcactgagtcttaaatttctttgtctcctatttgccawgacaaaagctaagtttttgtgctgaaatactttaaaattgtataggtaatttggaaatatgtgatgtgttgattagacactatggaagtaaaaattataatattgaataatttataattttaaatactatcttaattggatttaaatatgccttttcatgacaactttcttctaaattattttacttaatttctttttaaaaactttcaatattatgtagcaaagtacttgcaatttacacttatggtggattttctctggtatgacatttgaaagtcatgtgggatgtgggacatggga

SEQ ID NO: 74794 - DNA, 601 bp, Human
attatctctgactctgacctctgtgggtgtaaagggccgttcaaaaactcatttccaggtaactgtaattacttgaagattgagctcatattcccaatgtcttcctttttccaagctttactaatacaggaagctattaagtgtttctcaggtcctagcagctttctccaactcatttggtttttcagtctcccttaaaatttaagttcagaggtggtcttatcaaagtagcatttagtgggcctattggatacttcactgaaatttctatgtgacatcatggtcgaaggtgcctcaggartatgagtcaaagtcatgaactagtacaactgtatctacataggactgtgagttaaaaccatgatagtttcccaaacttatcaaaatgtttggagtctccatgtctccctgataatagaatggactatgtaaaccagcttggaaaatttatttaaactttacaagaaggaaagttgagttttcatggaaattatttctagttaatgtaacccttaggatcaataacctttttcttattggtatcttaaatatcaaatggaatattgtttctatcttattcctctctgtagacaagacaatc

SEQ ID NO: 74795 - DNA, 601 bp, Human
aacatagtattgcagttaatatttaatcggaacaagtttaacctttcagagaagtgaaataatatcttgctttagtagtacctgaattgcaggttttgtgtgtgtttgtgtgtgttttttacagaactttcattctagttgttttatgtttcttcccagcattcattttgatatatatagaagtcatagtcattctcctttaaagaaaaatacaactttggcacagatttttcagagcatgtttgaatcagaatgccattgttaaagctggggccgtaactggttgggctaacctgcagtycaatttatctataatagaggcctctttagaatgcctctgaatgactcctgtgtcatggagggtaggttctacctctatagaaagaaaccaaactaccaatgagtccagtatcatataaattaatctaatgtgtcatgtgcaagggtagagagccctcaaacagttgccaataattctcaacattgtatcatcaataaacatccataaaaagaaatgcaccaataatggtgcttttcccaggatgttgaaccaaccatcccattaggaattttaggttgccagcagtttcacgaaactttg

SEQ ID NO: 74796 - DNA, 601 bp, Human
gaaataatatcttgctttagtagtacctgaattgcaggttttgtgtgtgtttgtgtgtgttttttacagaactttcattctagttgttttatgtttcttcccagcattcattttgatatatatagaagtcatagtcattctcctttaaagaaaaatacaactttggcacagatttttcagagcatgtttgaatcagaatgccattgttaaagctggggccgtaactggttgggctaacctgcagttcaatttatctataatagaggcctctttagaatgcctctgaatgactcctgtgtcrtggagggtaggttctacctctatagaaagaaaccaaactaccaatgagtccagtatcatataaattaatctaatgtgtcatgtgcaagggtagagagccctcaaacagttgccaataattctcaacattgtatcatcaataaacatccataaaaagaaatgcaccaataatggtgcttttcccaggatgttgaaccaaccatcccattaggaattttaggttgccagcagtttcacgaaactttggtggtatgtgatgacaggtccctttgacagtcagtcattactatcttctagtctt

SEQ ID NO: 74797 - DNA, 601 bp, Human
caatgagtccagtatcatataaattaatctaatgtgtcatgtgcaagggtagagagccctcaaacagttgccaataattctcaacattgtatcatcaataaacatccataaaaagaaatgcaccaataatggtgcttttcccaggatgttgaaccaaccatcccattaggaattttaggttgccagcagtttcacgaaactttggtggtatgtgatgacaggtccctttgacagtcagtcattactatcttctagtcttggtgaatcaacctggatccctgggccaactttaagaggacaygttaagtctacataagataatcagtttcccaaccttaaaaaaaagaaaaagaaaggaaagaaaaaacaggaatgagacgtgttggacacatcacaaatagctctctggtaatagaatatccattcatcaatccatttaactaatatatattaagaaccttctaagtactactcagatgccagagtacttgtggtagtcgtgatggtaatgaacccagagcgctactttcactttctgttcacaaggagcttatgatctagtgaaggggaagatggtaatagtgctgtacagtgctctaca

SEQ ID NO: 74798 - DNA, 601 bp, Human
ttgtaatggagatgaagagaagtggacagaattcaggagctcttttggaggttgtgtccacagaactttctgatacggcagaaacacgaagtgagggaaagggaaattaatgactcccaggcttcacccttgagcaactaggacaaatggtggcgcaattcactgagattgagatgactagtaaaactacaggaggaggacatttagggtgaagtaagaatcaaggattcttctttggatgtaaacaaatttaaaatgattattggatatcccggtgcagatgtgaaggccaggggagaaytctgggctggaaatataaatttggaagtgtctggatgaaatcaccaagtagtaagtaaagacagggaagaaaagagaagccctggatcaactctagaggagccaccccagcagttagaaattcagcttagcaggaagcatcagaaagagagagtggaaaggaacagctaaggaggtcagagaaaacaaaacaaaacaaaacaaaaacagaattgcacaccaccatcatcaaacttatgctttatcctgaccacagacatgttcgggcacgttcgagataaggaatcatataactttagtg

SEQ ID NO: 74799 - DNA, 601 bp, Human
gagaagtggacagaattcaggagctcttttggaggttgtgtccacagaactttctgatacggcagaaacacgaagtgagggaaagggaaattaatgactcccaggcttcacccttgagcaactaggacaaatggtggcgcaattcactgagattgagatgactagtaaaactacaggaggaggacatttagggtgaagtaagaatcaaggattcttctttggatgtaaacaaatttaaaatgattattggatatcccggtgcagatgtgaaggccaggggagaattctgggctggaaatayaaatttggaagtgtctggatgaaatcaccaagtagtaagtaaagacagggaagaaaagagaagccctggatcaactctagaggagccaccccagcagttagaaattcagcttagcaggaagcatcagaaagagagagtggaaaggaacagctaaggaggtcagagaaaacaaaacaaaacaaaacaaaaacagaattgcacaccaccatcatcaaacttatgctttatcctgaccacagacatgttcgggcacgttcgagataaggaatcatataactttagtgctaggagagcttttgg

SEQ ID NO: 74800 - DNA, 601 bp, Human
gaggagcctcatacccacttttgtgactttccgttcctctttggaatttggtcttagggacattggcttgattttcttaatcttactcatacaaacctttatagagattagaaatctttaaaacataatttggctatggacaagaaaaaaatcaaaatactttgaaatgttaagtatttgggggatagtaggctttttctctctgtctctctcaaatatggttatagatacatagaaatctgtaggctgccagtcagctagaaagaagctaataaaatgcttaaggtcttatacttttttwaaaaaaattattcatcctgtgaatcagagaatatttacttagcatttactatatgccacacactattcttggttctgagcatacagaaatgaacaaaactgacaaaaatgtcaaccctcattctaatggagaaaaggagatgataaacataaatataagaatgttaaatggtgataagtgtcatggagaaaagtgaaagaggaaaagaggataggaagtgctgtgggggatgggtgcaatttttgtgaggagtagagtaagtgtcactgtgaaggtgatgtttgagtcagagcctaaagg

SEQ ID NO: 74801 - DNA, 601 bp, Human
aaaaggagatgataaacataaatataagaatgttaaatggtgataagtgtcatggagaaaagtgaaagaggaaaagaggataggaagtgctgtgggggatgggtgcaatttttgtgaggagtagagtaagtgtcactgtgaaggtgatgtttgagtcagagcctaaaggagatgagggagtaaaccaaagagatcactgggatgagattctgtaggcagaaggaaccacaggtgcccagctatggaagcatagtgttcctggcaagttcaaggaaaagtcaggcaggcagtgtggctgcartggaacaaacaaggtagagagccatagatacagggcagagaggtagcaagggaacagaccgtgtagggtcattgaaaagacactttcctgtgagtgagatgattctccattgcatgctttaagcagaggcgcataacctaacgggtttcactgggtcactctggtgataatagattgttcagggcaaggataagagcaggaaggagccaattaggtaatatgaccatacatccctgttgccttagacaataccactttgcaactcttatggattatttaaaaggcagtaatcctctttag

SEQ ID NO: 74802 - DNA, 601 bp, Human
gatgtttgagtcagagcctaaaggagatgagggagtaaaccaaagagatcactgggatgagattctgtaggcagaaggaaccacaggtgcccagctatggaagcatagtgttcctggcaagttcaaggaaaagtcaggcaggcagtgtggctgcaatggaacaaacaaggtagagagccatagatacagggcagagaggtagcaagggaacagaccgtgtagggtcattgaaaagacactttcctgtgagtgagatgattctccattgcatgctttaagcagaggcgcataacctaacggktttcactgggtcactctggtgataatagattgttcagggcaaggataagagcaggaaggagccaattaggtaatatgaccatacatccctgttgccttagacaataccactttgcaactcttatggattatttaaaaggcagtaatcctctttaggatttggggcaaggcttttctgccccaaaagtgttcccgtgtggacatttttgataaattacatggtcaccttaaagtttagagaacactgagtctgtccagataagagattatacttgtttaggtcagactgggagccacagag

SEQ ID NO: 74803 - DNA, 601 bp, Human
gtgaacaaatctggtaagatgaggaatgagaattgaccactgatcttagcagcccagaagtcactggtgattttgagaagaggcatttgggtgccatggtgacgggaaaaaaaaatctaaaatgcacaggagctaaagaatagaagaatccaagaatttttggtagttttttgtttttattttgttttctttaagtgagtgaaaacagcttgtctgtagactaagcaaaatgatccaacaaaacagagaaaactgttgatgcagcatagttagaggtgagacttggtgtgatgtccttgaytggagcagaggagatggaacccggggatccagtggaaggattgggtctggatatatcttcaggaagacaatgacagacaaacagacagtatgggcattaatgggatagtgagcagagtgaagatcatgatagccgcttgtggatggtttcttctgattgacttcttgtaagataaacacatgcatgttctttaggtttgcagggggcaatacctgccatgctactcttctgatatatacctccatggccagcagccccatgcaagcattgttttctgatttaggttctcagtgacagcca

SEQ ID NO: 74804 - DNA, 601 bp, Human
gtagagatggggtttcaccattttggtcaggctggtcccgaactcctgacctcttgatctgcccgcaagtgcctcccatagtgctgggattacaggcgtgagccaccgcgcccggcccactttagcacttctctaaaggcatttctcctgcccatcataaggtactgcatattctgcaggtacatgattctctccaatgtattggaagaatctgaaggagggacacatagggcaatgactgtgaagtctggcattgacctaaatacacaagcaagtgcccactctggaaaagttggtcttstaagcaaaggaatttttctggaggcctggtcatccccacttatatgcaactgactgggaaactcactgattgggaggaaaacaggtgtaataaggacccttgattaggagtccagaggtgtggatcccagttcttgccctcacaaacaaattgtgttaccatagcaaagtaactcagaccctctgaattccagcttcctatctataaaatgagtctgggctagatgatcttttatgctccttcaacttttagaatttcgttccatacctgagttcagaataaaagcagcaagattaatga

SEQ ID NO: 74805 - DNA, 601 bp, Human
tgcccgcaagtgcctcccatagtgctgggattacaggcgtgagccaccgcgcccggcccactttagcacttctctaaaggcatttctcctgcccatcataaggtactgcatattctgcaggtacatgattctctccaatgtattggaagaatctgaaggagggacacatagggcaatgactgtgaagtctggcattgacctaaatacacaagcaagtgcccactctggaaaagttggtcttgtaagcaaaggaatttttctggaggcctggtcatccccacttatatgcaactgactgggwaactcactgattgggaggaaaacaggtgtaataaggacccttgattaggagtccagaggtgtggatcccagttcttgccctcacaaacaaattgtgttaccatagcaaagtaactcagaccctctgaattccagcttcctatctataaaatgagtctgggctagatgatcttttatgctccttcaacttttagaatttcgttccatacctgagttcagaataaaagcagcaagattaatgatgcaatgaaagtgctgatcttattctaagaattttgcaatatatgactcctaacaaaat

SEQ ID NO: 74806 - DNA, 601 bp, Human
caagtgcctcccatagtgctgggattacaggcgtgagccaccgcgcccggcccactttagcacttctctaaaggcatttctcctgcccatcataaggtactgcatattctgcaggtacatgattctctccaatgtattggaagaatctgaaggagggacacatagggcaatgactgtgaagtctggcattgacctaaatacacaagcaagtgcccactctggaaaagttggtcttgtaagcaaaggaatttttctggaggcctggtcatccccacttatatgcaactgactgggaaactcrctgattgggaggaaaacaggtgtaataaggacccttgattaggagtccagaggtgtggatcccagttcttgccctcacaaacaaattgtgttaccatagcaaagtaactcagaccctctgaattccagcttcctatctataaaatgagtctgggctagatgatcttttatgctccttcaacttttagaatttcgttccatacctgagttcagaataaaagcagcaagattaatgatgcaatgaaagtgctgatcttattctaagaattttgcaatatatgactcctaacaaaataaaaat

SEQ ID NO: 74807 - DNA, 601 bp, Human
taaatacacaagcaagtgcccactctggaaaagttggtcttgtaagcaaaggaatttttctggaggcctggtcatccccacttatatgcaactgactgggaaactcactgattgggaggaaaacaggtgtaataaggacccttgattaggagtccagaggtgtggatcccagttcttgccctcacaaacaaattgtgttaccatagcaaagtaactcagaccctctgaattccagcttcctatctataaaatgagtctgggctagatgatcttttatgctccttcaacttttagaatttcrttccatacctgagttcagaataaaagcagcaagattaatgatgcaatgaaagtgctgatcttattctaagaattttgcaatatatgactcctaacaaaataaaaatgctaagtaaaagcacatgctcctggaaccactgaaaaggaggtattcagatatttgttttgaaactaagtgaagagaatcagaagggtgagggggtgggaagtgggtggatgatgagaaattatttagtaggtacaatgtatgttatgtgggtaatgaataccctgaaagacctgatttcaccactatgcaatc

SEQ ID NO: 74808 - DNA, 601 bp, Human
ctcaggaggctgagtgggaggatcgcttgaatctgggaggtggagtttgcagtgagccaagatcatgccactgcactccagcctgggtgacagagcaagactccacctcaaaaaaaaaaatagtcacattctgaggtactaagggttagggtttcagcatatgaatttaggcggaggggatataattcatcccataacaaagatagaaagcaatcaaaatgcctttgatgtcattgtattccctatcatatgcaattgcctaattaatatttagccactatctactttaatcttgtgcttstgagaatggaaaacatgagtcatgtaaaccaggggtgtccagtcttttggcttttggcttccatgtgccacactggaagaagaattatcttgggccacacataaaatatgctaacactgatgaatcaaaaaaatttcactaaaaatatctcacaatgttttaagaaagtttatgaatttgtgttgggctgcattcaaagccattctgggcagcatgcggcctacgggccatgggttggacaagtttgatctaaaccatcttaggctgtggcactgagctggccttgacttctcatgagaa

SEQ ID NO: 74809 - DNA, 601 bp, Human
aagccattctgggcagcatgcggcctacgggccatgggttggacaagtttgatctaaaccatcttaggctgtggcactgagctggccttgacttctcatgagaagtgggaaccccctagccagtttttgccagaaatttccagacttctactctaggcaataagaagaaatgctctaactcagtactattcatttgaaacataataagggccacatgtataactttcaattttctagtagccacattaaaaattagtaaaaagaaacaggtaaaattgaattcgatatactttatgtaacmaaatatatccaaggtcatattgttccaacatataatcaatataaataattattaataagatattttattcttttctcacactaggtctttgacattctgtctgtattttacatttgcaacacctctcaatttggactagccacatttcaagtacgcaacagctacatgtggctagtggctgtgttggacaattcacattccgattcttacattttaaaacatttcctgggacagttgttgtcttgagtaggaaaatctaattataagcactcccaattcaattatactttcacttgtgaa

SEQ ID NO: 74810 - DNA, 601 bp, Human
tggttgttagatgtcccagacctttaggagattttcctgaggatcttatcacctagagccacattctcagccagaacaaaggaaaccctcactgcagtattcatgtcgtattccttggaccactgggagctcttgcagtaattcatgatagttcttgactttgcccctgaaattggataattttacctacataaaaacagaagagaacattaagatacaacctcagcgtgtctggtcttgcctggtgcttgaatcctcctcttttggttgatgaatcttgactcatgttttaaatcagccrataaataagattttttgagtacctataggtggctacttcaaatgaagacaaagtcatttataacacatgacccttgttcttaaagaatctaataggatctactagaatcaggccttcactcacatagattatataggaaataattaaaggcagtagaatgtcagagaagggataaatcattaagagaaagagtcaccaaatgagacttcaaggaggaggtaagactttttcttgaccttcgaatgagcagaataaagagcatactgattgaaggcaaacatgggctgacatagagcactg

SEQ ID NO: 74811 - DNA, 601 bp, Human
taatttaaaaatagattaaaggaggccgggggtggtggctcatgcctataatcccagctcccagcactttgggaggcagaggcaggcagatcacaaggtcaggagatcgagaccatcctggccaacatggtgaaaccctgtctctactaaaaatacaaaaaaattagctgggcatggtggcatgcgcctgtagtctcagctactcaggaggctgaggcaggagaattttttgaacccgggaggcagaggttgcagtgagccgagattgcaccaccactgcactccagcctggtgacagagygagactccacctcaaaaaaaaaaaaaaaaaaaaaaaagattaaaggaaaaggtaacgagtttttaaaagatatgctctctgggactgagaaataagggaagagcctcagaattgtgactgaggaacaattctgtagtgtgcatttttaaaaaagaaaagcctaggctcagcctaactaatcattcatctatgcccccaaacaacttcacacttggttctatagattcaagttccacatgagtcagaatccctaaaggacataatcctattagcaaaggcagttataaaggaagtgagaag

SEQ ID NO: 74812 - DNA, 601 bp, Human
ctgttatgtgaacctagcagcaaggtacaatatgtccaaataagcaatgtcagggggtctgagagcaggtaacagggaccccagcttaaaaccttgagttcaggcacagcactctgcatactgggggacctagagggaaagacaacatccaaaagacagggtcacaagcagaagaccaggagacattcaggaatggagaatgagacagcagatgactattagaattgaggaacaggcagggttttttggtctcaagagagcaatgccagtgactcaattactagaaataagtatgaaaagracagacaacacagcttcctttacgaatggatttatttattattaagataaaatgtctaagataaaaaatttatctaatgttttattaatcttctaatcccctcctatcaattcttttcttaaaaaattatattatcagccaggcacggtggctcacacctgtaatcccaatactttgggaggccaaagtgggtggattgctggagcccaggagtttgagaccaacttgagcaacatggcaaaactccatctctgcaaaaaatgcaaaaataagccaggtagtcccagttacttgggagtc

SEQ ID NO: 74813 - DNA, 601 bp, Human
tgagttcaggcacagcactctgcatactgggggacctagagggaaagacaacatccaaaagacagggtcacaagcagaagaccaggagacattcaggaatggagaatgagacagcagatgactattagaattgaggaacaggcagggttttttggtctcaagagagcaatgccagtgactcaattactagaaataagtatgaaaagaacagacaacacagcttcctttacgaatggatttatttattattaagataaaatgtctaagataaaaaatttatctaatgttttattaatcttcyaatcccctcctatcaattcttttcttaaaaaattatattatcagccaggcacggtggctcacacctgtaatcccaatactttgggaggccaaagtgggtggattgctggagcccaggagtttgagaccaacttgagcaacatggcaaaactccatctctgcaaaaaatgcaaaaataagccaggtagtcccagttacttgggagtcgaggcaggaggatcacttgagccagggaagatgaggcttcagtgagctgtgttcgcactactgcactccagcctgggtgacagagtgagacccc

SEQ ID NO: 74814 - DNA, 601 bp, Human
gcagggttttttggtctcaagagagcaatgccagtgactcaattactagaaataagtatgaaaagaacagacaacacagcttcctttacgaatggatttatttattattaagataaaatgtctaagataaaaaatttatctaatgttttattaatcttctaatcccctcctatcaattcttttcttaaaaaattatattatcagccaggcacggtggctcacacctgtaatcccaatactttgggaggccaaagtgggtggattgctggagcccaggagtttgagaccaacttgagcaacrtggcaaaactccatctctgcaaaaaatgcaaaaataagccaggtagtcccagttacttgggagtcgaggcaggaggatcacttgagccagggaagatgaggcttcagtgagctgtgttcgcactactgcactccagcctgggtgacagagtgagacccccgcctcaaaaaaaaaaaaaaatgatactatctgtttagctttatctttttaaattttgactaaattttcaagcagccatttttctgtctgaattgttccagatagtttccagagaaaggaagacaggttgttggctaaata

SEQ ID NO: 74815 - DNA, 601 bp, Human
tgccagtgactcaattactagaaataagtatgaaaagaacagacaacacagcttcctttacgaatggatttatttattattaagataaaatgtctaagataaaaaatttatctaatgttttattaatcttctaatcccctcctatcaattcttttcttaaaaaattatattatcagccaggcacggtggctcacacctgtaatcccaatactttgggaggccaaagtgggtggattgctggagcccaggagtttgagaccaacttgagcaacatggcaaaactccatctctgcaaaaaatkcaaaaataagccaggtagtcccagttacttgggagtcgaggcaggaggatcacttgagccagggaagatgaggcttcagtgagctgtgttcgcactactgcactccagcctgggtgacagagtgagacccccgcctcaaaaaaaaaaaaaaatgatactatctgtttagctttatctttttaaattttgactaaattttcaagcagccatttttctgtctgaattgttccagatagtttccagagaaaggaagacaggttgttggctaaataccaaactgcatctcatcattagaaggaa

SEQ ID NO: 74816 - DNA, 601 bp, Human
atctaatgttttattaatcttctaatcccctcctatcaattcttttcttaaaaaattatattatcagccaggcacggtggctcacacctgtaatcccaatactttgggaggccaaagtgggtggattgctggagcccaggagtttgagaccaacttgagcaacatggcaaaactccatctctgcaaaaaatgcaaaaataagccaggtagtcccagttacttgggagtcgaggcaggaggatcacttgagccagggaagatgaggcttcagtgagctgtgttcgcactactgcactccagyctgggtgacagagtgagacccccgcctcaaaaaaaaaaaaaaatgatactatctgtttagctttatctttttaaattttgactaaattttcaagcagccatttttctgtctgaattgttccagatagtttccagagaaaggaagacaggttgttggctaaataccaaactgcatctcatcattagaaggaagcacaccaaatttcatttttctccacctttattaagtgcagatttttgtttctcatccaggaagttctgtattatcagggcaatgctaacttcagtataaatgacacag

SEQ ID NO: 74817 - DNA, 601 bp, Human
aaattttttttaaaactttgtctttgctcagaaccagctccacccaaatcactcttcgcagtgaacaaaacccagacttcagtgactttgctgtgggtggaagagggagtagctgatttctttgaagttttctgtcaacaagttggctccagtcagaaaaccaaacttcaggtactgtaccttttgatctaccttttctcagttaacttaagtaaggctaattatctgggcaaaataagaatcttctatttctttgagctatataaaatgaaaactgtttatttgctcttttgtgtttcastgatagaaattaacagcaggcttagaccaagcccaaaagttgttatgagaacttttatctttgtctgtatcacttgttcctaattcataagtcactccaggtcagacaaaggaataaaggtagtaggccattgaattgatcaagggaagaaagaccctacaatataaaatataatttaacaaatatgaaccatttgccaagtatataaaggcactgaatagaacacacatgatagaatcaatatttgccttcaaaacatttttatatggtgtagacattgcataagtatagaaaaaagta

SEQ ID NO: 74818 - DNA, 601 bp, Human
gctaaggtaaaaaaattagcagaataatgtgtaggctaagccatcacttatgttttttaactgtgtcatatatgttcatacatccataaaatgcatatgggaagaaaaataatgcctgacaacatggaataatgctgcttccatgaaagggaattggtcagatggggaatggggaaaaaaggaaacatttttcaatgctattctttgtcatcttatacattttttactctgtcaatctattaccaactcaactatgaaatatatttttaaaaaatatagatgaagttaacctaaaatttaycttattttctgaaaccccaggaaccagttgctgtttcttcccatgtcgtgaccatctccagccttcttcctgccactgcctacaattgtagtgtcaccagctttagccatgacagccccagtgtccctacgttcatagccgtctcaacaatgggtaattatacacattagtgtataattttctcactttttttgaatatatatatatatatgtatttgtatcaatattccaccaagaaatcccaagcttcggagtcagagagtccttaatttcaatcccaaagtgcacttactagctatg

SEQ ID NO: 74819 - DNA, 601 bp, Human
ccaccaagaaatcccaagcttcggagtcagagagtccttaatttcaatcccaaagtgcacttactagctatggagttagagaaagacatttggtgcctctgagcttttctttcatctgtaaaattggaataataatatgtaactttctgagttgttttgaagcttagaaataaaatacttaaatccttagtatatgctgtctaaatgctagttgctaactcatctcatcttcttcagtaataggcacagtactcttatcaatccaatttcatctatttagccttggtcttcatctgtcacygatcagagaatgacataattgataactgggtcaaagcaagaaagtttccaatccagccaaaagtataagtgggaaaattagaggttaatgaaaggtctggaatgatgctgtttatttccttattcttttcttagttgtattacatgtgttactcctggtttgttagagtctgattctgcaacctgagaccctctatgaagcctcttgtaataaagtcactcataacttcactggtttagttccatttctgtaatattagtcatatatttagctgctaaattcagggatgactggagcgga

SEQ ID NO: 74820 - DNA, 601 bp, Human
caagagtgaaactccatctcaaaaaacaaataaacaaaaaaagagagttgaggctaactcctgggtttttggcccaagcacttgaaaggatggagctgccatcaactgagagaggattccaggtcagagttgggggaacatcaagacttcagttttggaaattgtattagtcagagttctctagagggtcaaaactaatagtacatagtagtatatatatatcctattagatattatatatagatatagtgtgtgtgtgtatatatatatatatctcctattatatattatacatagatayaggtatatgggagtttattaagtattaacttccacgatcacaaggccccacagtaggctgtctgcaagcttgaggagaaaggagagccagtctgaatctcaaaactgaagaacttggagtccaatgttgaagggcaggaagcgtccagcacaggagaaagatgtaggctgggaggcgaggccagtctctccttttcacatttttctgcctgctttatattcactggcagctggttagattgtgcccacccaattaagggtgggtctgcctttcccagcccactgactcatatgttaatct

SEQ ID NO: 74821 - DNA, 601 bp, Human
tacatagatataggtatatgggagtttattaagtattaacttccacgatcacaaggccccacagtaggctgtctgcaagcttgaggagaaaggagagccagtctgaatctcaaaactgaagaacttggagtccaatgttgaagggcaggaagcgtccagcacaggagaaagatgtaggctgggaggcgaggccagtctctccttttcacatttttctgcctgctttatattcactggcagctggttagattgtgcccacccaattaagggtgggtctgcctttcccagcccactgactcawatgttaatctcctttggcaacaccttcacagacacacccaggatcaatactttgtgtccttcaatccaatcaagttgaccctcagtattaaccatcacagaaatgttaagtttgagataacttgcaagtgcaggtgcagagtagccacctggacataaaagtctaatgtttgaaagagaatttttggttgaagatataaatttgagagttgttggttctgcacagtggctcatgcttgtaatcccggcactttgggaggcaggcagctcacttgaggtcaggagtttgagaccagcctgg

SEQ ID NO: 74822 - DNA, 601 bp, Human
aataggccacattccggacagtaggcacaccagaagcttgcctatttcaatacattccactcttttattctaatctccagtgatgaataatacgggcatcacaatataagagaaagattttggaggaagtaaacaatccacttgatccactatcattgtagggaggaaatcaaaatgccataaacaaaaccctacaaagaatttttgctaaagatggaaaatgctcagttcatctaggagagtttctatgttactattaaaggctttgtaaaaaaataaataaatattataccccaaatarttcaaatatttcttttagaatcatgaatgccctttggaaaggattgtgaagtgaattcttttggcctcaaataatttgatttgcaaacttgcaaaagattatttcttttcgttttagctttctgttttgcattgtatgccaaaagggaacatatggaacttctattagcttcttttattttgttttttttttttttctttttctttttgagacagagtcttgctctgtcacccaggctggagtgcggtggcgcgatctctgctcaccacaacctctgtctcccaggttcaagcaattatc

SEQ ID NO: 74823 - DNA, 601 bp, Human
cgcaggagcccatacctgtgctgaaaaagggcttaaatgcaggagcgccgctgaacaagtggtggctaaaggcacgagaagagattccaatgaagcagcttgcgacagatcggcttctccattttattttatattttattttattttattttttattgttttgtattttttgaggagacagaatctccctctttcgtcacccgggctggagtgcaggatgatctcaactcactgcaatctctgcctcctgggctcaagtaatctttccacctcagcctcccgagtagctgggactacaggmgcgcaccaccaaatctggctaatttttagatatttgtagagatgaggtctcactatattgcccaggctggtctcgaactcctgggctgaagtgatcctcccacctcggcctcccaaagtgctgggattacaggcctgagcccccatgccaacccagcatctccattttaaactcacatttcagtgcctgaggcaataagagccaccacttctgttaaaaagttgtacagcccagtattcagttctcatgcttacagataaataaatatcaaagccagtgaagtttcataagaaaacatgg

SEQ ID NO: 74824 - DNA, 601 bp, Human
tgatgttgttggcaagcgttttttcccatttagtactagttatttgtttcttcattgagtcaatccattggcctctcatctttgcaaataatgctttccattttccattatcatcttcatccattagagagctccaaatttccaagaaggtagaaatgcattaagatggagaaatcagagtctatacaatcctctgtatctgaggcctccttgtttttataataatgctaactcagtgactattaaacagctgactatacgcaagcctctttgtatgattatctgatttaattttcccccrcaatcctgcagagagtattactagtcccattttagaaatgtggaaataggggcttacggagatttactgtcttagtagcacattccactatgtacagaatccaggttccaaactcaggtctctctgaaatctattctttcctctgtaaagagcagactcctttaatttcttattttcttaacttctggatcattttaataatcaaatcttgaagtgttccttttgactttttaatatgtaatgataacagtaaccttgaattctgagactaaagaattaagaactctttcttttcctgtg

SEQ ID NO: 74825 - DNA, 601 bp, Human
caatccattggcctctcatctttgcaaataatgctttccattttccattatcatcttcatccattagagagctccaaatttccaagaaggtagaaatgcattaagatggagaaatcagagtctatacaatcctctgtatctgaggcctccttgtttttataataatgctaactcagtgactattaaacagctgactatacgcaagcctctttgtatgattatctgatttaattttcccccgcaatcctgcagagagtattactagtcccattttagaaatgtggaaataggggcttacggrgatttactgtcttagtagcacattccactatgtacagaatccaggttccaaactcaggtctctctgaaatctattctttcctctgtaaagagcagactcctttaatttcttattttcttaacttctggatcattttaataatcaaatcttgaagtgttccttttgactttttaatatgtaatgataacagtaaccttgaattctgagactaaagaattaagaactctttcttttcctgtgctataagataaaaggtagcagtttccaggggaactgacaagaaaatcattgtccttaaat

SEQ ID NO: 74826 - DNA, 601 bp, Human
aatcctctgtatctgaggcctccttgtttttataataatgctaactcagtgactattaaacagctgactatacgcaagcctctttgtatgattatctgatttaattttcccccgcaatcctgcagagagtattactagtcccattttagaaatgtggaaataggggcttacggagatttactgtcttagtagcacattccactatgtacagaatccaggttccaaactcaggtctctctgaaatctattctttcctctgtaaagagcagactcctttaatttcttattttcttaacttctrgatcattttaataatcaaatcttgaagtgttccttttgactttttaatatgtaatgataacagtaaccttgaattctgagactaaagaattaagaactctttcttttcctgtgctataagataaaaggtagcagtttccaggggaactgacaagaaaatcattgtccttaaatattaatacctagtgtttaggtactaaattatgtacagacagatccataaatgtggacaacttgaaaaggtctcagaagaaaacaataaaaatatctcatagactggaaaaaaaatagcttatggggt

SEQ ID NO: 74827 - DNA, 601 bp, Human
taaacagctgactatacgcaagcctctttgtatgattatctgatttaattttcccccgcaatcctgcagagagtattactagtcccattttagaaatgtggaaataggggcttacggagatttactgtcttagtagcacattccactatgtacagaatccaggttccaaactcaggtctctctgaaatctattctttcctctgtaaagagcagactcctttaatttcttattttcttaacttctggatcattttaataatcaaatcttgaagtgttccttttgactttttaatatgtaatrataacagtaaccttgaattctgagactaaagaattaagaactctttcttttcctgtgctataagataaaaggtagcagtttccaggggaactgacaagaaaatcattgtccttaaatattaatacctagtgtttaggtactaaattatgtacagacagatccataaatgtggacaacttgaaaaggtctcagaagaaaacaataaaaatatctcatagactggaaaaaaaatagcttatggggtggtggtgcgggtatgaaaagcaatctggagcatttatttattcaaaaagacaattg

SEQ ID NO: 74828 - DNA, 601 bp, Human
cattttagaaatgtggaaataggggcttacggagatttactgtcttagtagcacattccactatgtacagaatccaggttccaaactcaggtctctctgaaatctattctttcctctgtaaagagcagactcctttaatttcttattttcttaacttctggatcattttaataatcaaatcttgaagtgttccttttgactttttaatatgtaatgataacagtaaccttgaattctgagactaaagaattaagaactctttcttttcctgtgctataagataaaaggtagcagtttccargggaactgacaagaaaatcattgtccttaaatattaatacctagtgtttaggtactaaattatgtacagacagatccataaatgtggacaacttgaaaaggtctcagaagaaaacaataaaaatatctcatagactggaaaaaaaatagcttatggggtggtggtgcgggtatgaaaagcaatctggagcatttatttattcaaaaagacaattgaccaaatgttctccagctcctccaaggacagaataaatacagctggcagaatttaggatttcaagttgcactggaaggaacataa

SEQ ID NO: 74829 - DNA, 601 bp, Human
ctgagactttctcattttccacagtgcgtttttaagcttctgtaaggtaggcctgtgcaagtaagcatgtattccttaataggcctcattgatgaacatatgctcaaatttcagcaaccctcacaaggtctgctatttctaataccaatcaaatagcacgaggcccaacttatggggagaaaatacccttcagtaatttttagaagaatcaccttgaaactgtaaatggttgtctccagttgagaagagaaggtaaaacatagagctgcatgctttctgtaacttcagtaaatttcacacrtatcaactagtaaaaacatactggatataaactatgttctcagcccttttgtacaatgccagatacaaaagaagtgaaattcatgctccccgctcgtggaaatacagcttctactcacacaaccactccaattccctgtttgcttcatctaataacttgtggttattttcccctgctttcattggctaaagagtcatttttaatcctcctaatgatgtgtttgtcttcatatttcacctaccctgtgaacaacagctgcaaataacaagagccatctccccagacgcacactgcctaaca

SEQ ID NO: 74830 - DNA, 601 bp, Human
agaagatagcgtccttggacgaaaaggagagactgtcaaggcttgctcctcccatgactcaggcaaagaaaagaaggagaagcaagacccagacaaaagatagggtagagattaggagtggtagaacatacccacaagcaaaaaaaaactcacatcaattcggcttccaccttcccccctctcattttcctttgactcctctctccttctctagaagacatttcttgaaaggctttcctctcacctttttatttgccttctctaccatttctctttccctccaaatgccccaccactaccrtatccccctggttcccattttctatctccacttgtcttcattccatccttcctttccatcacctcctctttttctttttcctctgtagatatttgtccttttggtctctactcccttccagctttctttttcttctccttgtcattctccttctcccttatgtccattcttctgtttgctattccttcctctctctctcttttccctctgcttcttgcttttacttcttttaacccattaatactttgtctggtttgccttctgtatacatgtgcccattttcctagtaacaagatgaaa

SEQ ID NO: 74831 - DNA, 601 bp, Human
tctccaagaagattaagaagtatgatattaaacaatatataatacctatcaacaagaattttaaaatgtatgtatatttctttgtgtttggcaaagcccggttcaactggatgactttgatgcctatattaaggatatggccaaagactctgactataaattttctcttcagtttgaggtgagttggttaaggcattttctaccttctgtaatggaaagggcctgggaattggggggtttgtgttgcggtcatgtccctgctcactggcagtgcgtaacaaaaagggtattggcctggggrttgctgatctgctggtttagagcaagggttgtcaatccttgcttagtaggcaaggcctcaggtggcacaaatgagatgaggggaagaagagaataggtgcaggtactgaggtgagcaaacatgggtatagtagaagccatcattgaaaaccagggaaatcgagagtacaagaagaaaaatgcaagctgaggcatgaagcctgagacagaatttccctttcaggggatttgtagtgtttctcatgcttcttaggccacagtagtggcggatagtggataaaactgaccccctttgtgtcct

SEQ ID NO: 74832 - DNA, 601 bp, Human
ttgcttagtaggcaaggcctcaggtggcacaaatgagatgaggggaagaagagaataggtgcaggtactgaggtgagcaaacatgggtatagtagaagccatcattgaaaaccagggaaatcgagagtacaagaagaaaaatgcaagctgaggcatgaagcctgagacagaatttccctttcaggggatttgtagtgtttctcatgcttcttaggccacagtagtggcggatagtggataaaactgaccccctttgtgtcctgggcacataacatcctggagtagggcttttcaagctataggactcctggcattctacttaataacttttgtgcagttttattttctttccttggacaaattggggagataaagttacacatgatttgtgttaagaaaaaaattgacaacatctctttttttccgaaggacacatatttctttggatctaaaaccatatgtcagaagagatggaagtgagtgagtctaatatctcagcagtgtgggggaagataattagttctcactttttctttctacatattttatagctcataacacagtctaaatggccccccatccttcaggtttctatagcatg

SEQ ID NO: 74833 - DNA, 601 bp, Human
ccaaatacaaagaccgctaactaccacctgtgtcctgaaaaattccacacagagcctgctcacttatccattgtatccaggtgcataggatattatagatgctacaccaaatgctatactcaaagaaattcaatttgaattggaaatgaatgaggaggatggcatttcagaaagtatatcaaggaaaggaggactttttttctaagcaaacatgaggcaaaactctgaaaaaataaatagctagatgattctaacgatgatagaaattatggtatagctacacttttaccttattaaagcmacattttcttaattccttcaagatggcatgcccttggtggcacagctggatcataacctctgctggcaactcacagtttatgtcttgaaacccaagcataactattactgtttctgaattgcatgaaaaaaaattcaacaagtcattttccagtaaacatattcttttagttgtgagtgacaaaaacatagctcaaacttgtttaaactaaaggaaagggggtttattcaaaggatactaaggtatctcatacaatcaaagaaaaggttgagtagctagactacgtgcagggaagcagca

SEQ ID NO: 74834 - DNA, 601 bp, Human
ttcctaaaactatacaaacagtatagtatagtatatacttcctaaaactatacaaagagtagatatcaacatttgtaatcattgataatgtaatattacaaagaaattgctttctcatctgttaacgttaagctacatcatcttcatatagcactattagtcatttgtgttatttcattttcctctgtttcttttattttcatgtaccttataatcttcatcattttgttactgatttctaacagctgatttatgattaaagaggttaacattttgtgaagggctgaaaatgaaataccatttttttctcatttttttacattggggttttatttggagtttgtacagaagttgtgtatttaaaaaataatcatgttctgcttttttttaagtacattttctcatcaccttagtttctttatgtataaaatgggtgagttgaactagatcaatggttctcaactggacaagtaccagtcagcccccagatgaaatttgaaaatgtgtgggagtgtttttggttgttataatagcttaggaggaggatgctaacagtattttatggaagagggacgaggcgttaaatgctcttcaatgagtg

SEQ ID NO: 74835 - DNA, 601 bp, Human
atacaaacagtatagtatagtatatacttcctaaaactatacaaagagtagatatcaacatttgtaatcattgataatgtaatattacaaagaaattgctttctcatctgttaacgttaagctacatcatcttcatatagcactattagtcatttgtgttatttcattttcctctgtttcttttattttcatgtaccttataatcttcatcattttgttactgatttctaacagctgatttatgattaaagaggttaacattttgtgaagggctgaaaatgaaataccatttttttctcatttttttacattggggttttatttggagtttgtacagaagttgtgtatttaaaaaataatcatgttctgcttttttttaagtacattttctcatcaccttagtttctttatgtataaaatgggtgagttgaactagatcaatggttctcaactggacaagtaccagtcagcccccagatgaaatttgaaaatgtgtgggagtgtttttggttgttataatagcttaggaggaggatgctaacagtattttatggaagagggacgaggcgttaaatgctcttcaatgagtgggacattcccg

SEQ ID NO: 74836 - DNA, 601 bp, Human
aacgttaagctacatcatcttcatatagcactattagtcatttgtgttatttcattttcctctgtttcttttattttcatgtaccttataatcttcatcattttgttactgatttctaacagctgatttatgattaaagaggttaacattttgtgaagggctgaaaatgaaataccatttttttctcatttttttacattggggttttatttggagtttgtacagaagttgtgtatttaaaaaataatcatgttctgcttttttttaagtacattttctcatcaccttagtttctttatgwataaaatgggtgagttgaactagatcaatggttctcaactggacaagtaccagtcagcccccagatgaaatttgaaaatgtgtgggagtgtttttggttgttataatagcttaggaggaggatgctaacagtattttatggaagagggacgaggcgttaaatgctcttcaatgagtgggacattcccgcacaatagagaattgtcctaggccgaaagtgtttgattgagaaatatgggttaaatatgggatgaggctacaatcaagctttataacccatgtgtattagtcatgggttctc

SEQ ID NO: 74837 - DNA, 601 bp, Human
acgttaagctacatcatcttcatatagcactattagtcatttgtgttatttcattttcctctgtttcttttattttcatgtaccttataatcttcatcattttgttactgatttctaacagctgatttatgattaaagaggttaacattttgtgaagggctgaaaatgaaataccatttttttctcatttttttacattggggttttatttggagtttgtacagaagttgtgtatttaaaaaataatcatgttctgcttttttttaagtacattttctcatcaccttagtttctttatgtrtaaaatgggtgagttgaactagatcaatggttctcaactggacaagtaccagtcagcccccagatgaaatttgaaaatgtgtgggagtgtttttggttgttataatagcttaggaggaggatgctaacagtattttatggaagagggacgaggcgttaaatgctcttcaatgagtgggacattcccgcacaatagagaattgtcctaggccgaaagtgtttgattgagaaatatgggttaaatatgggatgaggctacaatcaagctttataacccatgtgtattagtcatgggttctcc

SEQ ID NO: 74838 - DNA, 601 bp, Human
ttgcagttttgagtttgaaggcaatggggaggcagaattcctccctccttgtaggacctgtctcttctcatcaggccttcaaactgactggatgaggcccagccacattacgtagcataatcagccttcctcaaactctacttacgtaaatgttaatcacatatgagaaaaacaccttcacagcagcagactggtgtttggccaagcaactggacactatagcctagtcaagttgacgtctaaaattaaccattacaccacgattttaaagtctttaatattgttatttattatgatgctytcttcatacatttctattcttagaacattattggtcatatatgtaattaattgggtggtaagtcctgacattatttacatattctggtaggaaaatacaacttactctctagggctctgttttaagtcacaggcttagactgtatgttttggactaacatttgctcaagcagtggcccactggtccaatttacttccttcttcatttgacagacttcagatattaccagtcctcagtcccattctgccccctacatcctcagggtcagcgtcagggtttcctcatcaattttcatagaag

SEQ ID NO: 74839 - DNA, 601 bp, Human
gactaacatttgctcaagcagtggcccactggtccaatttacttccttcttcatttgacagacttcagatattaccagtcctcagtcccattctgccccctacatcctcagggtcagcgtcagggtttcctcatcaattttcatagaagtagtgtgctcccatgcctgatttcaggatgtatgctggacctttcacatggcagccctcacatttttttgaaatacattgatagttaattgagacttaaggaaaaaaatgttcctaactctaatgagaattcaagagggtatgagatggccraatcaccttggtctagataattccagcagctgaacttgtacttgttctgtttatattaatgcctagtatttgtattcattttgatactgacattgaaatatcacattcacattgagaaatcacatcatttataagcattttgcaaattgaaactaatgtctggatttatagatactaccaatacagccataagtcatacatgaagctatatgagttactaatttgtgtttactgaataaatttcttttttactctgaatctgattttaaatctgctagaaagattgattatccttctgat

SEQ ID NO: 74840 - DNA, 601 bp, Human
actggtccaatttacttccttcttcatttgacagacttcagatattaccagtcctcagtcccattctgccccctacatcctcagggtcagcgtcagggtttcctcatcaattttcatagaagtagtgtgctcccatgcctgatttcaggatgtatgctggacctttcacatggcagccctcacatttttttgaaatacattgatagttaattgagacttaaggaaaaaaatgttcctaactctaatgagaattcaagagggtatgagatggccaaatcaccttggtctagataattccagyagctgaacttgtacttgttctgtttatattaatgcctagtatttgtattcattttgatactgacattgaaatatcacattcacattgagaaatcacatcatttataagcattttgcaaattgaaactaatgtctggatttatagatactaccaatacagccataagtcatacatgaagctatatgagttactaatttgtgtttactgaataaatttcttttttactctgaatctgattttaaatctgctagaaagattgattatccttctgataaaaatatacaccgttcctttaaaagt

SEQ ID NO: 74841 - DNA, 601 bp, Human
cccattctgccccctacatcctcagggtcagcgtcagggtttcctcatcaattttcatagaagtagtgtgctcccatgcctgatttcaggatgtatgctggacctttcacatggcagccctcacatttttttgaaatacattgatagttaattgagacttaaggaaaaaaatgttcctaactctaatgagaattcaagagggtatgagatggccaaatcaccttggtctagataattccagcagctgaacttgtacttgttctgtttatattaatgcctagtatttgtattcattttgatrctgacattgaaatatcacattcacattgagaaatcacatcatttataagcattttgcaaattgaaactaatgtctggatttatagatactaccaatacagccataagtcatacatgaagctatatgagttactaatttgtgtttactgaataaatttcttttttactctgaatctgattttaaatctgctagaaagattgattatccttctgataaaaatatacaccgttcctttaaaagtcttgggacccagggattaaaataggttcctcattttttacatttcacatgggaaagatt

SEQ ID NO: 74842 - DNA, 601 bp, Human
tggtagtagcttttacttgctatagatggaacctcttctgtcaacaccactggcactttctttctcctcactttttccaccccttatggacacgtaatctagtaatcttagtattgtttgaataaaccccctttcctttagtctaaactagtttgagctatgtttttgtcactcacaactaaaataatgtgtttactggaaaatgacttgttggattttttgtaatcatgcgattcagaaacagtaatagttatgcttgggtttcaagacataatgtccaccctatcccaaagcaaacacygaaagcaaactctcacctgctgacattgttacaaaccctaagaccagaatgcagattgtgctctcctcagaagatgatattgcaggttatgggctgaatatctgtggccccccaaaattcctatgtttaatccctaacccccaatgcaatggtatttggagatggagcccttgctaagtaattaggattagataagctcatgagggtgaggacttcgtggtaggattgttgcaggacttttccttagttcagctaaagatgaggtccttgtccatcccacagccatgaaaatttaggttc

SEQ ID NO: 74843 - DNA, 601 bp, Human
ttttgtaatcatgcgattcagaaacagtaatagttatgcttgggtttcaagacataatgtccaccctatcccaaagcaaacaccgaaagcaaactctcacctgctgacattgttacaaaccctaagaccagaatgcagattgtgctctcctcagaagatgatattgcaggttatgggctgaatatctgtggccccccaaaattcctatgtttaatccctaacccccaatgcaatggtatttggagatggagcccttgctaagtaattaggattagataagctcatgagggtgaggacttcrtggtaggattgttgcaggacttttccttagttcagctaaagatgaggtccttgtccatcccacagccatgaaaatttaggttcacaggcaatttggagggtgagtaaaacagggttttattcggtgaaaaggaagaaaagggagaaacagggactctcactaggctggagtccctgctagagcacttcccactggcagcttgaatctcaggttccacacaggaagaggaaaggccaggttccttccccactgcaaacatggtgaacttcccgaggctccacctctgtgagcaggctagtt

SEQ ID NO: 74844 - DNA, 601 bp, Human
taagaccagaatgcagattgtgctctcctcagaagatgatattgcaggttatgggctgaatatctgtggccccccaaaattcctatgtttaatccctaacccccaatgcaatggtatttggagatggagcccttgctaagtaattaggattagataagctcatgagggtgaggacttcgtggtaggattgttgcaggacttttccttagttcagctaaagatgaggtccttgtccatcccacagccatgaaaatttaggttcacaggcaatttggagggtgagtaaaacagggttttattmggtgaaaaggaagaaaagggagaaacagggactctcactaggctggagtccctgctagagcacttcccactggcagcttgaatctcaggttccacacaggaagaggaaaggccaggttccttccccactgcaaacatggtgaacttcccgaggctccacctctgtgagcaggctagttggaatttctccaaggaccccctcccacctgactgtctcaggatcagccaagataagatgcctaagaatgaaatctaccttgttgccatcttgatcttggacttcccagcctccagaactgtg

SEQ ID NO: 74845 - DNA, 601 bp, Human
gtttcaggtccatcactccatagtttgtcttcataaagatttaagccagtggaatttccatatggttggaaagaaaataacttcaaagctgctgaactggaaacttaatattttattttccacttagtgacaggctaaattacaaaggcttcaaagcatactgtgtttacatgcagttcccactttgctgcaattcaactttggcaacttccacttacagtgttcagccaattaaacctctcttatcaacttagagtatttacagcaggaaggcaacacacaattaaagttctgtcagttmgtcagcttccacaattaaagttctgtcagttagtcagcttccacatgtgctcaaacgctcagcctcaatctgtttccaccattccttttgtatctgaggccttttcccatggcttatcagtctgtccccaaagcaagagaattgggggaagagttgttggtctgctggcataaatggcagaggaggaagaaattatggagccaggcaaagcaaaacaaagaatcatcacaaaagtattttacaatgatcatcaatagtgctgtattagtatttgttgagttaaattattccatttgataa

SEQ ID NO: 74846 - DNA, 601 bp, Human
tgaaacagatatccctattcaatcctagaacgtggtcaagtggctccaattctcttcaacagtgttaaaagaccctccgaaattcttctcctagggaagtattcctccagctttgattccttgaagtaataattgggaggaattatgaagagtaaaacttgtgctcaatattaacattctataaatgtaaataaaatttataacaagtgatttttgcctcgcttagtagtcttatagaaagatgcacactatgtgggtaatcccacttatacacagttatgtacactgtttactaacattyctctaacatttgtataggaatataactagatccactgcattggttgcacattgtacaactccagtgaacaccgttcatatagaccacaatgtgaatgatgcctccaagaaatacaggtggcctgaccgtaatccccgtttcctgtaagacacatggcatagcaacttagaaatccccctttccccataacataccctttttgaagtgtgacagttatttatataaaaatttcccatcagttcaccttctgaaatgaggtttataagagtaccaatatacgcaggcagacatttggatgtt

SEQ ID NO: 74847 - DNA, 601 bp, Human
gctttgattccttgaagtaataattgggaggaattatgaagagtaaaacttgtgctcaatattaacattctataaatgtaaataaaatttataacaagtgatttttgcctcgcttagtagtcttatagaaagatgcacactatgtgggtaatcccacttatacacagttatgtacactgtttactaacattcctctaacatttgtataggaatataactagatccactgcattggttgcacattgtacaactccagtgaacaccgttcatatagaccacaatgtgaatgatgcctccaagaaatacaggtggcctgaccgtaatccccgtttcctgtaagacacatggcatagcaacttagaaatccccctttccccataacataccctttttgaagtgtgacagttatttatataaaaatttcccatcagttcaccttctgaaatgaggtttataagagtaccaatatacgcaggcagacatttggatgttcttattctcactgaaggattttccccaacaactacagatccatctttatgtttgaggtttcattaccagatatttagtgactgttaatcccatactttgtaacatggag

SEQ ID NO: 74848 - DNA, 601 bp, Human
tttataacaagtgatttttgcctcgcttagtagtcttatagaaagatgcacactatgtgggtaatcccacttatacacagttatgtacactgtttactaacattcctctaacatttgtataggaatataactagatccactgcattggttgcacattgtacaactccagtgaacaccgttcatatagaccacaatgtgaatgatgcctccaagaaatacaggtggcctgaccgtaatccccgtttcctgtaagacacatggcatagcaacttagaaatccccctttccccataacataccmtttttgaagtgtgacagttatttatataaaaatttcccatcagttcaccttctgaaatgaggtttataagagtaccaatatacgcaggcagacatttggatgttcttattctcactgaaggattttccccaacaactacagatccatctttatgtttgaggtttcattaccagatatttagtgactgttaatcccatactttgtaacatggagattgttccctactcattcctcactattttttactactttctctaaggctcattgcctacaagaaaaaaaaagcctagatttcttcag

SEQ ID NO: 74849 - DNA, 601 bp, Human
gaaatgcatttttattttcaaatatttcataccctgagtgttatacatatagttcttacttctccaaatgaccactaagttatccaaggtatttatgtgttgtattagatagctattaccacaataatgctgtataagaaacaacctcaaaatctctacaataacatttacttttctcactcatgggtctgtggaacagctggggcagttctgcttcaggctgtgggtcagagtcaggtctgccctatgtgcctcctcattctcggactagcagcttccctgggcatgtctttttcagggyagatggcaggcacacaagagggcaaaccaaacaagcaagtgcattgaaagcttctgagtggacttgatttctatctaagatcattggccaaagcaagttgatgatagtggggtggagtaccttccacctctaaagggagctactgcaatgtcatatagcaaagggcttgtgagcaataaaccagtgtgaacaataatccaattcacaccacgtatggaactctcaaatccattctctgtcctttacaggagttgaaattgattggactggatatcccacactttgctgcagatcttccac

SEQ ID NO: 74850 - DNA, 601 bp, Human
agttctgcttcaggctgtgggtcagagtcaggtctgccctatgtgcctcctcattctcggactagcagcttccctgggcatgtctttttcagggtagatggcaggcacacaagagggcaaaccaaacaagcaagtgcattgaaagcttctgagtggacttgatttctatctaagatcattggccaaagcaagttgatgatagtggggtggagtaccttccacctctaaagggagctactgcaatgtcatatagcaaagggcttgtgagcaataaaccagtgtgaacaataatccaattcayaccacgtatggaactctcaaatccattctctgtcctttacaggagttgaaattgattggactggatatcccacactttgctgcagatcttccactgaatcgatgtaaaaaccgttacacaaacatcctaccatgtaagatcgtcaattgtgccaataacactcatgtcttaagggttgaaggactgtcattgcagattaatcaatttcaccaatctctggccatacccacttgtggtccggatctcaaggccacgtctgagattgcattgatctcactctcctttgatgtctttagatct

SEQ ID NO: 74851 - DNA, 601 bp, Human
caaaccaaagttgaagaatagctaaaatatcaggctaaaaattattatctgcctactctgtcactgactgatttaacttaatattggatagaaagggccaaaataatttttccttccatcttgaattttaatatttttttctccttattctctacagatgacttcagccgtgtgagattagtctccatgaatgaagaggaaggtgcagactacatcaatgccaactatattcctgtaagtagaaaaaaaaaatcaggcatcccaaagctaaccagccagagaaagactagcagggctatawggatgtgtcaaacagttcaaaagagagcctttcccaacccagcaattgaattctaaaaagtttgcattactccgtttcataataaagaatagaaagaaaaagtccatagattactaatgtttctatttctttataaaggtccagtgaaagggaaagtagaaaggttaaagatcacctctcttatgtttaaatttcacattcagcaaccaaattcaaagggttccaccctagcacctgcacttttaaaatataaagacagttattattgtcataaaaaggtgtggatgtgatttttacagc

SEQ ID NO: 74852 - DNA, 601 bp, Human
ctacaccaccaccaccagggaagtgctgggagaccaacccaatgagcactttgagctttgcattgctgcttccttcaagaggaaaaatccattctcagtgtcattgtttcccatttcatcagtgatggtgtggatgatatggttggtctggagaggctgagaagacgcagtaaaaagtctgcactagttcatctcgaattagctcaagatcatagaagacactattaatcattgtttatgaggcatcattgaggacagaagtgttctcattacttatattaatcatatatgagtataattrgggtatataaggcacacttatgttttaaattaaataattaaaccctgatttagtagtttgggttttgttttgttttttttcttgttttgttctggtttggttttcattatttgtaaggtacttctaggtcttattatcataattccctatctctcttgaagggctattgatttctgatggataacacatccaaaaaaaatgtctgtttttctcacaaggcctgacacctttctgctgacaagtctctgagcaaacgctgaatatttctgtgacaggcttaggtgttaacatcaattgaag

SEQ ID NO: 74853 - DNA, 601 bp, Human
tttcccatttcatcagtgatggtgtggatgatatggttggtctggagaggctgagaagacgcagtaaaaagtctgcactagttcatctcgaattagctcaagatcatagaagacactattaatcattgtttatgaggcatcattgaggacagaagtgttctcattacttatattaatcatatatgagtataattggggtatataaggcacacttatgttttaaattaaataattaaaccctgatttagtagtttgggttttgttttgttttttttcttgttttgttctggtttggttttcrttatttgtaaggtacttctaggtcttattatcataattccctatctctcttgaagggctattgatttctgatggataacacatccaaaaaaaatgtctgtttttctcacaaggcctgacacctttctgctgacaagtctctgagcaaacgctgaatatttctgtgacaggcttaggtgttaacatcaattgaagtcatgccattgacctcagcctatagaatatacagtttttactattaatagtcttctccacttgaacatgctgtctatgaagacaaaattgaataggaaagttctca

SEQ ID NO: 74854 - DNA, 601 bp, Human
agacaactgagtatggtggttcatgcctgtaatcccagcactttgagaggctgaggcgagcagatcacttaagcccaggatttcaagattgcctgagcaacacagggagatcccatctgactaaaaattcaaaaattagctggtgtagtggtacacacctgtagtcccagctactcaagaggctgaggtgggggaatcacttgagcccagtaggtggaggttgcagtgagccaagattgtgccactacacttcagcctgggcaacaagagcaagactctatctccacacacacacacacamaaaaaaaaaatcaacaagaaaaatagtattttatgtgaaatgctatatgtaaattatgtgaaattcaaatttcaatgtccatatataacattttattagaacacagcctgcattgttgacgaattgtctatgactgcttttgtgctacatcaagcttgagtagctgcaaccaaaactatatgatctgcaaaaactaaaatatttactaactgtctctttgcagaaaatgtttgctgacccttaaaataggcaatggaaacaaagattgcccgtatcaatacaacgttagaacttgatact

SEQ ID NO: 74855 - DNA, 601 bp, Human
aaagattgcccgtatcaatacaacgttagaacttgatactacctactgattgatctctacaggagataaatcacttcttagccattgttaattgccacttgttaactggcagttaacaatgtcttttatgaccaggagaattcaggcaaatccccgtatgactctaacaggctgtgtttcgtgttgtttcggtcatttaaaattcacattgcttccttgttaagcacgtttttactcaaatgcagagtttcagcttaagtgtcaccccctttgtggcgtcttctctgggcttggacaccgytagcccattccttctctggggcagagtcttaagtaagctgctttatcacagcacaccatagatagttacaattctcgcttcttgtgtctgcctccccagtatactgtgagtttcagaagcaagtgctgtatccctgtggaatgaataaatcagtgaatgaatgagttatttcaaaaataataaggcacttgtaaagcatcaatagactttccgtcagagaaaatatttgtcaatccaaatgccatttgaactctgttttttgttcttagatatttcaattgaaaagccagtgcaaactga

SEQ ID NO: 74856 - DNA, 601 bp, Human
tgctgtatccctgtggaatgaataaatcagtgaatgaatgagttatttcaaaaataataaggcacttgtaaagcatcaatagactttccgtcagagaaaatatttgtcaatccaaatgccatttgaactctgttttttgttcttagatatttcaattgaaaagccagtgcaaactgataaccaaatacagtacaaatctgtccctaggtttgcacgtagtagaaaaaatttcagagcacaaaatagggtctgttccattgcctattctgttgacaaagaagagtcacatagattattgctkggtcagtactatgcttcttgtccttggtcttaagtgatgacctatctttcaatgacaatcatgtgaaggacttgaaaaataggaataaaacattgaacagtagtgtttgtttgtaaggaatttacttgttacaagcgtctggtaccagagtgcccccttttggccataagcataatgaatctaaatgttaagctacaatgaaggctaagttgcccaaagaacattgtgctatgctaattaatatatttttcaatttgtttcattttttgtttatacccttctttatccattccatattga

SEQ ID NO: 74857 - DNA, 601 bp, Human
atcaactgcattttctattaaatattaggagttggttttgtaaggggaacagctcaccattccataagcccttatcaggtttagttgaaaattaaataaactctgatgttttttaaactatgattaattgatgtctcactatatacaatgtttattctggctttcctgtatctataccctataaaatagatgttattattccaatttttaaatgaaaaaaatagagaagggtagagatgttaagggattcacacaagttcatgcaactagaacatggaggagttagtattcaaatccaggmatgccaatctgcaaagatcatgcccttaatatgtgatattatcctactccatcaaggattctgggtagttacaacatggacaaatacaaggtcaaattatagaaagctgatcacagcttgacataatataaataggcataaaaactagaaaaggaaaagaaaaatgaaaatattcagcttaggaagataaacatatttgctatgattcctcttcgggattgtctcttaaattgtcagacagtagaatgaaaaaggatataggatataaaaaaatcaaggtccacactaattcccaacagg

SEQ ID NO: 74858 - DNA, 601 bp, Human
taattcccaacaggaaaagttatcattaaatttaatttgttcttcctactgtatgaacagagctccatcaaaatctatctctgtgatacaatattgctgtaaaatccttatgcaacctcaaaagaacaggggacataaacgtgctccaatggcaagtgagaggtggcagtgggatgaagatgtgaagggaagcattggcagccatgccaacctaagcaaataaatctacaatcccagacctactgccttggcccttgtgaattagaatgactagaatgaagaagtatatgtgtgcattcaygtgtgtttgtgtggagtgtgtgtctccctggaaaggaaaatgcttcataagctactaagtttctgtttagggcagatattgttgctgtcaatccactgtaggcattcacaggttaaaagatgtgctttagcaggtaagattatctgttctcaaaatggttcttttcaagaacagaaaatgaagctcttcaactctggggtcaaactcacagattcctttcatggaagatagtaagtgcagttctggatatgactttacaggtgctcacccaatggcagatcattttatctgagaaatcct

SEQ ID NO: 74859 - DNA, 601 bp, Human; identical to SEQ ID NO: 74660

SEQ ID NO: 74860 - DNA, 601 bp, Human; identical to SEQ ID NO: 74661

SEQ ID NO: 74861 - DNA, 601 bp, Human; identical to SEQ ID NO: 74662

SEQ ID NO: 74862 - DNA, 601 bp, Human; identical to SEQ ID NO: 74663

SEQ ID NO: 74863 - DNA, 601 bp, Human; identical to SEQ ID NO: 74664

SEQ ID NO: 74864 - DNA, 601 bp, Human; identical to SEQ ID NO: 74665

SEQ ID NO: 74865 - DNA, 601 bp, Human; identical to SEQ ID NO: 74666

SEQ ID NO: 74866 - DNA, 601 bp, Human; identical to SEQ ID NO: 74667

SEQ ID NO: 74867 - DNA, 601 bp, Human; identical to SEQ ID NO: 74668

SEQ ID NO: 74868 - DNA, 601 bp, Human; identical to SEQ ID NO: 74669

SEQ ID NO: 74869 - DNA, 601 bp, Human; identical to SEQ ID NO: 74670

SEQ ID NO: 74870 - DNA, 601 bp, Human; identical to SEQ ID NO: 74671

SEQ ID NO: 74871 - DNA, 601 bp, Human; identical to SEQ ID NO: 74672

SEQ ID NO: 74872 - DNA, 601 bp, Human; identical to SEQ ID NO: 74673

SEQ ID NO: 74873 - DNA, 601 bp, Human; identical to SEQ ID NO: 74674

SEQ ID NO: 74874 - DNA, 601 bp, Human; identical to SEQ ID NO: 74675

SEQ ID NO: 74875 - DNA, 601 bp, Human; identical to SEQ ID NO: 74676

SEQ ID NO: 74876 - DNA, 601 bp, Human; identical to SEQ ID NO: 74677

SEQ ID NO: 74877 - DNA, 601 bp, Human; identical to SEQ ID NO: 74678

SEQ ID NO: 74878 - DNA, 601 bp, Human; identical to SEQ ID NO: 74679

SEQ ID NO: 74879 - DNA, 601 bp, Human; identical to SEQ ID NO: 74680

SEQ ID NO: 74880 - DNA, 601 bp, Human; identical to SEQ ID NO: 74681

SEQ ID NO: 74881 - DNA, 601 bp, Human; identical to SEQ ID NO: 74682

SEQ ID NO: 74882 - DNA, 601 bp, Human; identical to SEQ ID NO: 74683

SEQ ID NO: 74883 - DNA, 601 bp, Human; identical to SEQ ID NO: 74684

SEQ ID NO: 74884 - DNA, 601 bp, Human; identical to SEQ ID NO: 74685

SEQ ID NO: 74885 - DNA, 601 bp, Human; identical to SEQ ID NO: 74686

SEQ ID NO: 74886 - DNA, 601 bp, Human; identical to SEQ ID NO: 74687

SEQ ID NO: 74887 - DNA, 601 bp, Human; identical to SEQ ID NO: 74688

SEQ ID NO: 74888 - DNA, 601 bp, Human; identical to SEQ ID NO: 74689

SEQ ID NO: 74889 - DNA, 601 bp, Human; identical to SEQ ID NO: 74690

SEQ ID NO: 74890 - DNA, 601 bp, Human; identical to SEQ ID NO: 74691

SEQ ID NO: 74891 - DNA, 601 bp, Human; identical to SEQ ID NO: 74692

SEQ ID NO: 74892 - DNA, 601 bp, Human; identical to SEQ ID NO: 74693

SEQ ID NO: 74893 - DNA, 601 bp, Human; identical to SEQ ID NO: 74694

SEQ ID NO: 74894 - DNA, 601 bp, Human; identical to SEQ ID NO: 74695

SEQ ID NO: 74895 - DNA, 601 bp, Human; identical to SEQ ID NO: 74696

SEQ ID NO: 74896 - DNA, 601 bp, Human; identical to SEQ ID NO: 74697

SEQ ID NO: 74897 - DNA, 601 bp, Human; identical to SEQ ID NO: 74698

SEQ ID NO: 74898 - DNA, 601 bp, Human; identical to SEQ ID NO: 74699

SEQ ID NO: 74899 - DNA, 601 bp, Human; identical to SEQ ID NO: 74700

SEQ ID NO: 74900 - DNA, 601 bp, Human; identical to SEQ ID NO: 74701

SEQ ID NO: 74901 - DNA, 601 bp, Human; identical to SEQ ID NO: 74702

SEQ ID NO: 74902 - DNA, 601 bp, Human; identical to SEQ ID NO: 74703

SEQ ID NO: 74903 - DNA, 601 bp, Human; identical to SEQ ID NO: 74704

SEQ ID NO: 74904 - DNA, 601 bp, Human; identical to SEQ ID NO: 74705

SEQ ID NO: 74905 - DNA, 601 bp, Human; identical to SEQ ID NO: 74706

SEQ ID NO: 74906 - DNA, 601 bp, Human; identical to SEQ ID NO: 74707

SEQ ID NO: 74907 - DNA, 601 bp, Human; identical to SEQ ID NO: 74708

SEQ ID NO: 74908 - DNA, 601 bp, Human; identical to SEQ ID NO: 74709

SEQ ID NO: 74909 - DNA, 601 bp, Human; identical to SEQ ID NO: 74710

SEQ ID NO: 74910 - DNA, 601 bp, Human; identical to SEQ ID NO: 74711

SEQ ID NO: 74911 - DNA, 601 bp, Human; identical to SEQ ID NO: 74712

SEQ ID NO: 74912 - DNA, 601 bp, Human; identical to SEQ ID NO: 74713

SEQ ID NO: 74913 - DNA, 601 bp, Human; identical to SEQ ID NO: 74714

SEQ ID NO: 74914 - DNA, 601 bp, Human; identical to SEQ ID NO: 74715

SEQ ID NO: 74915 - DNA, 601 bp, Human; identical to SEQ ID NO: 74716

SEQ ID NO: 74916 - DNA, 601 bp, Human; identical to SEQ ID NO: 74717

SEQ ID NO: 74917 - DNA, 601 bp, Human; identical to SEQ ID NO: 74718

SEQ ID NO: 74918 - DNA, 601 bp, Human; identical to SEQ ID NO: 74719

SEQ ID NO: 74919 - DNA, 601 bp, Human; identical to SEQ ID NO: 74720

SEQ ID NO: 74920 - DNA, 601 bp, Human; identical to SEQ ID NO: 74721

SEQ ID NO: 74921 - DNA, 601 bp, Human; identical to SEQ ID NO: 74722

SEQ ID NO: 74922 - DNA, 601 bp, Human; identical to SEQ ID NO: 74723

SEQ ID NO: 74923 - DNA, 601 bp, Human; identical to SEQ ID NO: 74724

SEQ ID NO: 74924 - DNA, 601 bp, Human; identical to SEQ ID NO: 74725

SEQ ID NO: 74925 - DNA, 601 bp, Human; identical to SEQ ID NO: 74726

SEQ ID NO: 74926 - DNA, 601 bp, Human; identical to SEQ ID NO: 74727

SEQ ID NO: 74927 - DNA, 601 bp, Human; identical to SEQ ID NO: 74728

SEQ ID NO: 74928 - DNA, 601 bp, Human; identical to SEQ ID NO: 74729

SEQ ID NO: 74929 - DNA, 601 bp, Human; identical to SEQ ID NO: 74730

SEQ ID NO: 74930 - DNA, 601 bp, Human; identical to SEQ ID NO: 74731

SEQ ID NO: 74931 - DNA, 601 bp, Human; identical to SEQ ID NO: 74732

SEQ ID NO: 74932 - DNA, 601 bp, Human; identical to SEQ ID NO: 74733

SEQ ID NO: 74933 - DNA, 601 bp, Human; identical to SEQ ID NO: 74734

SEQ ID NO: 74934 - DNA, 601 bp, Human; identical to SEQ ID NO: 74735

SEQ ID NO: 74935 - DNA, 601 bp, Human; identical to SEQ ID NO: 74736

SEQ ID NO: 74936 - DNA, 601 bp, Human; identical to SEQ ID NO: 74737

SEQ ID NO: 74937 - DNA, 601 bp, Human; identical to SEQ ID NO: 74738

SEQ ID NO: 74938 - DNA, 601 bp, Human; identical to SEQ ID NO: 74739

SEQ ID NO: 74939 - DNA, 601 bp, Human; identical to SEQ ID NO: 74740

SEQ ID NO: 74940 - DNA, 601 bp, Human; identical to SEQ ID NO: 74741

SEQ ID NO: 74941 - DNA, 601 bp, Human; identical to SEQ ID NO: 74742

SEQ ID NO: 74942 - DNA, 601 bp, Human; identical to SEQ ID NO: 74743

SEQ ID NO: 74943 - DNA, 601 bp, Human; identical to SEQ ID NO: 74744

SEQ ID NO: 74944 - DNA, 601 bp, Human; identical to SEQ ID NO: 74745

SEQ ID NO: 74945 - DNA, 601 bp, Human; identical to SEQ ID NO: 74746

SEQ ID NO: 74946 - DNA, 601 bp, Human; identical to SEQ ID NO: 74747

SEQ ID NO: 74947 - DNA, 601 bp, Human; identical to SEQ ID NO: 74748

SEQ ID NO: 74948 - DNA, 601 bp, Human; identical to SEQ ID NO: 74749

SEQ ID NO: 74949 - DNA, 601 bp, Human; identical to SEQ ID NO: 74750

SEQ ID NO: 74950 - DNA, 601 bp, Human; identical to SEQ ID NO: 74751

SEQ ID NO: 74951 - DNA, 601 bp, Human; identical to SEQ ID NO: 74752

SEQ ID NO: 74952 - DNA, 601 bp, Human; identical to SEQ ID NO: 74753

SEQ ID NO: 74953 - DNA, 601 bp, Human; identical to SEQ ID NO: 74754

SEQ ID NO: 74954 - DNA, 601 bp, Human; identical to SEQ ID NO: 74755

SEQ ID NO: 74955 - DNA, 601 bp, Human; identical to SEQ ID NO: 74756

SEQ ID NO: 74956 - DNA, 601 bp, Human; identical to SEQ ID NO: 74757

SEQ ID NO: 74957 - DNA, 601 bp, Human; identical to SEQ ID NO: 74758

SEQ ID NO: 74958 - DNA, 601 bp, Human; identical to SEQ ID NO: 74759

SEQ ID NO: 74959 - DNA, 601 bp, Human; identical to SEQ ID NO: 74760

SEQ ID NO: 74960 - DNA, 601 bp, Human; identical to SEQ ID NO: 74761

SEQ ID NO: 74961 - DNA, 601 bp, Human; identical to SEQ ID NO: 74762

SEQ ID NO: 74962 - DNA, 601 bp, Human; identical to SEQ ID NO: 74763

SEQ ID NO: 74963 - DNA, 601 bp, Human; identical to SEQ ID NO: 74764

SEQ ID NO: 74964 - DNA, 601 bp, Human; identical to SEQ ID NO: 74765

SEQ ID NO: 74965 - DNA, 601 bp, Human; identical to SEQ ID NO: 74766

SEQ ID NO: 74966 - DNA, 601 bp, Human; identical to SEQ ID NO: 74767

SEQ ID NO: 74967 - DNA, 601 bp, Human; identical to SEQ ID NO: 74768

SEQ ID NO: 74968 - DNA, 601 bp, Human; identical to SEQ ID NO: 74769

SEQ ID NO: 74969 - DNA, 601 bp, Human; identical to SEQ ID NO: 74770

SEQ ID NO: 74970 - DNA, 601 bp, Human; identical to SEQ ID NO: 74771

SEQ ID NO: 74971 - DNA, 601 bp, Human; identical to SEQ ID NO: 74772

SEQ ID NO: 74972 - DNA, 601 bp, Human; identical to SEQ ID NO: 74773

SEQ ID NO: 74973 - DNA, 601 bp, Human; identical to SEQ ID NO: 74774

SEQ ID NO: 74974 - DNA, 601 bp, Human; identical to SEQ ID NO: 74775

SEQ ID NO: 74975 - DNA, 601 bp, Human; identical to SEQ ID NO: 74776

SEQ ID NO: 74976 - DNA, 601 bp, Human; identical to SEQ ID NO: 74777

SEQ ID NO: 74977 - DNA, 601 bp, Human; identical to SEQ ID NO: 74778

SEQ ID NO: 74978 - DNA, 601 bp, Human; identical to SEQ ID NO: 74779

SEQ ID NO: 74979 - DNA, 601 bp, Human; identical to SEQ ID NO: 74780

SEQ ID NO: 74980 - DNA, 601 bp, Human; identical to SEQ ID NO: 74781

SEQ ID NO: 74981 - DNA, 601 bp, Human; identical to SEQ ID NO: 74782

SEQ ID NO: 74982 - DNA, 601 bp, Human; identical to SEQ ID NO: 74783

SEQ ID NO: 74983 - DNA, 601 bp, Human; identical to SEQ ID NO: 74784

SEQ ID NO: 74984 - DNA, 601 bp, Human; identical to SEQ ID NO: 74785

SEQ ID NO: 74985 - DNA, 601 bp, Human; identical to SEQ ID NO: 74786

SEQ ID NO: 74986 - DNA, 601 bp, Human; identical to SEQ ID NO: 74787

SEQ ID NO: 74987 - DNA, 601 bp, Human; identical to SEQ ID NO: 74788

SEQ ID NO: 74988 - DNA, 601 bp, Human; identical to SEQ ID NO: 74789

SEQ ID NO: 74989 - DNA, 601 bp, Human; identical to SEQ ID NO: 74790

SEQ ID NO: 74990 - DNA, 601 bp, Human; identical to SEQ ID NO: 74791

SEQ ID NO: 74991 - DNA, 601 bp, Human; identical to SEQ ID NO: 74792

SEQ ID NO: 74992 - DNA, 601 bp, Human; identical to SEQ ID NO: 74793

SEQ ID NO: 74993 - DNA, 601 bp, Human; identical to SEQ ID NO: 74794

SEQ ID NO: 74994 - DNA, 601 bp, Human; identical to SEQ ID NO: 74795

SEQ ID NO: 74995 - DNA, 601 bp, Human; identical to SEQ ID NO: 74796

SEQ ID NO: 74996 - DNA, 601 bp, Human; identical to SEQ ID NO: 74797

SEQ ID NO: 74997 - DNA, 601 bp, Human; identical to SEQ ID NO: 74798

SEQ ID NO: 74998 - DNA, 601 bp, Human; identical to SEQ ID NO: 74799

SEQ ID NO: 74999 - DNA, 601 bp, Human; identical to SEQ ID NO: 74800

SEQ ID NO: 75000 - DNA, 601 bp, Human; identical to SEQ ID NO: 74801

SEQ ID NO: 75001 - DNA, 601 bp, Human; identical to SEQ ID NO: 74802

SEQ ID NO: 75002 - DNA, 601 bp, Human; identical to SEQ ID NO: 74803

SEQ ID NO: 75003 - DNA, 601 bp, Human; identical to SEQ ID NO: 74804

SEQ ID NO: 75004 - DNA, 601 bp, Human; identical to SEQ ID NO: 74805

SEQ ID NO: 75005 - DNA, 601 bp, Human; identical to SEQ ID NO: 74806

SEQ ID NO: 75006 - DNA, 601 bp, Human; identical to SEQ ID NO: 74807

SEQ ID NO: 75007 - DNA, 601 bp, Human; identical to SEQ ID NO: 74808

SEQ ID NO: 75008 - DNA, 601 bp, Human; identical to SEQ ID NO: 74809

SEQ ID NO: 75009 - DNA, 601 bp, Human; identical to SEQ ID NO: 74810

SEQ ID NO: 75010 - DNA, 601 bp, Human; identical to SEQ ID NO: 74811

SEQ ID NO: 75011 - DNA, 601 bp, Human; identical to SEQ ID NO: 74812

SEQ ID NO: 75012 - DNA, 601 bp, Human; identical to SEQ ID NO: 74813

SEQ ID NO: 75013 - DNA, 601 bp, Human; identical to SEQ ID NO: 74814

SEQ ID NO: 75014 - DNA, 601 bp, Human; identical to SEQ ID NO: 74815

SEQ ID NO: 75015 - DNA, 601 bp, Human; identical to SEQ ID NO: 74816

SEQ ID NO: 75016 - DNA, 601 bp, Human; identical to SEQ ID NO: 74817

SEQ ID NO: 75017 - DNA, 601 bp, Human; identical to SEQ ID NO: 74818

SEQ ID NO: 75018 - DNA, 601 bp, Human; identical to SEQ ID NO: 74819

SEQ ID NO: 75019 - DNA, 601 bp, Human; identical to SEQ ID NO: 74820

SEQ ID NO: 75020 - DNA, 601 bp, Human; identical to SEQ ID NO: 74821

SEQ ID NO: 75021 - DNA, 601 bp, Human; identical to SEQ ID NO: 74822

SEQ ID NO: 75022 - DNA, 601 bp, Human; identical to SEQ ID NO: 74823

SEQ ID NO: 75023 - DNA, 601 bp, Human; identical to SEQ ID NO: 74824

SEQ ID NO: 75024 - DNA, 601 bp, Human; identical to SEQ ID NO: 74825

SEQ ID NO: 75025 - DNA, 601 bp, Human; identical to SEQ ID NO: 74826

SEQ ID NO: 75026 - DNA, 601 bp, Human; identical to SEQ ID NO: 74827

SEQ ID NO: 75027 - DNA, 601 bp, Human; identical to SEQ ID NO: 74828

SEQ ID NO: 75028 - DNA, 601 bp, Human; identical to SEQ ID NO: 74829

SEQ ID NO: 75029 - DNA, 601 bp, Human; identical to SEQ ID NO: 74830

SEQ ID NO: 75030 - DNA, 601 bp, Human; identical to SEQ ID NO: 74831

SEQ ID NO: 75031 - DNA, 601 bp, Human; identical to SEQ ID NO: 74832

SEQ ID NO: 75032 - DNA, 601 bp, Human; identical to SEQ ID NO: 74833

SEQ ID NO: 75033 - DNA, 601 bp, Human; identical to SEQ ID NO: 74834

SEQ ID NO: 75034 - DNA, 601 bp, Human; identical to SEQ ID NO: 74835

SEQ ID NO: 75035 - DNA, 601 bp, Human; identical to SEQ ID NO: 74836

SEQ ID NO: 75036 - DNA, 601 bp, Human; identical to SEQ ID NO: 74837

SEQ ID NO: 75037 - DNA, 601 bp, Human; identical to SEQ ID NO: 74838

SEQ ID NO: 75038 - DNA, 601 bp, Human; identical to SEQ ID NO: 74839

SEQ ID NO: 75039 - DNA, 601 bp, Human; identical to SEQ ID NO: 74840

SEQ ID NO: 75040 - DNA, 601 bp, Human; identical to SEQ ID NO: 74841

SEQ ID NO: 75041 - DNA, 601 bp, Human; identical to SEQ ID NO: 74842

SEQ ID NO: 75042 - DNA, 601 bp, Human; identical to SEQ ID NO: 74843

SEQ ID NO: 75043 - DNA, 601 bp, Human; identical to SEQ ID NO: 74844

SEQ ID NO: 75044 - DNA, 601 bp, Human; identical to SEQ ID NO: 74845

SEQ ID NO: 75045 - DNA, 601 bp, Human; identical to SEQ ID NO: 74846

SEQ ID NO: 75046 - DNA, 601 bp, Human; identical to SEQ ID NO: 74847

SEQ ID NO: 75047 - DNA, 601 bp, Human; identical to SEQ ID NO: 74848

SEQ ID NO: 75048 - DNA, 601 bp, Human; identical to SEQ ID NO: 74849

SEQ ID NO: 75049 - DNA, 601 bp, Human; identical to SEQ ID NO: 74850

SEQ ID NO: 75050 - DNA, 601 bp, Human; identical to SEQ ID NO: 74851

SEQ ID NO: 75051 - DNA, 601 bp, Human; identical to SEQ ID NO: 74852

SEQ ID NO: 75052 - DNA, 601 bp, Human; identical to SEQ ID NO: 74853

SEQ ID NO: 75053 - DNA, 601 bp, Human; identical to SEQ ID NO: 74854

SEQ ID NO: 75054 - DNA, 601 bp, Human; identical to SEQ ID NO: 74855

SEQ ID NO: 75055 - DNA, 601 bp, Human; identical to SEQ ID NO: 74856

SEQ ID NO: 75056 - DNA, 601 bp, Human; identical to SEQ ID NO: 74857

SEQ ID NO: 75057 - DNA, 601 bp, Human; identical to SEQ ID NO: 74858

SEQ ID NO: 75058 - DNA, 601 bp, Human; identical to SEQ ID NO: 74660

SEQ ID NO: 75059 - DNA, 601 bp, Human; identical to SEQ ID NO: 74661

SEQ ID NO: 75060 - DNA, 601 bp, Human; identical to SEQ ID NO: 74662

SEQ ID NO: 75061 - DNA, 601 bp, Human; identical to SEQ ID NO: 74663

SEQ ID NO: 75062 - DNA, 601 bp, Human; identical to SEQ ID NO: 74664

SEQ ID NO: 75063 - DNA, 601 bp, Human; identical to SEQ ID NO: 74665

SEQ ID NO: 75064 - DNA, 601 bp, Human; identical to SEQ ID NO: 74666

SEQ ID NO: 75065 - DNA, 601 bp, Human; identical to SEQ ID NO: 74667

SEQ ID NO: 75066 - DNA, 601 bp, Human; identical to SEQ ID NO: 74668

SEQ ID NO: 75067 - DNA, 601 bp, Human; identical to SEQ ID NO: 74669

SEQ ID NO: 75068 - DNA, 601 bp, Human; identical to SEQ ID NO: 74670

SEQ ID NO: 75069 - DNA, 601 bp, Human; identical to SEQ ID NO: 74671

SEQ ID NO: 75070 - DNA, 601 bp, Human; identical to SEQ ID NO: 74672

SEQ ID NO: 75071 - DNA, 601 bp, Human; identical to SEQ ID NO: 74673

SEQ ID NO: 75072 - DNA, 601 bp, Human; identical to SEQ ID NO: 74674

SEQ ID NO: 75073 - DNA, 601 bp, Human; identical to SEQ ID NO: 74675

SEQ ID NO: 75074 - DNA, 601 bp, Human; identical to SEQ ID NO: 74676

SEQ ID NO: 75075 - DNA, 601 bp, Human; identical to SEQ ID NO: 74677

SEQ ID NO: 75076 - DNA, 601 bp, Human; identical to SEQ ID NO: 74678

SEQ ID NO: 75077 - DNA, 601 bp, Human; identical to SEQ ID NO: 74679

SEQ ID NO: 75078 - DNA, 601 bp, Human; identical to SEQ ID NO: 74680

SEQ ID NO: 75079 - DNA, 601 bp, Human; identical to SEQ ID NO: 74681

SEQ ID NO: 75080 - DNA, 601 bp, Human; identical to SEQ ID NO: 74682

SEQ ID NO: 75081 - DNA, 601 bp, Human; identical to SEQ ID NO: 74683

SEQ ID NO: 75082 - DNA, 601 bp, Human; identical to SEQ ID NO: 74684

SEQ ID NO: 75083 - DNA, 601 bp, Human; identical to SEQ ID NO: 74685

SEQ ID NO: 75084 - DNA, 601 bp, Human; identical to SEQ ID NO: 74686

SEQ ID NO: 75085 - DNA, 601 bp, Human; identical to SEQ ID NO: 74687

SEQ ID NO: 75086 - DNA, 601 bp, Human; identical to SEQ ID NO: 74688

SEQ ID NO: 75087 - DNA, 601 bp, Human; identical to SEQ ID NO: 74689

SEQ ID NO: 75088 - DNA, 601 bp, Human; identical to SEQ ID NO: 74690

SEQ ID NO: 75089 - DNA, 601 bp, Human; identical to SEQ ID NO: 74691

SEQ ID NO: 75090 - DNA, 601 bp, Human; identical to SEQ ID NO: 74692

SEQ ID NO: 75091 - DNA, 601 bp, Human; identical to SEQ ID NO: 74693

SEQ ID NO: 75092 - DNA, 601 bp, Human; identical to SEQ ID NO: 74694

SEQ ID NO: 75093 - DNA, 601 bp, Human; identical to SEQ ID NO: 74695

SEQ ID NO: 75094 - DNA, 601 bp, Human; identical to SEQ ID NO: 74696

SEQ ID NO: 75095 - DNA, 601 bp, Human; identical to SEQ ID NO: 74697

SEQ ID NO: 75096 - DNA, 601 bp, Human; identical to SEQ ID NO: 74698

SEQ ID NO: 75097 - DNA, 601 bp, Human; identical to SEQ ID NO: 74699

SEQ ID NO: 75098 - DNA, 601 bp, Human; identical to SEQ ID NO: 74700

SEQ ID NO: 75099 - DNA, 601 bp, Human; identical to SEQ ID NO: 74701

SEQ ID NO: 75100 - DNA, 601 bp, Human; identical to SEQ ID NO: 74702

SEQ ID NO: 75101 - DNA, 601 bp, Human; identical to SEQ ID NO: 74703

SEQ ID NO: 75102 - DNA, 601 bp, Human; identical to SEQ ID NO: 74704

SEQ ID NO: 75103 - DNA, 601 bp, Human; identical to SEQ ID NO: 74705

SEQ ID NO: 75104 - DNA, 601 bp, Human; identical to SEQ ID NO: 74706

SEQ ID NO: 75105 - DNA, 601 bp, Human; identical to SEQ ID NO: 74707

SEQ ID NO: 75106 - DNA, 601 bp, Human; identical to SEQ ID NO: 74708

SEQ ID NO: 75107 - DNA, 601 bp, Human; identical to SEQ ID NO: 74709

SEQ ID NO: 75108 - DNA, 601 bp, Human; identical to SEQ ID NO: 74710

SEQ ID NO: 75109 - DNA, 601 bp, Human; identical to SEQ ID NO: 74711

SEQ ID NO: 75110 - DNA, 601 bp, Human; identical to SEQ ID NO: 74712

SEQ ID NO: 75111 - DNA, 601 bp, Human; identical to SEQ ID NO: 74713

SEQ ID NO: 75112 - DNA, 601 bp, Human; identical to SEQ ID NO: 74714

SEQ ID NO: 75113 - DNA, 601 bp, Human; identical to SEQ ID NO: 74715

SEQ ID NO: 75114 - DNA, 601 bp, Human; identical to SEQ ID NO: 74716

SEQ ID NO: 75115 - DNA, 601 bp, Human; identical to SEQ ID NO: 74717

SEQ ID NO: 75116 - DNA, 601 bp, Human; identical to SEQ ID NO: 74718

SEQ ID NO: 75117 - DNA, 601 bp, Human; identical to SEQ ID NO: 74719

SEQ ID NO: 75118 - DNA, 601 bp, Human; identical to SEQ ID NO: 74720

SEQ ID NO: 75119 - DNA, 601 bp, Human; identical to SEQ ID NO: 74721

SEQ ID NO: 75120 - DNA, 601 bp, Human; identical to SEQ ID NO: 74722

SEQ ID NO: 75121 - DNA, 601 bp, Human; identical to SEQ ID NO: 74723

SEQ ID NO: 75122 - DNA, 601 bp, Human; identical to SEQ ID NO: 74724

SEQ ID NO: 75123 - DNA, 601 bp, Human; identical to SEQ ID NO: 74725

SEQ ID NO: 75124 - DNA, 601 bp, Human; identical to SEQ ID NO: 74726

SEQ ID NO: 75125 - DNA, 601 bp, Human; identical to SEQ ID NO: 74727

SEQ ID NO: 75126 - DNA, 601 bp, Human; identical to SEQ ID NO: 74728

SEQ ID NO: 75127 - DNA, 601 bp, Human; identical to SEQ ID NO: 74729

SEQ ID NO: 75128 - DNA, 601 bp, Human; identical to SEQ ID NO: 74730

SEQ ID NO: 75129 - DNA, 601 bp, Human; identical to SEQ ID NO: 74731

SEQ ID NO: 75130 - DNA, 601 bp, Human; identical to SEQ ID NO: 74732

SEQ ID NO: 75131 - DNA, 601 bp, Human; identical to SEQ ID NO: 74733

SEQ ID NO: 75132 - DNA, 601 bp, Human; identical to SEQ ID NO: 74734

SEQ ID NO: 75133 - DNA, 601 bp, Human; identical to SEQ ID NO: 74735

SEQ ID NO: 75134 - DNA, 601 bp, Human; identical to SEQ ID NO: 74736

SEQ ID NO: 75135 - DNA, 601 bp, Human; identical to SEQ ID NO: 74737

SEQ ID NO: 75136 - DNA, 601 bp, Human; identical to SEQ ID NO: 74738

SEQ ID NO: 75137 - DNA, 601 bp, Human; identical to SEQ ID NO: 74739

SEQ ID NO: 75138 - DNA, 601 bp, Human; identical to SEQ ID NO: 74740

SEQ ID NO: 75139 - DNA, 601 bp, Human; identical to SEQ ID NO: 74741

SEQ ID NO: 75140 - DNA, 601 bp, Human; identical to SEQ ID NO: 74742

SEQ ID NO: 75141 - DNA, 601 bp, Human; identical to SEQ ID NO: 74743

SEQ ID NO: 75142 - DNA, 601 bp, Human; identical to SEQ ID NO: 74744

SEQ ID NO: 75143 - DNA, 601 bp, Human; identical to SEQ ID NO: 74745

SEQ ID NO: 75144 - DNA, 601 bp, Human; identical to SEQ ID NO: 74746

SEQ ID NO: 75145 - DNA, 601 bp, Human; identical to SEQ ID NO: 74747

SEQ ID NO: 75146 - DNA, 601 bp, Human; identical to SEQ ID NO: 74748

SEQ ID NO: 75147 - DNA, 601 bp, Human; identical to SEQ ID NO: 74749

SEQ ID NO: 75148 - DNA, 601 bp, Human; identical to SEQ ID NO: 74750

SEQ ID NO: 75149 - DNA, 601 bp, Human; identical to SEQ ID NO: 74751

SEQ ID NO: 75150 - DNA, 601 bp, Human; identical to SEQ ID NO: 74752

SEQ ID NO: 75151 - DNA, 601 bp, Human; identical to SEQ ID NO: 74753

SEQ ID NO: 75152 - DNA, 601 bp, Human; identical to SEQ ID NO: 74754

SEQ ID NO: 75153 - DNA, 601 bp, Human; identical to SEQ ID NO: 74755

SEQ ID NO: 75154 - DNA, 601 bp, Human; identical to SEQ ID NO: 74756

SEQ ID NO: 75155 - DNA, 601 bp, Human; identical to SEQ ID NO: 74757

SEQ ID NO: 75156 - DNA, 601 bp, Human; identical to SEQ ID NO: 74758

SEQ ID NO: 75157 - DNA, 601 bp, Human; identical to SEQ ID NO: 74759

SEQ ID NO: 75158 - DNA, 601 bp, Human; identical to SEQ ID NO: 74760

SEQ ID NO: 75159 - DNA, 601 bp, Human; identical to SEQ ID NO: 74761

SEQ ID NO: 75160 - DNA, 601 bp, Human; identical to SEQ ID NO: 74762

SEQ ID NO: 75161 - DNA, 601 bp, Human; identical to SEQ ID NO: 74763

SEQ ID NO: 75162 - DNA, 601 bp, Human; identical to SEQ ID NO: 74764

SEQ ID NO: 75163 - DNA, 601 bp, Human; identical to SEQ ID NO: 74765

SEQ ID NO: 75164 - DNA, 601 bp, Human; identical to SEQ ID NO: 74766

SEQ ID NO: 75165 - DNA, 601 bp, Human; identical to SEQ ID NO: 74767

SEQ ID NO: 75166 - DNA, 601 bp, Human; identical to SEQ ID NO: 74768

SEQ ID NO: 75167 - DNA, 601 bp, Human; identical to SEQ ID NO: 74769

SEQ ID NO: 75168 - DNA, 601 bp, Human; identical to SEQ ID NO: 74770

SEQ ID NO: 75169 - DNA, 601 bp, Human; identical to SEQ ID NO: 74771

SEQ ID NO: 75170 - DNA, 601 bp, Human; identical to SEQ ID NO: 74772

SEQ ID NO: 75171 - DNA, 601 bp, Human; identical to SEQ ID NO: 74773

SEQ ID NO: 75172 - DNA, 601 bp, Human; identical to SEQ ID NO: 74774

SEQ ID NO: 75173 - DNA, 601 bp, Human; identical to SEQ ID NO: 74775

SEQ ID NO: 75174 - DNA, 601 bp, Human; identical to SEQ ID NO: 74776

SEQ ID NO: 75175 - DNA, 601 bp, Human; identical to SEQ ID NO: 74777

SEQ ID NO: 75176 - DNA, 601 bp, Human; identical to SEQ ID NO: 74778

SEQ ID NO: 75177 - DNA, 601 bp, Human; identical to SEQ ID NO: 74779

SEQ ID NO: 75178 - DNA, 601 bp, Human; identical to SEQ ID NO: 74780

SEQ ID NO: 75179 - DNA, 601 bp, Human; identical to SEQ ID NO: 74781

SEQ ID NO: 75180 - DNA, 601 bp, Human; identical to SEQ ID NO: 74782

SEQ ID NO: 75181 - DNA, 601 bp, Human; identical to SEQ ID NO: 74783

SEQ ID NO: 75182 - DNA, 601 bp, Human; identical to SEQ ID NO: 74784

SEQ ID NO: 75183 - DNA, 601 bp, Human; identical to SEQ ID NO: 74785

SEQ ID NO: 75184 - DNA, 601 bp, Human; identical to SEQ ID NO: 74786

SEQ ID NO: 75185 - DNA, 601 bp, Human; identical to SEQ ID NO: 74787

SEQ ID NO: 75186 - DNA, 601 bp, Human; identical to SEQ ID NO: 74788

SEQ ID NO: 75187 - DNA, 601 bp, Human; identical to SEQ ID NO: 74789

SEQ ID NO: 75188 - DNA, 601 bp, Human; identical to SEQ ID NO: 74790

SEQ ID NO: 75189 - DNA, 601 bp, Human; identical to SEQ ID NO: 74791

SEQ ID NO: 75190 - DNA, 601 bp, Human; identical to SEQ ID NO: 74792

SEQ ID NO: 75191 - DNA, 601 bp, Human; identical to SEQ ID NO: 74793

SEQ ID NO: 75192 - DNA, 601 bp, Human; identical to SEQ ID NO: 74794

SEQ ID NO: 75193 - DNA, 601 bp, Human; identical to SEQ ID NO: 74795

SEQ ID NO: 75194 - DNA, 601 bp, Human; identical to SEQ ID NO: 74796

SEQ ID NO: 75195 - DNA, 601 bp, Human; identical to SEQ ID NO: 74797

SEQ ID NO: 75196 - DNA, 601 bp, Human; identical to SEQ ID NO: 74798

SEQ ID NO: 75197 - DNA, 601 bp, Human; identical to SEQ ID NO: 74799

SEQ ID NO: 75198 - DNA, 601 bp, Human; identical to SEQ ID NO: 74800

SEQ ID NO: 75199 - DNA, 601 bp, Human; identical to SEQ ID NO: 74801

SEQ ID NO: 75200 - DNA, 601 bp, Human; identical to SEQ ID NO: 74802

SEQ ID NO: 75201 - DNA, 601 bp, Human; identical to SEQ ID NO: 74803

SEQ ID NO: 75202 - DNA, 601 bp, Human; identical to SEQ ID NO: 74804

SEQ ID NO: 75203 - DNA, 601 bp, Human; identical to SEQ ID NO: 74805

SEQ ID NO: 75204 - DNA, 601 bp, Human; identical to SEQ ID NO: 74806

SEQ ID NO: 75205 - DNA, 601 bp, Human; identical to SEQ ID NO: 74807

SEQ ID NO: 75206 - DNA, 601 bp, Human; identical to SEQ ID NO: 74808

SEQ ID NO: 75207 - DNA, 601 bp, Human; identical to SEQ ID NO: 74809

SEQ ID NO: 75208 - DNA, 601 bp, Human; identical to SEQ ID NO: 74810

SEQ ID NO: 75209 - DNA, 601 bp, Human; identical to SEQ ID NO: 74811

SEQ ID NO: 75210 - DNA, 601 bp, Human; identical to SEQ ID NO: 74812

SEQ ID NO: 75211 - DNA, 601 bp, Human; identical to SEQ ID NO: 74813

SEQ ID NO: 75212 - DNA, 601 bp, Human; identical to SEQ ID NO: 74814

SEQ ID NO: 75213 - DNA, 601 bp, Human; identical to SEQ ID NO: 74815

SEQ ID NO: 75214 - DNA, 601 bp, Human; identical to SEQ ID NO: 74816

SEQ ID NO: 75215 - DNA, 601 bp, Human; identical to SEQ ID NO: 74817

SEQ ID NO: 75216 - DNA, 601 bp, Human; identical to SEQ ID NO: 74818

SEQ ID NO: 75217 - DNA, 601 bp, Human; identical to SEQ ID NO: 74819

SEQ ID NO: 75218 - DNA, 601 bp, Human; identical to SEQ ID NO: 74820

SEQ ID NO: 75219 - DNA, 601 bp, Human; identical to SEQ ID NO: 74821

SEQ ID NO: 75220 - DNA, 601 bp, Human; identical to SEQ ID NO: 74822

SEQ ID NO: 75221 - DNA, 601 bp, Human; identical to SEQ ID NO: 74823

SEQ ID NO: 75222 - DNA, 601 bp, Human; identical to SEQ ID NO: 74824

SEQ ID NO: 75223 - DNA, 601 bp, Human; identical to SEQ ID NO: 74825

SEQ ID NO: 75224 - DNA, 601 bp, Human; identical to SEQ ID NO: 74826

SEQ ID NO: 75225 - DNA, 601 bp, Human; identical to SEQ ID NO: 74827

SEQ ID NO: 75226 - DNA, 601 bp, Human; identical to SEQ ID NO: 74828

SEQ ID NO: 75227 - DNA, 601 bp, Human; identical to SEQ ID NO: 74829

SEQ ID NO: 75228 - DNA, 601 bp, Human; identical to SEQ ID NO: 74830

SEQ ID NO: 75229 - DNA, 601 bp, Human; identical to SEQ ID NO: 74831

SEQ ID NO: 75230 - DNA, 601 bp, Human; identical to SEQ ID NO: 74832

SEQ ID NO: 75231 - DNA, 601 bp, Human; identical to SEQ ID NO: 74833

SEQ ID NO: 75232 - DNA, 601 bp, Human; identical to SEQ ID NO: 74834

SEQ ID NO: 75233 - DNA, 601 bp, Human; identical to SEQ ID NO: 74835

SEQ ID NO: 75234 - DNA, 601 bp, Human; identical to SEQ ID NO: 74836

SEQ ID NO: 75235 - DNA, 601 bp, Human; identical to SEQ ID NO: 74837

SEQ ID NO: 75236 - DNA, 601 bp, Human; identical to SEQ ID NO: 74838

SEQ ID NO: 75237 - DNA, 601 bp, Human; identical to SEQ ID NO: 74839

SEQ ID NO: 75238 - DNA, 601 bp, Human; identical to SEQ ID NO: 74840

SEQ ID NO: 75239 - DNA, 601 bp, Human; identical to SEQ ID NO: 74841

SEQ ID NO: 75240 - DNA, 601 bp, Human; identical to SEQ ID NO: 74842

SEQ ID NO: 75241 - DNA, 601 bp, Human; identical to SEQ ID NO: 74843

SEQ ID NO: 75242 - DNA, 601 bp, Human; identical to SEQ ID NO: 74844

SEQ ID NO: 75243 - DNA, 601 bp, Human; identical to SEQ ID NO: 74845

SEQ ID NO: 75244 - DNA, 601 bp, Human; identical to SEQ ID NO: 74846

SEQ ID NO: 75245 - DNA, 601 bp, Human; identical to SEQ ID NO: 74847

SEQ ID NO: 75246 - DNA, 601 bp, Human; identical to SEQ ID NO: 74848

SEQ ID NO: 75247 - DNA, 601 bp, Human; identical to SEQ ID NO: 74849

SEQ ID NO: 75248 - DNA, 601 bp, Human; identical to SEQ ID NO: 74850

SEQ ID NO: 75249 - DNA, 601 bp, Human; identical to SEQ ID NO: 74851

SEQ ID NO: 75250 - DNA, 601 bp, Human; identical to SEQ ID NO: 74852

SEQ ID NO: 75251 - DNA, 601 bp, Human; identical to SEQ ID NO: 74853

SEQ ID NO: 75252 - DNA, 601 bp, Human; identical to SEQ ID NO: 74854

SEQ ID NO: 75253 - DNA, 601 bp, Human; identical to SEQ ID NO: 74855

SEQ ID NO: 75254 - DNA, 601 bp, Human; identical to SEQ ID NO: 74856

SEQ ID NO: 75255 - DNA, 601 bp, Human; identical to SEQ ID NO: 74857

SEQ ID NO: 75256 - DNA, 601 bp, Human; identical to SEQ ID NO: 74858

SEQ ID NO: 75257 - DNA, 601 bp, Human; identical to SEQ ID NO: 74660

SEQ ID NO: 75258 - DNA, 601 bp, Human; identical to SEQ ID NO: 74661

SEQ ID NO: 75259 - DNA, 601 bp, Human; identical to SEQ ID NO: 74662

SEQ ID NO: 75260 - DNA, 601 bp, Human; identical to SEQ ID NO: 74663

SEQ ID NO: 75261 - DNA, 601 bp, Human; identical to SEQ ID NO: 74664

SEQ ID NO: 75262 - DNA, 601 bp, Human; identical to SEQ ID NO: 74665

SEQ ID NO: 75263 - DNA, 601 bp, Human; identical to SEQ ID NO: 74666

SEQ ID NO: 75264 - DNA, 601 bp, Human; identical to SEQ ID NO: 74667

SEQ ID NO: 75265 - DNA, 601 bp, Human; identical to SEQ ID NO: 74668

SEQ ID NO: 75266 - DNA, 601 bp, Human; identical to SEQ ID NO: 74669

SEQ ID NO: 75267 - DNA, 601 bp, Human; identical to SEQ ID NO: 74670

SEQ ID NO: 75268 - DNA, 601 bp, Human; identical to SEQ ID NO: 74671

SEQ ID NO: 75269 - DNA, 601 bp, Human; identical to SEQ ID NO: 74672

SEQ ID NO: 75270 - DNA, 601 bp, Human; identical to SEQ ID NO: 74673

SEQ ID NO: 75271 - DNA, 601 bp, Human; identical to SEQ ID NO: 74674

SEQ ID NO: 75272 - DNA, 601 bp, Human; identical to SEQ ID NO: 74675

SEQ ID NO: 75273 - DNA, 601 bp, Human; identical to SEQ ID NO: 74676

SEQ ID NO: 75274 - DNA, 601 bp, Human; identical to SEQ ID NO: 74677

SEQ ID NO: 75275 - DNA, 601 bp, Human; identical to SEQ ID NO: 74678

SEQ ID NO: 75276 - DNA, 601 bp, Human; identical to SEQ ID NO: 74679

SEQ ID NO: 75277 - DNA, 601 bp, Human; identical to SEQ ID NO: 74680

SEQ ID NO: 75278 - DNA, 601 bp, Human; identical to SEQ ID NO: 74681

SEQ ID NO: 75279 - DNA, 601 bp, Human; identical to SEQ ID NO: 74682

SEQ ID NO: 75280 - DNA, 601 bp, Human; identical to SEQ ID NO: 74683

SEQ ID NO: 75281 - DNA, 601 bp, Human; identical to SEQ ID NO: 74684

SEQ ID NO: 75282 - DNA, 601 bp, Human; identical to SEQ ID NO: 74685

SEQ ID NO: 75283 - DNA, 601 bp, Human; identical to SEQ ID NO: 74686

SEQ ID NO: 75284 - DNA, 601 bp, Human; identical to SEQ ID NO: 74687

SEQ ID NO: 75285 - DNA, 601 bp, Human; identical to SEQ ID NO: 74688

SEQ ID NO: 75286 - DNA, 601 bp, Human; identical to SEQ ID NO: 74689

SEQ ID NO: 75287 - DNA, 601 bp, Human; identical to SEQ ID NO: 74690

SEQ ID NO: 75288 - DNA, 601 bp, Human; identical to SEQ ID NO: 74691

SEQ ID NO: 75289 - DNA, 601 bp, Human; identical to SEQ ID NO: 74692

SEQ ID NO: 75290 - DNA, 601 bp, Human; identical to SEQ ID NO: 74693

SEQ ID NO: 75291 - DNA, 601 bp, Human; identical to SEQ ID NO: 74694

SEQ ID NO: 75292 - DNA, 601 bp, Human; identical to SEQ ID NO: 74695

SEQ ID NO: 75293 - DNA, 601 bp, Human; identical to SEQ ID NO: 74696

SEQ ID NO: 75294 - DNA, 601 bp, Human; identical to SEQ ID NO: 74697

SEQ ID NO: 75295 - DNA, 601 bp, Human; identical to SEQ ID NO: 74698

SEQ ID NO: 75296 - DNA, 601 bp, Human; identical to SEQ ID NO: 74699

SEQ ID NO: 75297 - DNA, 601 bp, Human; identical to SEQ ID NO: 74700

SEQ ID NO: 75298 - DNA, 601 bp, Human; identical to SEQ ID NO: 74701

SEQ ID NO: 75299 - DNA, 601 bp, Human; identical to SEQ ID NO: 74702

SEQ ID NO: 75300 - DNA, 601 bp, Human; identical to SEQ ID NO: 74703

SEQ ID NO: 75301 - DNA, 601 bp, Human; identical to SEQ ID NO: 74704

SEQ ID NO: 75302 - DNA, 601 bp, Human; identical to SEQ ID NO: 74705

SEQ ID NO: 75303 - DNA, 601 bp, Human; identical to SEQ ID NO: 74706

SEQ ID NO: 75304 - DNA, 601 bp, Human; identical to SEQ ID NO: 74707

SEQ ID NO: 75305 - DNA, 601 bp, Human; identical to SEQ ID NO: 74708

SEQ ID NO: 75306 - DNA, 601 bp, Human; identical to SEQ ID NO: 74709

SEQ ID NO: 75307 - DNA, 601 bp, Human; identical to SEQ ID NO: 74710

SEQ ID NO: 75308 - DNA, 601 bp, Human; identical to SEQ ID NO: 74711

SEQ ID NO: 75309 - DNA, 601 bp, Human; identical to SEQ ID NO: 74712

SEQ ID NO: 75310 - DNA, 601 bp, Human; identical to SEQ ID NO: 74713

SEQ ID NO: 75311 - DNA, 601 bp, Human; identical to SEQ ID NO: 74714

SEQ ID NO: 75312 - DNA, 601 bp, Human; identical to SEQ ID NO: 74715

SEQ ID NO: 75313 - DNA, 601 bp, Human; identical to SEQ ID NO: 74716

SEQ ID NO: 75314 - DNA, 601 bp, Human; identical to SEQ ID NO: 74717

SEQ ID NO: 75315 - DNA, 601 bp, Human; identical to SEQ ID NO: 74718

SEQ ID NO: 75316 - DNA, 601 bp, Human; identical to SEQ ID NO: 74719

SEQ ID NO: 75317 - DNA, 601 bp, Human; identical to SEQ ID NO: 74720

SEQ ID NO: 75318 - DNA, 601 bp, Human; identical to SEQ ID NO: 74721

SEQ ID NO: 75319 - DNA, 601 bp, Human; identical to SEQ ID NO: 74722

SEQ ID NO: 75320 - DNA, 601 bp, Human; identical to SEQ ID NO: 74723

SEQ ID NO: 75321 - DNA, 601 bp, Human; identical to SEQ ID NO: 74724

SEQ ID NO: 75322 - DNA, 601 bp, Human; identical to SEQ ID NO: 74725

SEQ ID NO: 75323 - DNA, 601 bp, Human; identical to SEQ ID NO: 74726

SEQ ID NO: 75324 - DNA, 601 bp, Human; identical to SEQ ID NO: 74727

SEQ ID NO: 75325 - DNA, 601 bp, Human; identical to SEQ ID NO: 74728

SEQ ID NO: 75326 - DNA, 601 bp, Human; identical to SEQ ID NO: 74729

SEQ ID NO: 75327 - DNA, 601 bp, Human; identical to SEQ ID NO: 74730

SEQ ID NO: 75328 - DNA, 601 bp, Human; identical to SEQ ID NO: 74731

SEQ ID NO: 75329 - DNA, 601 bp, Human; identical to SEQ ID NO: 74732

SEQ ID NO: 75330 - DNA, 601 bp, Human; identical to SEQ ID NO: 74733

SEQ ID NO: 75331 - DNA, 601 bp, Human; identical to SEQ ID NO: 74734

SEQ ID NO: 75332 - DNA, 601 bp, Human; identical to SEQ ID NO: 74735

SEQ ID NO: 75333 - DNA, 601 bp, Human; identical to SEQ ID NO: 74736

SEQ ID NO: 75334 - DNA, 601 bp, Human; identical to SEQ ID NO: 74737

SEQ ID NO: 75335 - DNA, 601 bp, Human; identical to SEQ ID NO: 74738

SEQ ID NO: 75336 - DNA, 601 bp, Human; identical to SEQ ID NO: 74739

SEQ ID NO: 75337 - DNA, 601 bp, Human; identical to SEQ ID NO: 74740

SEQ ID NO: 75338 - DNA, 601 bp, Human; identical to SEQ ID NO: 74741

SEQ ID NO: 75339 - DNA, 601 bp, Human; identical to SEQ ID NO: 74742

SEQ ID NO: 75340 - DNA, 601 bp, Human; identical to SEQ ID NO: 74743

SEQ ID NO: 75341 - DNA, 601 bp, Human; identical to SEQ ID NO: 74744

SEQ ID NO: 75342 - DNA, 601 bp, Human; identical to SEQ ID NO: 74745

SEQ ID NO: 75343 - DNA, 601 bp, Human; identical to SEQ ID NO: 74746

SEQ ID NO: 75344 - DNA, 601 bp, Human; identical to SEQ ID NO: 74747

SEQ ID NO: 75345 - DNA, 601 bp, Human; identical to SEQ ID NO: 74748

SEQ ID NO: 75346 - DNA, 601 bp, Human; identical to SEQ ID NO: 74749

SEQ ID NO: 75347 - DNA, 601 bp, Human; identical to SEQ ID NO: 74750

SEQ ID NO: 75348 - DNA, 601 bp, Human; identical to SEQ ID NO: 74751

SEQ ID NO: 75349 - DNA, 601 bp, Human; identical to SEQ ID NO: 74752

SEQ ID NO: 75350 - DNA, 601 bp, Human; identical to SEQ ID NO: 74753

SEQ ID NO: 75351 - DNA, 601 bp, Human; identical to SEQ ID NO: 74754

SEQ ID NO: 75352 - DNA, 601 bp, Human; identical to SEQ ID NO: 74755

SEQ ID NO: 75353 - DNA, 601 bp, Human; identical to SEQ ID NO: 74756

SEQ ID NO: 75354 - DNA, 601 bp, Human; identical to SEQ ID NO: 74757

SEQ ID NO: 75355 - DNA, 601 bp, Human; identical to SEQ ID NO: 74758

SEQ ID NO: 75356 - DNA, 601 bp, Human; identical to SEQ ID NO: 74759

SEQ ID NO: 75357 - DNA, 601 bp, Human; identical to SEQ ID NO: 74760

SEQ ID NO: 75358 - DNA, 601 bp, Human; identical to SEQ ID NO: 74761

SEQ ID NO: 75359 - DNA, 601 bp, Human; identical to SEQ ID NO: 74762

SEQ ID NO: 75360 - DNA, 601 bp, Human; identical to SEQ ID NO: 74763

SEQ ID NO: 75361 - DNA, 601 bp, Human; identical to SEQ ID NO: 74764

SEQ ID NO: 75362 - DNA, 601 bp, Human; identical to SEQ ID NO: 74765

SEQ ID NO: 75363 - DNA, 601 bp, Human; identical to SEQ ID NO: 74766

SEQ ID NO: 75364 - DNA, 601 bp, Human; identical to SEQ ID NO: 74767

SEQ ID NO: 75365 - DNA, 601 bp, Human; identical to SEQ ID NO: 74768

SEQ ID NO: 75366 - DNA, 601 bp, Human; identical to SEQ ID NO: 74769

SEQ ID NO: 75367 - DNA, 601 bp, Human; identical to SEQ ID NO: 74770

SEQ ID NO: 75368 - DNA, 601 bp, Human; identical to SEQ ID NO: 74771

SEQ ID NO: 75369 - DNA, 601 bp, Human; identical to SEQ ID NO: 74772

SEQ ID NO: 75370 - DNA, 601 bp, Human; identical to SEQ ID NO: 74773

SEQ ID NO: 75371 - DNA, 601 bp, Human; identical to SEQ ID NO: 74774

SEQ ID NO: 75372 - DNA, 601 bp, Human; identical to SEQ ID NO: 74775

SEQ ID NO: 75373 - DNA, 601 bp, Human; identical to SEQ ID NO: 74776

SEQ ID NO: 75374 - DNA, 601 bp, Human; identical to SEQ ID NO: 74777

SEQ ID NO: 75375 - DNA, 601 bp, Human; identical to SEQ ID NO: 74778

SEQ ID NO: 75376 - DNA, 601 bp, Human; identical to SEQ ID NO: 74779

SEQ ID NO: 75377 - DNA, 601 bp, Human; identical to SEQ ID NO: 74780

SEQ ID NO: 75378 - DNA, 601 bp, Human; identical to SEQ ID NO: 74781

SEQ ID NO: 75379 - DNA, 601 bp, Human; identical to SEQ ID NO: 74782

SEQ ID NO: 75380 - DNA, 601 bp, Human; identical to SEQ ID NO: 74783

SEQ ID NO: 75381 - DNA, 601 bp, Human; identical to SEQ ID NO: 74784

SEQ ID NO: 75382 - DNA, 601 bp, Human; identical to SEQ ID NO: 74785

SEQ ID NO: 75383 - DNA, 601 bp, Human; identical to SEQ ID NO: 74786

SEQ ID NO: 75384 - DNA, 601 bp, Human; identical to SEQ ID NO: 74787

SEQ ID NO: 75385 - DNA, 601 bp, Human; identical to SEQ ID NO: 74788

SEQ ID NO: 75386 - DNA, 601 bp, Human; identical to SEQ ID NO: 74789

SEQ ID NO: 75387 - DNA, 601 bp, Human; identical to SEQ ID NO: 74790

SEQ ID NO: 75388 - DNA, 601 bp, Human; identical to SEQ ID NO: 74791

SEQ ID NO: 75389 - DNA, 601 bp, Human; identical to SEQ ID NO: 74792

SEQ ID NO: 75390 - DNA, 601 bp, Human; identical to SEQ ID NO: 74793

SEQ ID NO: 75391 - DNA, 601 bp, Human; identical to SEQ ID NO: 74794

SEQ ID NO: 75392 - DNA, 601 bp, Human; identical to SEQ ID NO: 74795

SEQ ID NO: 75393 - DNA, 601 bp, Human; identical to SEQ ID NO: 74796

SEQ ID NO: 75394 - DNA, 601 bp, Human; identical to SEQ ID NO: 74797

SEQ ID NO: 75395 - DNA, 601 bp, Human; identical to SEQ ID NO: 74798

SEQ ID NO: 75396 - DNA, 601 bp, Human; identical to SEQ ID NO: 74799

SEQ ID NO: 75397 - DNA, 601 bp, Human; identical to SEQ ID NO: 74800

SEQ ID NO: 75398 - DNA, 601 bp, Human; identical to SEQ ID NO: 74801

SEQ ID NO: 75399 - DNA, 601 bp, Human; identical to SEQ ID NO: 74802

SEQ ID NO: 75400 - DNA, 601 bp, Human; identical to SEQ ID NO: 74803

SEQ ID NO: 75401 - DNA, 601 bp, Human; identical to SEQ ID NO: 74804

SEQ ID NO: 75402 - DNA, 601 bp, Human; identical to SEQ ID NO: 74805

SEQ ID NO: 75403 - DNA, 601 bp, Human; identical to SEQ ID NO: 74806

SEQ ID NO: 75404 - DNA, 601 bp, Human; identical to SEQ ID NO: 74807

SEQ ID NO: 75405 - DNA, 601 bp, Human; identical to SEQ ID NO: 74808

SEQ ID NO: 75406 - DNA, 601 bp, Human; identical to SEQ ID NO: 74809

SEQ ID NO: 75407 - DNA, 601 bp, Human; identical to SEQ ID NO: 74810

SEQ ID NO: 75408 - DNA, 601 bp, Human; identical to SEQ ID NO: 74811

SEQ ID NO: 75409 - DNA, 601 bp, Human; identical to SEQ ID NO: 74812

SEQ ID NO: 75410 - DNA, 601 bp, Human; identical to SEQ ID NO: 74813

SEQ ID NO: 75411 - DNA, 601 bp, Human; identical to SEQ ID NO: 74814

SEQ ID NO: 75412 - DNA, 601 bp, Human; identical to SEQ ID NO: 74815

SEQ ID NO: 75413 - DNA, 601 bp, Human; identical to SEQ ID NO: 74816

SEQ ID NO: 75414 - DNA, 601 bp, Human; identical to SEQ ID NO: 74817

SEQ ID NO: 75415 - DNA, 601 bp, Human; identical to SEQ ID NO: 74818

SEQ ID NO: 75416 - DNA, 601 bp, Human; identical to SEQ ID NO: 74819

SEQ ID NO: 75417 - DNA, 601 bp, Human; identical to SEQ ID NO: 74820

SEQ ID NO: 75418 - DNA, 601 bp, Human; identical to SEQ ID NO: 74821

SEQ ID NO: 75419 - DNA, 601 bp, Human; identical to SEQ ID NO: 74822

SEQ ID NO: 75420 - DNA, 601 bp, Human; identical to SEQ ID NO: 74823

SEQ ID NO: 75421 - DNA, 601 bp, Human; identical to SEQ ID NO: 74824

SEQ ID NO: 75422 - DNA, 601 bp, Human; identical to SEQ ID NO: 74825

SEQ ID NO: 75423 - DNA, 601 bp, Human; identical to SEQ ID NO: 74826

SEQ ID NO: 75424 - DNA, 601 bp, Human; identical to SEQ ID NO: 74827

SEQ ID NO: 75425 - DNA, 601 bp, Human; identical to SEQ ID NO: 74828

SEQ ID NO: 75426 - DNA, 601 bp, Human; identical to SEQ ID NO: 74829

SEQ ID NO: 75427 - DNA, 601 bp, Human; identical to SEQ ID NO: 74830

SEQ ID NO: 75428 - DNA, 601 bp, Human; identical to SEQ ID NO: 74831

SEQ ID NO: 75429 - DNA, 601 bp, Human; identical to SEQ ID NO: 74832

SEQ ID NO: 75430 - DNA, 601 bp, Human; identical to SEQ ID NO: 74833

SEQ ID NO: 75431 - DNA, 601 bp, Human; identical to SEQ ID NO: 74834

SEQ ID NO: 75432 - DNA, 601 bp, Human; identical to SEQ ID NO: 74835

SEQ ID NO: 75433 - DNA, 601 bp, Human; identical to SEQ ID NO: 74836

SEQ ID NO: 75434 - DNA, 601 bp, Human; identical to SEQ ID NO: 74837

SEQ ID NO: 75435 - DNA, 601 bp, Human; identical to SEQ ID NO: 74838

SEQ ID NO: 75436 - DNA, 601 bp, Human; identical to SEQ ID NO: 74839

SEQ ID NO: 75437 - DNA, 601 bp, Human; identical to SEQ ID NO: 74840

SEQ ID NO: 75438 - DNA, 601 bp, Human; identical to SEQ ID NO: 74841

SEQ ID NO: 75439 - DNA, 601 bp, Human; identical to SEQ ID NO: 74842

SEQ ID NO: 75440 - DNA, 601 bp, Human; identical to SEQ ID NO: 74843

SEQ ID NO: 75441 - DNA, 601 bp, Human; identical to SEQ ID NO: 74844

SEQ ID NO: 75442 - DNA, 601 bp, Human; identical to SEQ ID NO: 74845

SEQ ID NO: 75443 - DNA, 601 bp, Human; identical to SEQ ID NO: 74846

SEQ ID NO: 75444 - DNA, 601 bp, Human; identical to SEQ ID NO: 74847

SEQ ID NO: 75445 - DNA, 601 bp, Human; identical to SEQ ID NO: 74848

SEQ ID NO: 75446 - DNA, 601 bp, Human; identical to SEQ ID NO: 74849

SEQ ID NO: 75447 - DNA, 601 bp, Human; identical to SEQ ID NO: 74850

SEQ ID NO: 75448 - DNA, 601 bp, Human; identical to SEQ ID NO: 74851

SEQ ID NO: 75449 - DNA, 601 bp, Human; identical to SEQ ID NO: 74852

SEQ ID NO: 75450 - DNA, 601 bp, Human; identical to SEQ ID NO: 74853

SEQ ID NO: 75451 - DNA, 601 bp, Human; identical to SEQ ID NO: 74854

SEQ ID NO: 75452 - DNA, 601 bp, Human; identical to SEQ ID NO: 74855

SEQ ID NO: 75453 - DNA, 601 bp, Human; identical to SEQ ID NO: 74856

SEQ ID NO: 75454 - DNA, 601 bp, Human; identical to SEQ ID NO: 74857

SEQ ID NO: 75455 - DNA, 601 bp, Human; identical to SEQ ID NO: 74858

SEQ ID NO: 75456 - DNA, 601 bp, Human; identical to SEQ ID NO: 74660

SEQ ID NO: 75457 - DNA, 601 bp, Human; identical to SEQ ID NO: 74661

SEQ ID NO: 75458 - DNA, 601 bp, Human; identical to SEQ ID NO: 74662

SEQ ID NO: 75459 - DNA, 601 bp, Human; identical to SEQ ID NO: 74663

SEQ ID NO: 75460 - DNA, 601 bp, Human; identical to SEQ ID NO: 74664

SEQ ID NO: 75461 - DNA, 601 bp, Human; identical to SEQ ID NO: 74665

SEQ ID NO: 75462 - DNA, 601 bp, Human; identical to SEQ ID NO: 74666

SEQ ID NO: 75463 - DNA, 601 bp, Human; identical to SEQ ID NO: 74667

SEQ ID NO: 75464 - DNA, 601 bp, Human; identical to SEQ ID NO: 74668

SEQ ID NO: 75465 - DNA, 601 bp, Human; identical to SEQ ID NO: 74669

SEQ ID NO: 75466 - DNA, 601 bp, Human; identical to SEQ ID NO: 74670

SEQ ID NO: 75467 - DNA, 601 bp, Human; identical to SEQ ID NO: 74671

SEQ ID NO: 75468 - DNA, 601 bp, Human; identical to SEQ ID NO: 74672

SEQ ID NO: 75469 - DNA, 601 bp, Human; identical to SEQ ID NO: 74673

SEQ ID NO: 75470 - DNA, 601 bp, Human; identical to SEQ ID NO: 74674

SEQ ID NO: 75471 - DNA, 601 bp, Human; identical to SEQ ID NO: 74675

SEQ ID NO: 75472 - DNA, 601 bp, Human; identical to SEQ ID NO: 74676

SEQ ID NO: 75473 - DNA, 601 bp, Human; identical to SEQ ID NO: 74677

SEQ ID NO: 75474 - DNA, 601 bp, Human; identical to SEQ ID NO: 74678

SEQ ID NO: 75475 - DNA, 601 bp, Human; identical to SEQ ID NO: 74679

SEQ ID NO: 75476 - DNA, 601 bp, Human; identical to SEQ ID NO: 74680

SEQ ID NO: 75477 - DNA, 601 bp, Human; identical to SEQ ID NO: 74681

SEQ ID NO: 75478 - DNA, 601 bp, Human; identical to SEQ ID NO: 74682

SEQ ID NO: 75479 - DNA, 601 bp, Human; identical to SEQ ID NO: 74683

SEQ ID NO: 75480 - DNA, 601 bp, Human; identical to SEQ ID NO: 74684

SEQ ID NO: 75481 - DNA, 601 bp, Human; identical to SEQ ID NO: 74685

SEQ ID NO: 75482 - DNA, 601 bp, Human; identical to SEQ ID NO: 74686

SEQ ID NO: 75483 - DNA, 601 bp, Human; identical to SEQ ID NO: 74687

SEQ ID NO: 75484 - DNA, 601 bp, Human; identical to SEQ ID NO: 74688

SEQ ID NO: 75485 - DNA, 601 bp, Human; identical to SEQ ID NO: 74689

SEQ ID NO: 75486 - DNA, 601 bp, Human; identical to SEQ ID NO: 74690

SEQ ID NO: 75487 - DNA, 601 bp, Human; identical to SEQ ID NO: 74691

SEQ ID NO: 75488 - DNA, 601 bp, Human; identical to SEQ ID NO: 74692

SEQ ID NO: 75489 - DNA, 601 bp, Human; identical to SEQ ID NO: 74693

SEQ ID NO: 75490 - DNA, 601 bp, Human; identical to SEQ ID NO: 74694

SEQ ID NO: 75491 - DNA, 601 bp, Human; identical to SEQ ID NO: 74695

SEQ ID NO: 75492 - DNA, 601 bp, Human; identical to SEQ ID NO: 74696

SEQ ID NO: 75493 - DNA, 601 bp, Human; identical to SEQ ID NO: 74697

SEQ ID NO: 75494 - DNA, 601 bp, Human; identical to SEQ ID NO: 74698

SEQ ID NO: 75495 - DNA, 601 bp, Human; identical to SEQ ID NO: 74699

SEQ ID NO: 75496 - DNA, 601 bp, Human; identical to SEQ ID NO: 74700

SEQ ID NO: 75497 - DNA, 601 bp, Human; identical to SEQ ID NO: 74701

SEQ ID NO: 75498 - DNA, 601 bp, Human; identical to SEQ ID NO: 74702

SEQ ID NO: 75499 - DNA, 601 bp, Human; identical to SEQ ID NO: 74703

SEQ ID NO: 75500 - DNA, 601 bp, Human; identical to SEQ ID NO: 74704

SEQ ID NO: 75501 - DNA, 601 bp, Human; identical to SEQ ID NO: 74705

SEQ ID NO: 75502 - DNA, 601 bp, Human; identical to SEQ ID NO: 74706

SEQ ID NO: 75503 - DNA, 601 bp, Human; identical to SEQ ID NO: 74707

SEQ ID NO: 75504 - DNA, 601 bp, Human; identical to SEQ ID NO: 74708

SEQ ID NO: 75505 - DNA, 601 bp, Human; identical to SEQ ID NO: 74709

SEQ ID NO: 75506 - DNA, 601 bp, Human; identical to SEQ ID NO: 74710

SEQ ID NO: 75507 - DNA, 601 bp, Human; identical to SEQ ID NO: 74711

SEQ ID NO: 75508 - DNA, 601 bp, Human; identical to SEQ ID NO: 74712

SEQ ID NO: 75509 - DNA, 601 bp, Human; identical to SEQ ID NO: 74713

SEQ ID NO: 75510 - DNA, 601 bp, Human; identical to SEQ ID NO: 74714

SEQ ID NO: 75511 - DNA, 601 bp, Human; identical to SEQ ID NO: 74715

SEQ ID NO: 75512 - DNA, 601 bp, Human; identical to SEQ ID NO: 74716

SEQ ID NO: 75513 - DNA, 601 bp, Human; identical to SEQ ID NO: 74717

SEQ ID NO: 75514 - DNA, 601 bp, Human; identical to SEQ ID NO: 74718

SEQ ID NO: 75515 - DNA, 601 bp, Human; identical to SEQ ID NO: 74719

SEQ ID NO: 75516 - DNA, 601 bp, Human; identical to SEQ ID NO: 74720

SEQ ID NO: 75517 - DNA, 601 bp, Human; identical to SEQ ID NO: 74721

SEQ ID NO: 75518 - DNA, 601 bp, Human; identical to SEQ ID NO: 74722

SEQ ID NO: 75519 - DNA, 601 bp, Human; identical to SEQ ID NO: 74723

SEQ ID NO: 75520 - DNA, 601 bp, Human; identical to SEQ ID NO: 74724

SEQ ID NO: 75521 - DNA, 601 bp, Human; identical to SEQ ID NO: 74725

SEQ ID NO: 75522 - DNA, 601 bp, Human; identical to SEQ ID NO: 74726

SEQ ID NO: 75523 - DNA, 601 bp, Human; identical to SEQ ID NO: 74727

SEQ ID NO: 75524 - DNA, 601 bp, Human; identical to SEQ ID NO: 74728

SEQ ID NO: 75525 - DNA, 601 bp, Human; identical to SEQ ID NO: 74729

SEQ ID NO: 75526 - DNA, 601 bp, Human; identical to SEQ ID NO: 74730

SEQ ID NO: 75527 - DNA, 601 bp, Human; identical to SEQ ID NO: 74731

SEQ ID NO: 75528 - DNA, 601 bp, Human; identical to SEQ ID NO: 74732

SEQ ID NO: 75529 - DNA, 601 bp, Human; identical to SEQ ID NO: 74733

SEQ ID NO: 75530 - DNA, 601 bp, Human; identical to SEQ ID NO: 74734

SEQ ID NO: 75531 - DNA, 601 bp, Human; identical to SEQ ID NO: 74735

SEQ ID NO: 75532 - DNA, 601 bp, Human; identical to SEQ ID NO: 74736

SEQ ID NO: 75533 - DNA, 601 bp, Human; identical to SEQ ID NO: 74737

SEQ ID NO: 75534 - DNA, 601 bp, Human; identical to SEQ ID NO: 74738

SEQ ID NO: 75535 - DNA, 601 bp, Human; identical to SEQ ID NO: 74739

SEQ ID NO: 75536 - DNA, 601 bp, Human; identical to SEQ ID NO: 74740

SEQ ID NO: 75537 - DNA, 601 bp, Human; identical to SEQ ID NO: 74741

SEQ ID NO: 75538 - DNA, 601 bp, Human; identical to SEQ ID NO: 74742

SEQ ID NO: 75539 - DNA, 601 bp, Human; identical to SEQ ID NO: 74743

SEQ ID NO: 75540 - DNA, 601 bp, Human; identical to SEQ ID NO: 74744

SEQ ID NO: 75541 - DNA, 601 bp, Human; identical to SEQ ID NO: 74745

SEQ ID NO: 75542 - DNA, 601 bp, Human; identical to SEQ ID NO: 74746

SEQ ID NO: 75543 - DNA, 601 bp, Human; identical to SEQ ID NO: 74747

SEQ ID NO: 75544 - DNA, 601 bp, Human; identical to SEQ ID NO: 74748

SEQ ID NO: 75545 - DNA, 601 bp, Human; identical to SEQ ID NO: 74749

SEQ ID NO: 75546 - DNA, 601 bp, Human; identical to SEQ ID NO: 74750

SEQ ID NO: 75547 - DNA, 601 bp, Human; identical to SEQ ID NO: 74751

SEQ ID NO: 75548 - DNA, 601 bp, Human; identical to SEQ ID NO: 74752

SEQ ID NO: 75549 - DNA, 601 bp, Human; identical to SEQ ID NO: 74753

SEQ ID NO: 75550 - DNA, 601 bp, Human; identical to SEQ ID NO: 74754

SEQ ID NO: 75551 - DNA, 601 bp, Human; identical to SEQ ID NO: 74755

SEQ ID NO: 75552 - DNA, 601 bp, Human; identical to SEQ ID NO: 74756

SEQ ID NO: 75553 - DNA, 601 bp, Human; identical to SEQ ID NO: 74757

SEQ ID NO: 75554 - DNA, 601 bp, Human; identical to SEQ ID NO: 74758

SEQ ID NO: 75555 - DNA, 601 bp, Human; identical to SEQ ID NO: 74759

SEQ ID NO: 75556 - DNA, 601 bp, Human; identical to SEQ ID NO: 74760

SEQ ID NO: 75557 - DNA, 601 bp, Human; identical to SEQ ID NO: 74761

SEQ ID NO: 75558 - DNA, 601 bp, Human; identical to SEQ ID NO: 74762

SEQ ID NO: 75559 - DNA, 601 bp, Human; identical to SEQ ID NO: 74763

SEQ ID NO: 75560 - DNA, 601 bp, Human; identical to SEQ ID NO: 74764

SEQ ID NO: 75561 - DNA, 601 bp, Human; identical to SEQ ID NO: 74765

SEQ ID NO: 75562 - DNA, 601 bp, Human; identical to SEQ ID NO: 74766

SEQ ID NO: 75563 - DNA, 601 bp, Human; identical to SEQ ID NO: 74767

SEQ ID NO: 75564 - DNA, 601 bp, Human; identical to SEQ ID NO: 74768

SEQ ID NO: 75565 - DNA, 601 bp, Human; identical to SEQ ID NO: 74769

SEQ ID NO: 75566 - DNA, 601 bp, Human; identical to SEQ ID NO: 74770

SEQ ID NO: 75567 - DNA, 601 bp, Human; identical to SEQ ID NO: 74771

SEQ ID NO: 75568 - DNA, 601 bp, Human; identical to SEQ ID NO: 74772

SEQ ID NO: 75569 - DNA, 601 bp, Human; identical to SEQ ID NO: 74773

SEQ ID NO: 75570 - DNA, 601 bp, Human; identical to SEQ ID NO: 74774

SEQ ID NO: 75571 - DNA, 601 bp, Human; identical to SEQ ID NO: 74775

SEQ ID NO: 75572 - DNA, 601 bp, Human; identical to SEQ ID NO: 74776

SEQ ID NO: 75573 - DNA, 601 bp, Human; identical to SEQ ID NO: 74777

SEQ ID NO: 75574 - DNA, 601 bp, Human; identical to SEQ ID NO: 74778

SEQ ID NO: 75575 - DNA, 601 bp, Human; identical to SEQ ID NO: 74779

SEQ ID NO: 75576 - DNA, 601 bp, Human; identical to SEQ ID NO: 74780

SEQ ID NO: 75577 - DNA, 601 bp, Human; identical to SEQ ID NO: 74781

SEQ ID NO: 75578 - DNA, 601 bp, Human; identical to SEQ ID NO: 74782

SEQ ID NO: 75579 - DNA, 601 bp, Human; identical to SEQ ID NO: 74783

SEQ ID NO: 75580 - DNA, 601 bp, Human; identical to SEQ ID NO: 74784

SEQ ID NO: 75581 - DNA, 601 bp, Human; identical to SEQ ID NO: 74785

SEQ ID NO: 75582 - DNA, 601 bp, Human; identical to SEQ ID NO: 74786

SEQ ID NO: 75583 - DNA, 601 bp, Human; identical to SEQ ID NO: 74787

SEQ ID NO: 75584 - DNA, 601 bp, Human; identical to SEQ ID NO: 74788

SEQ ID NO: 75585 - DNA, 601 bp, Human; identical to SEQ ID NO: 74789

SEQ ID NO: 75586 - DNA, 601 bp, Human; identical to SEQ ID NO: 74790

SEQ ID NO: 75587 - DNA, 601 bp, Human; identical to SEQ ID NO: 74791

SEQ ID NO: 75588 - DNA, 601 bp, Human; identical to SEQ ID NO: 74792

SEQ ID NO: 75589 - DNA, 601 bp, Human; identical to SEQ ID NO: 74793

SEQ ID NO: 75590 - DNA, 601 bp, Human; identical to SEQ ID NO: 74794

SEQ ID NO: 75591 - DNA, 601 bp, Human; identical to SEQ ID NO: 74795

SEQ ID NO: 75592 - DNA, 601 bp, Human; identical to SEQ ID NO: 74796

SEQ ID NO: 75593 - DNA, 601 bp, Human; identical to SEQ ID NO: 74797

SEQ ID NO: 75594 - DNA, 601 bp, Human; identical to SEQ ID NO: 74798

SEQ ID NO: 75595 - DNA, 601 bp, Human; identical to SEQ ID NO: 74799

SEQ ID NO: 75596 - DNA, 601 bp, Human; identical to SEQ ID NO: 74800

SEQ ID NO: 75597 - DNA, 601 bp, Human; identical to SEQ ID NO: 74801

SEQ ID NO: 75598 - DNA, 601 bp, Human; identical to SEQ ID NO: 74802

SEQ ID NO: 75599 - DNA, 601 bp, Human; identical to SEQ ID NO: 74803

SEQ ID NO: 75600 - DNA, 601 bp, Human; identical to SEQ ID NO: 74804

SEQ ID NO: 75601 - DNA, 601 bp, Human; identical to SEQ ID NO: 74805

SEQ ID NO: 75602 - DNA, 601 bp, Human; identical to SEQ ID NO: 74806

SEQ ID NO: 75603 - DNA, 601 bp, Human; identical to SEQ ID NO: 74807

SEQ ID NO: 75604 - DNA, 601 bp, Human; identical to SEQ ID NO: 74808

SEQ ID NO: 75605 - DNA, 601 bp, Human; identical to SEQ ID NO: 74809

SEQ ID NO: 75606 - DNA, 601 bp, Human; identical to SEQ ID NO: 74810

SEQ ID NO: 75607 - DNA, 601 bp, Human; identical to SEQ ID NO: 74811

SEQ ID NO: 75608 - DNA, 601 bp, Human; identical to SEQ ID NO: 74812

SEQ ID NO: 75609 - DNA, 601 bp, Human; identical to SEQ ID NO: 74813

SEQ ID NO: 75610 - DNA, 601 bp, Human; identical to SEQ ID NO: 74814

SEQ ID NO: 75611 - DNA, 601 bp, Human; identical to SEQ ID NO: 74815

SEQ ID NO: 75612 - DNA, 601 bp, Human; identical to SEQ ID NO: 74816

SEQ ID NO: 75613 - DNA, 601 bp, Human; identical to SEQ ID NO: 74817

SEQ ID NO: 75614 - DNA, 601 bp, Human; identical to SEQ ID NO: 74818

SEQ ID NO: 75615 - DNA, 601 bp, Human; identical to SEQ ID NO: 74819

SEQ ID NO: 75616 - DNA, 601 bp, Human; identical to SEQ ID NO: 74820

SEQ ID NO: 75617 - DNA, 601 bp, Human; identical to SEQ ID NO: 74821

SEQ ID NO: 75618 - DNA, 601 bp, Human; identical to SEQ ID NO: 74822

SEQ ID NO: 75619 - DNA, 601 bp, Human; identical to SEQ ID NO: 74823

SEQ ID NO: 75620 - DNA, 601 bp, Human; identical to SEQ ID NO: 74824

SEQ ID NO: 75621 - DNA, 601 bp, Human; identical to SEQ ID NO: 74825

SEQ ID NO: 75622 - DNA, 601 bp, Human; identical to SEQ ID NO: 74826

SEQ ID NO: 75623 - DNA, 601 bp, Human; identical to SEQ ID NO: 74827

SEQ ID NO: 75624 - DNA, 601 bp, Human; identical to SEQ ID NO: 74828

SEQ ID NO: 75625 - DNA, 601 bp, Human; identical to SEQ ID NO: 74829

SEQ ID NO: 75626 - DNA, 601 bp, Human; identical to SEQ ID NO: 74830

SEQ ID NO: 75627 - DNA, 601 bp, Human; identical to SEQ ID NO: 74831

SEQ ID NO: 75628 - DNA, 601 bp, Human; identical to SEQ ID NO: 74832

SEQ ID NO: 75629 - DNA, 601 bp, Human; identical to SEQ ID NO: 74833

SEQ ID NO: 75630 - DNA, 601 bp, Human; identical to SEQ ID NO: 74834

SEQ ID NO: 75631 - DNA, 601 bp, Human; identical to SEQ ID NO: 74835

SEQ ID NO: 75632 - DNA, 601 bp, Human; identical to SEQ ID NO: 74836

SEQ ID NO: 75633 - DNA, 601 bp, Human; identical to SEQ ID NO: 74837

SEQ ID NO: 75634 - DNA, 601 bp, Human; identical to SEQ ID NO: 74838

SEQ ID NO: 75635 - DNA, 601 bp, Human; identical to SEQ ID NO: 74839

SEQ ID NO: 75636 - DNA, 601 bp, Human; identical to SEQ ID NO: 74840

SEQ ID NO: 75637 - DNA, 601 bp, Human; identical to SEQ ID NO: 74841

SEQ ID NO: 75638 - DNA, 601 bp, Human; identical to SEQ ID NO: 74842

SEQ ID NO: 75639 - DNA, 601 bp, Human; identical to SEQ ID NO: 74843

SEQ ID NO: 75640 - DNA, 601 bp, Human; identical to SEQ ID NO: 74844

SEQ ID NO: 75641 - DNA, 601 bp, Human; identical to SEQ ID NO: 74845

SEQ ID NO: 75642 - DNA, 601 bp, Human; identical to SEQ ID NO: 74846

SEQ ID NO: 75643 - DNA, 601 bp, Human; identical to SEQ ID NO: 74847

SEQ ID NO: 75644 - DNA, 601 bp, Human; identical to SEQ ID NO: 74848

SEQ ID NO: 75645 - DNA, 601 bp, Human; identical to SEQ ID NO: 74849

SEQ ID NO: 75646 - DNA, 601 bp, Human; identical to SEQ ID NO: 74850

SEQ ID NO: 75647 - DNA, 601 bp, Human; identical to SEQ ID NO: 74851

SEQ ID NO: 75648 - DNA, 601 bp, Human; identical to SEQ ID NO: 74852

SEQ ID NO: 75649 - DNA, 601 bp, Human; identical to SEQ ID NO: 74853

SEQ ID NO: 75650 - DNA, 601 bp, Human; identical to SEQ ID NO: 74854

SEQ ID NO: 75651 - DNA, 601 bp, Human; identical to SEQ ID NO: 74855

SEQ ID NO: 75652 - DNA, 601 bp, Human; identical to SEQ ID NO: 74856

SEQ ID NO: 75653 - DNA, 601 bp, Human; identical to SEQ ID NO: 74857

SEQ ID NO: 75654 - DNA, 601 bp, Human; identical to SEQ ID NO: 74858

SEQ ID NO: 75655 - DNA, 601 bp, Human
ttcactggtttttgttcaagttcttatttatgcttctctttttacaactttgcattgttaataaaaattcagttttaactatagatgccttcttctcctcttgtgtttgatttattgctccaaatgggccaacctggatgtctatatttcttccactaaaatgcaaataacttactaggtagaatatccccatgttatttcttggtttgtttgttttcttttttttgaggcagggtcttgctctgtcacccagactagattgtagtggtgcaatcacagctcactgcagcctcaacctctygggctcaggtgatcctccaacctcaacctcctgagtagctaggaccacaggcatgcatgtggcccactaccatgcaaaattttttttaaaaaaatttgtagatatggggactccctatgttgcccaggctgatcttgaattcttgggctcaagcaatcctgcctcagcctcacaaagcgctggaattacaggtgtgagctattgctcctggccagtatttgaaataagttttttttcttggtatttggataggtttttgccaatccagaagactgtgtagcatttggcaaaggagaaaat

SEQ ID NO: 75656 - DNA, 601 bp, Human
cctggatgtctatatttcttccactaaaatgcaaataacttactaggtagaatatccccatgttatttcttggtttgtttgttttcttttttttgaggcagggtcttgctctgtcacccagactagattgtagtggtgcaatcacagctcactgcagcctcaacctctcgggctcaggtgatcctccaacctcaacctcctgagtagctaggaccacaggcatgcatgtggcccactaccatgcaaaattttttttaaaaaaatttgtagatatggggactccctatgttgcccaggctgrtcttgaattcttgggctcaagcaatcctgcctcagcctcacaaagcgctggaattacaggtgtgagctattgctcctggccagtatttgaaataagttttttttcttggtatttggataggtttttgccaatccagaagactgtgtagcatttggcaaaggagaaaatgccaagaagtatcttcgaacagatgacagagtagaacgtgtacgcaggtaaaccagtgtctcttgaaattacttactttatgaaacaattttggtcaaggagttcagtgaagatgtctcagggtcttggaga

SEQ ID NO: 75657 - DNA, 601 bp, Human
cctgggttcaaaccattctcctgcctcagcctcctgagtagctgggactacaggcatgtgccaccacgcccagctaattttctgtattttcagtagaggctgggtttcaccatgttggccaggttggtctcgaactcctgacctcaggtgatccacccaccttggcctcccaaagtgctgggattacaggcgtgagccaccggacctggccaaaattcattcctttttttttttttttttttttttttttacagctgtgtagtattccatggtgtatacgtaccacattgtctttatccarttcatattgatggacaactaggttgcattagcccttttttgattctctgtgaaagtctgaagcccctcccaagatttctgcagattcccttatggcatatcatctccaggttaactctggatctgggttcctgcctctatgcatgtttccatattctgcaattggttatgctggatgttaatccagccctttcatcagttcccttcaaaaatgaactaaaaaaaatgtggctaaaaatagacttgagtaagtggaagtgcagaggcgtttacactgtggcagcacaaacattttaagttg

SEQ ID NO: 75658 - DNA, 601 bp, Human
ctcctgcctcagcctcctgagtagctgggactacaggcatgtgccaccacgcccagctaattttctgtattttcagtagaggctgggtttcaccatgttggccaggttggtctcgaactcctgacctcaggtgatccacccaccttggcctcccaaagtgctgggattacaggcgtgagccaccggacctggccaaaattcattcctttttttttttttttttttttttttttacagctgtgtagtattccatggtgtatacgtaccacattgtctttatccagttcatattgatggacamctaggttgcattagcccttttttgattctctgtgaaagtctgaagcccctcccaagatttctgcagattcccttatggcatatcatctccaggttaactctggatctgggttcctgcctctatgcatgtttccatattctgcaattggttatgctggatgttaatccagccctttcatcagttcccttcaaaaatgaactaaaaaaaatgtggctaaaaatagacttgagtaagtggaagtgcagaggcgtttacactgtggcagcacaaacattttaagttgtatgttatttctctgtc

SEQ ID NO: 75659 - DNA, 601 bp, Human
ttttttgattctctgtgaaagtctgaagcccctcccaagatttctgcagattcccttatggcatatcatctccaggttaactctggatctgggttcctgcctctatgcatgtttccatattctgcaattggttatgctggatgttaatccagccctttcatcagttcccttcaaaaatgaactaaaaaaaatgtggctaaaaatagacttgagtaagtggaagtgcagaggcgtttacactgtggcagcacaaacattttaagttgtatgttatttctctgtcagacaatggccttcagcrtcctctctttgcagaatatgccccgtacctgtacctccttcacgcaagcaatgcccagtgttacaccatttttgaggctctcctctagccccacagactcttcaaccttttcagcactaaaattaaaagtaccttcttgctcatgcaaaacaattctacccccaagctattcatcaagcaagaatgtttctcttctaagaagaagtctgtgcagatacttagcacaaaatttcaccttctatctcacttagttatatacttcttaattcagcagccctgctgagtaaatcagtgagtctt

SEQ ID NO: 75660 - DNA, 601 bp, Human
ctgaccctcaggggtttatagtgttccccccctccccgcccccaaaagacccacatgcatataggaatgggagaatgatatgaagccatgttccattagttccatggaatatttcataaaggaagaccttgaagagtattaggatttgaaaggagaaagaggagagaagtctcatcaatttgggaaaattcctttgtgagaatgtgaacacatggctggctatgtgctgagggtgaagagctttggctgagatgagggcgtcaggaaaagcctgctgtgcagctccttttgtagttgttcwcagcctgacaatccccagaagcatgtagcaatggcagtccaggtcaggtggatgctgggatccaagtaattctgatctgagggaaggaggcgtggctgtggcctcaagagcacagagatggtgggaaggtccgtcacagagcaaatatatgccagggcatgtgtgtccaaaggagaaagaagaatgggaaaatgtaatcatggggaagaagggtaatagacccaggtagaaagtggactcttaggaagactgatgtccacctggtgatagattttggcagctgtccataaatggcactaa

SEQ ID NO: 75661 - DNA, 601 bp, Human
gtctcaaaagaagtacaaaatacagcataaattggcataagtatgagggtctgtggaaaacaggccttactagcatagtgaggagtgttatctttgagaacattttgagggctgacgaaagagaaagagaactcaaaagggagaataagataaagagaaaatgaggctagaaaaacatgcaggagctagaaaggtaaaggaacccctgccccttgaccttccttccctctaccctcatggtcctcttactgtccttgactttcttctctgctttaacattccattctatttgtcaactgcrtaacacaggcgtagaagtggacattgttttccagagagtctcctttttatagtttcttcctcaaccttaaaatgtctgtccttttggcatgttgtgaaggagaacactaacgtgcctaagattggaggtgacgatatctctgtgatgctgggggagaaatcacaggggcaaaacaaatactctaggtgtcattgacaaagtgggcccttctttaatagaaaatggtattcctgtcttttctttcccatctcattctcagtagtacttgtattgctccatgaaagagagggcacaggaaca

SEQ ID NO: 75662 - DNA, 601 bp, Human
aagtacaaaatacagcataaattggcataagtatgagggtctgtggaaaacaggccttactagcatagtgaggagtgttatctttgagaacattttgagggctgacgaaagagaaagagaactcaaaagggagaataagataaagagaaaatgaggctagaaaaacatgcaggagctagaaaggtaaaggaacccctgccccttgaccttccttccctctaccctcatggtcctcttactgtccttgactttcttctctgctttaacattccattctatttgtcaactgcgtaacacaggygtagaagtggacattgttttccagagagtctcctttttatagtttcttcctcaaccttaaaatgtctgtccttttggcatgttgtgaaggagaacactaacgtgcctaagattggaggtgacgatatctctgtgatgctgggggagaaatcacaggggcaaaacaaatactctaggtgtcattgacaaagtgggcccttctttaatagaaaatggtattcctgtcttttctttcccatctcattctcagtagtacttgtattgctccatgaaagagagggcacaggaacactcacaccat

SEQ ID NO: 75663 - DNA, 601 bp, Human
agaataagataaagagaaaatgaggctagaaaaacatgcaggagctagaaaggtaaaggaacccctgccccttgaccttccttccctctaccctcatggtcctcttactgtccttgactttcttctctgctttaacattccattctatttgtcaactgcgtaacacaggcgtagaagtggacattgttttccagagagtctcctttttatagtttcttcctcaaccttaaaatgtctgtccttttggcatgttgtgaaggagaacactaacgtgcctaagattggaggtgacgatatctcygtgatgctgggggagaaatcacaggggcaaaacaaatactctaggtgtcattgacaaagtgggcccttctttaatagaaaatggtattcctgtcttttctttcccatctcattctcagtagtacttgtattgctccatgaaagagagggcacaggaacactcacaccatcctctctttgcttttattctgtattgaagccttttcaaatcattacttagctgggctgctgctgtcctcttcatgtctctatgtagtcatcctctttgtgagacaagcttagagataatctagggaagaca

SEQ ID NO: 75664 - DNA, 601 bp, Human
ccctcatggtcctcttactgtccttgactttcttctctgctttaacattccattctatttgtcaactgcgtaacacaggcgtagaagtggacattgttttccagagagtctcctttttatagtttcttcctcaaccttaaaatgtctgtccttttggcatgttgtgaaggagaacactaacgtgcctaagattggaggtgacgatatctctgtgatgctgggggagaaatcacaggggcaaaacaaatactctaggtgtcattgacaaagtgggcccttctttaatagaaaatggtattcytgtcttttctttcccatctcattctcagtagtacttgtattgctccatgaaagagagggcacaggaacactcacaccatcctctctttgcttttattctgtattgaagccttttcaaatcattacttagctgggctgctgctgtcctcttcatgtctctatgtagtcatcctctttgtgagacaagcttagagataatctagggaagacaagacaaaggaaaggagaggaggagagtgacgatcgttgagcaggcaatatgtaataattatatgcttattgctatagaagagagtaacgt

SEQ ID NO: 75665 - DNA, 601 bp, Human
tcctgtcttttctttcccatctcattctcagtagtacttgtattgctccatgaaagagagggcacaggaacactcacaccatcctctctttgcttttattctgtattgaagccttttcaaatcattacttagctgggctgctgctgtcctcttcatgtctctatgtagtcatcctctttgtgagacaagcttagagataatctagggaagacaagacaaaggaaaggagaggaggagagtgacgatcgttgagcaggcaatatgtaataattatatgcttattgctatagaagagagtaaygtaaagcagaaatagttttcattttgaaatacatatcaatagctgacaaactatcaaattctccatttctagcctagattctaaagcaatttctaattctgtagacttaagggaggtgacattttaaaattaagtatttttaaaaatgttgctgggcatgatggcttgcacctataaacccagtgttttgggaggctgaggctggaggactgcttgagaccaggtgttcaagaccagcctgggcaacatagcaagaccccatctctaaaaagaaaatttaaaaaattagccaggcatggt

SEQ ID NO: 75666 - DNA, 601 bp, Human
gctgaggctggaggactgcttgagaccaggtgttcaagaccagcctgggcaacatagcaagaccccatctctaaaaagaaaatttaaaaaattagccaggcatggtggtgaggcctgtagtcccagctactcatgatgctgagactcaggagtttgaggctgcagtgagctatgattgtaccactgcacttcagcctgagcaacagagcaagaccccctctctaaaaacaacaatagcaatgacaacaataataataaaaatgtcaagtccatagtagatgtgttttgtattcggtcttarccagagaaacccaagatgccacggtttggagcaaaactgtggctaaaacatgctttttgttttcttctagctctgttataaagaaaacatttaggaaattctctctttctctctttcacctatcctactttttgtgtgtcctttgtagttttgcaccatcattcctaacgaatttatttggcatttggaagataggttagcaaaaattttactatatttgaaaggctagttatgtattctgttatttagatataagagcatgagagtcttgatattaaattggtaaattaattattggca

SEQ ID NO: 75667 - DNA, 601 bp, Human
gatgccacggtttggagcaaaactgtggctaaaacatgctttttgttttcttctagctctgttataaagaaaacatttaggaaattctctctttctctctttcacctatcctactttttgtgtgtcctttgtagttttgcaccatcattcctaacgaatttatttggcatttggaagataggttagcaaaaattttactatatttgaaaggctagttatgtattctgttatttagatataagagcatgagagtcttgatattaaattggtaaattaattattggcaacctagtggtttggrttggcaaggattctgtcagtaatcatttggtagagtagcagaagcaaaggaggtgtcttaagaaaaatcaacaccaaaagggttttcttccttcgggagaaagaatttttataaaaagaatcttgaattgctaattgttatgaacctcataagaaaaaagtatttttatttacaaaaatgaaatgagttctattagatagatgtcgttttgatattctaggaactacaaaatgccttctgtgatatttaaagatacactaaaaataaaaagaaacagaaataatgagagattctaaataa

SEQ ID NO: 75668 - DNA, 601 bp, Human
taagaaaaaagtatttttatttacaaaaatgaaatgagttctattagatagatgtcgttttgatattctaggaactacaaaatgccttctgtgatatttaaagatacactaaaaataaaaagaaacagaaataatgagagattctaaataaaagtcaagtgggcaaggaagcaagacaatttgagagaaaaaaaataaatcttactttgaaatttaaggatccattagtgctcagatttagtttttagaagagagagaaaaaaggatacatatctagtattttgaaattagtgtctttaayagttatctttttccacagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttt

SEQ ID NO: 75669 - DNA, 601 bp, Human
ttacctggttgggagataaggaaatggatacttaaaaggtattagatggagaaagtagcttataagatgggatttgaaaaagtttggtccagggtgatgtggtgggaaaaacatcatggttggataaaaacagcataagcaaaaacaaggaaagggggaattgcatgtatacgaaacaacaaacaaaaggagagaaacatgagaatggaagggtagatcaaggttagattgtggataaccttgatttccagggcgaacagttgtacttaaatcaatagaacatggaactggcgtgctttayagcagaagaatgaagtgactgagagctttaagaagattgttctcacagcatgaaaaagtagaggcttaaagactgcttcgaaagcagggttaaaaaaaatgatagtagcttgaactagatatgaaaatgaaaagggaaaaaactggatacaggagatgttgagaaaataaaattgatgttggctataagcaagagaatgaagtcacagaagaatctgtggttttgaatctgggtgatcaagaggatagtatacctttcatagagaatttcaaaaggaataagtggtttaagataccagga

SEQ ID NO: 75670 - DNA, 601 bp, Human
tgagaagagacttacctggttgggagataaggaaatggatacttaaaaggtattagatggagaaagtagcttataagatgggatttgaaaaagtttggtccagggtgatgtggtgggaaaaacatcatggttggataaaaacagcataagcaaaaacaaggaaagggggaattgcatgtatacgaaacaacaaacaaaaggagagaaacatgagaatggaagggtagatcaaggttagattgtggataaccttgatttccagggcgaacagttgtacttaaatcaatagaacatggaactrgcgtgctttatagcagaagaatgaagtgactgagagctttaagaagattgttctcacagcatgaaaaagtagaggcttaaagactgcttcgaaagcagggttaaaaaaaatgatagtagcttgaactagatatgaaaatgaaaagggaaaaaactggatacaggagatgttgagaaaataaaattgatgttggctataagcaagagaatgaagtcacagaagaatctgtggttttgaatctgggtgatcaagaggatagtatacctttcatagagaatttcaaaaggaataagtggttta

SEQ ID NO: 75671 - DNA, 601 bp, Human
tgctctatccttaggcactacaaattactcatttaattccataaacatacattgtagcctttctctatggcagacattgtgcaagtgagtaactgacaagccctgctctaagggccttaaaagctaataaaatacatgaatcagataaataacaagagaagtaccaatcgttatgagaagagacttacctggttgggagataaggaaatggatacttaaaaggtattagatggagaaagtagcttataagatgggatttgaaaaagtttggtccagggtgatgtggtgggaaaaacatcayggttggataaaaacagcataagcaaaaacaaggaaagggggaattgcatgtatacgaaacaacaaacaaaaggagagaaacatgagaatggaagggtagatcaaggttagattgtggataaccttgatttccagggcgaacagttgtacttaaatcaatagaacatggaactggcgtgctttatagcagaagaatgaagtgactgagagctttaagaagattgttctcacagcatgaaaaagtagaggcttaaagactgcttcgaaagcagggttaaaaaaaatgatagtagcttgaact

SEQ ID NO: 75672 - DNA, 601 bp, Human
tttttaatagtcatattaacttttgatgctgtgcaatgtgctaccgaatgaagaaaagcttgtcaaatcaacttgcccagcccagcagtgctttaaaacctaaatgaaagttaacaatttaacaactttcacagcatctgcctatgggctgcatatgactatagtttctctggaagataccaaaggctatgcagagaattctagatcaggtgattttactacccctgttttgttgttgttgttttaaatatgtgtttctctactggcaaatctattatgccaaacttgaaaaatgcggttyccgaaatgagtactatcaagagaaacaatactatcgagagttaacagtactatggctgtgcctatacacacatacaaaaaataaaaggatccaggaaggaaggcaaaacaggaatgagaactggtactctgaatctatggtacttttccccagaattatttttagaaaattcccctgatttaatatggataatttaatgacagcagaaacaaacaggtgcaattctctgataagcaaaatgaggataagtagatgttcaaaaactgctctaaatttacttcttatgagctattttctggc

SEQ ID NO: 75673 - DNA, 601 bp, Human
tgtggccttgggcaaattacttatcctctctgtgccttactttcctcatctgcaaaatagggataataagagtagttctgtaaagtgcatggactagcaagcactgtgcgcgcgcgcgcgcatgtgtatgtgtgtgtgaaccctatgtgtacctgtcgattttaaatgacagctcttctttgaaagctaactaccctcctgtctaaatcctcttcctgactggtcccccttgccaaccaacagcattttgtttatgactcactcctaaggtatatcatgccttatattacatacacttctrtctcttccactagacttctagcctttaagggtttaggttttttcatcctatgacgcttagtccttcgtatgtagaaggttaaataaatgtctcattagatccatgtaattaacaaagaatggtacttaaggcattataggtggtaaatgcttacctggctttcatccaagttcctcccaatgacatccacagctgccgttcatcaccattgacagtataatttaagaaatcaattgtgtccttattcaataggggactaagtactgaactggctagttcaggacctcctgttgcctgcac

SEQ ID NO: 75674 - DNA, 601 bp, Human
ccttcacttctgcttctctctctacctggacaggcccttgccctactatggaactgtggaaatcctacccaacctgctaaaaggcagtttagcaaaccaatgatgaacactgactccaggagctacatggcacgagttcacatccctgctctgtcacttacaagttgtgtggccttgggcaaattacttatcctctctgtgccttactttcctcatctgcaaaatagggataataagagtagttctgtaaagtgcatggactagcaagcactgtgcgcgcgcgcgcgcatgtgtatgtgtrtgtgaaccctatgtgtacctgtcgattttaaatgacagctcttctttgaaagctaactaccctcctgtctaaatcctcttcctgactggtcccccttgccaaccaacagcattttgtttatgactcactcctaaggtatatcatgccttatattacatacacttctatctcttccactagacttctagcctttaagggtttaggttttttcatcctatgacgcttagtccttcgtatgtagaaggttaaataaatgtctcattagatccatgtaattaacaaagaatggtacttaaggca

SEQ ID NO: 75675 - DNA, 601 bp, Human
gcccttccacaatgatctgctaccccgaagtccatattccagagaaacacatcttcatcctttcttctcttgactaccttatgccttcacttctgcttctctctctacctggacaggcccttgccctactatggaactgtggaaatcctacccaacctgctaaaaggcagtttagcaaaccaatgatgaacactgactccaggagctacatggcacgagttcacatccctgctctgtcacttacaagttgtgtggccttgggcaaattacttatcctctctgtgccttactttcctcatcygcaaaatagggataataagagtagttctgtaaagtgcatggactagcaagcactgtgcgcgcgcgcgcgcatgtgtatgtgtgtgtgaaccctatgtgtacctgtcgattttaaatgacagctcttctttgaaagctaactaccctcctgtctaaatcctcttcctgactggtcccccttgccaaccaacagcattttgtttatgactcactcctaaggtatatcatgccttatattacatacacttctatctcttccactagacttctagcctttaagggtttaggttttttcatccta

SEQ ID NO: 75676 - DNA, 601 bp, Human
aagagagagaggtaattcaggacagggtaacattcagactttgattctagaacaattttcagttgaataaaatgagaacttgcaatcagaattacaagagaatacacagataattacactgtctacagagggcaatgttaaaaaaaaaactacctctgtggataatctttttatttcctgtttgcgctgatgttctgctacatttgccacagattctgccagttgataaagatcttgttccattgtggctcccataaagttcagcattgggggctcccagccattgcggaatcgtggaacrtatggtggaataaactgttcttttggccactctgctctgcaggagggaatgaaggcatataaacaataaaatctaggaatgtatccacgctcacagttatcttcagtaaggctagacatacacacgcacacacacataaataacaaacaacaaaaacagcacatagacctaatctgtcttccatccacccaaaaagaaaaagcaaacatgtttatgccagtatttcacaccttaataaaatgaaagaaagattgaattctgttgcatgatctgttttcccaacattgcctcatttctcca

SEQ ID NO: 75677 - DNA, 601 bp, Human
caaaagggaagaaagaaaacaaacagaggagaagagaggcaaagcaacgtgaagagaaggagagaaattaattaactgggggaattcaggaaacagctgcttaagacaggttagaggatctaggttcagggaactgtcttgagggcctgataatgggagaggaaaacataaagaaataagccaaagggcagtagtgcaattccctgacaaggagagaaagtcatcctaaaaaagctgacttaggatcgccagagccaggaaaacagtggcaacaaggggaggggtgggggctgacaggctrtaggagagcaatttgggttggggttgggcttcacggaggaacagagcaactgtcacaaaaaatgacagaggcaagagagagaggtaattcaggacagggtaacattcagactttgattctagaacaattttcagttgaataaaatgagaacttgcaatcagaattacaagagaatacacagataattacactgtctacagagggcaatgttaaaaaaaaaactacctctgtggataatctttttatttcctgtttgcgctgatgttctgctacatttgccacagattctgccagttgata

SEQ ID NO: 75678 - DNA, 601 bp, Human
ttaatagttttggttcagttttagacagaagcaaccttttaaacagaaaagtcaacttatggctcaagccaagaatcagaattaaagaaaaagacaagactgaacagtaaacagcaaaaggtaagagatattaaacttttcaggaatatcaggcaggagaaaattcctattatagaattcatactatttgcatgttttttattttatcgcagtttgcttattcctagcaaccacacacacaaataaaacaaatttggataattgttttcaaaacttaaaatataaactcttgccttttgcycacatatggggatcagggatatcctttatgaatagtgcttctcatagcttaccatgacctgcatattaaaattagttgatatagcccaaaggtatgtactctaccattattttaagtataggtttcaagcatatactacctctatgggaaagaaaatgaagaactggtattcatgaaccagacagaagcatatattatattaggtaaacagatattaaactcagaaaagtaggaactaagaaaagaaaaaggtataaaaactaagaaaattcacttcaaaaacccatgggaaatggagga

SEQ ID NO: 75679 - DNA, 601 bp, Human
gtagagatataaaacagtagatatgggtatctactgttgtagagatatgaaacagtagatatgggtatctactgttgtagagatagaaaaatgactggcacatatttccaaggatgttttcttttccattttactctattctttttttaaagaatatattataaatgttttgagaataggaatccttttagagtaggatttatgccagatagcagatagcaaagcagactgtgaagcttgcttattaaaattttacaaggtcttagtggttttgttgagctcagcccaaaattttcaggakgtgttaaaaagcagattgtttttaatacattttcaaagtagggccctcaacctgaacagcatacgcttctgcatacacacagaaagcttctgtacacatttctacacacaccactacatttgtagttgcaacccgaatttttaagaagagagtaggatagtgttgaaaagtttaaaacgaaatagccaaataggcaatccctataagaaccacaagtttctatttacataaagtagcaaaacaaactcctgaaacttgtgaactcttaaaaacatttcttgggttgtgccaaagttgaca

SEQ ID NO: 75680 - DNA, 601 bp, Human
tgtgatagcccacaaacacaaagttctgttaaaagcaaaatctatctttttgtctctctttctctgaaagaaggcagaattaatagacctcataggaaatttactttcctattgataattaagttggaatgagtcacttttctttagcaacttaagctgagtagaaattctaaagaattaaagaatgctattgagagataagatcctgattcatacaagatgctgcttcagaggggaaattatgcaagtaagcgcaacaaagccattaaaattgaactgttcttaaatatttaacctactstaaattacacatttttcctctaaatttggttatttgggaactctgcagtgaaaactaagcacagctggaacatttggagggtgttaagttgagagactgaatccaaaaaattatattaaaaagaagtgccatgagggaacgaatgtgggttacctctgacagctcgccaagtaattgctattaggaaaatggagcaaatcacatcaaatgagaaaattaatacaggaaatggaattaaaataatatcaattataattcacatcaaatatcagaaagagtaaattagcctgacagtaaaat

SEQ ID NO: 75681 - DNA, 601 bp, Human
tatccaaaatccaatgatttcactgtattttttctgttgccagcttggtctgagttaccagcctattaacagatctctctgcttccactccctaccaccctacccatttctcttcattctcttctcagtataacaactaagtgattcttttaaaatgtaagtcaggctaggtggctcatgcctgtaatccaagcactttgggaggctgaggcaggcggatcacaaggtcaagaaatcgagaccatcctggccaacatggtgaaacccagtctctactaaaaatacaaaaattagctgggcrtggtggcatgtgcctgtggccccagctactcgggaggctgaggcaggagaatcgcttgaacccaggaggcggaggttgcagtgtgccaagatagcgccactgtattccagcctggcaacagagcaagactccgtctcaaaaaaaaaaaaaaaaaaaaaatgcaagtcagatgttgcagcccctctgctcaaaacattcccaagtgatcctaattactcccagtaaaaggccctacaagacctccaccactctaaagccactccacaactcttctggagcccttcactcttgctcccaatg

SEQ ID NO: 75682 - DNA, 601 bp, Human
attgttatgtcaaaattaaatttcctatagaattagtcaatacatataaaatgagaacattatgctttttgtcaagtttccaaaagtatgtgctcaagcttcacatcatatgagcatttataacaaattaaccttctggaaactgtcattgatgatctcagtgacaaatttacaaaagcagagttaaatttaattcagctctgttaagaaagggaaattggccaatatggacataaatagttgtttccagagctttcaatttgcagaaaaacaccaccttaggttgacaagtcatacctcyaatgcagctttttgtacagtgatttggctatagactctcgccccttcagggcagactgtcctcagttcatccttattgagagagaaaagttgtgcaccatttaatactccaagactattgacagtcctaaaaaaaaaaaaaggaaaaagaaactgagcattaaaaatattgcctacaaacaaaggagaaaattatctgttcctgctagtaacttctcttttctaagcgttccataccctggaacccttattaaatgccactacagtctttatagttagggcaatgacaagtttctttcat

SEQ ID NO: 75683 - DNA, 601 bp, Human
atctttcttgaccgggcgcggtggctcatgcctgtaatcccagcactttgggaggccgaagcgggtggatcacctgagatcagaagtccgagaccagcctggccaacatagtgaaaccccgactctactaaaaatacaaaaattagccgggtgtggtggtgagcgcctgtaatcccagctactcaagagactgaggcaggagaatcacttgaacacgggaggtggaggttgcagtgtgccaagatcatgccactgcactccagcctgagcaagtgtgagactctgtttcaaaaaaaaaaaatcttcttgcctttacccagtgctgtctgcttttctggagccccaaaccaccccctttgccccatccttccctcctgtctttcccccacccccttgccccatcctttccccatctgctcccttcctcatatttggccctgtccttaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgt

SEQ ID NO: 75684 - DNA, 601 bp, Human
aagaagctccatttaaatctgcattatatattgcactgctacatagtattttgcttgcagattttacagcttgaaaaaaaagtttgaaactcagtgcactcaactttttagtagtcaaaaagtgaacaaatcttcctcacatgtgctctttggggatcatgggggctgatttcccctacttttttttttttttttgagataagttcttgctctgtcacgcaggctgaagtgcagtggcatgaacgtggctcactgcagcctcaaccacctgggctccagtaatcctcctgcctcagcccccaagtaggtgggactacaggcatgcaccaccatgccaggctaatttttatatttttttgtagagagtgggtttcgccatgttgcccaggctggtctcaaaatggtctcgaactcctgagctcaagtgatccacccacctcggcctcccaatgtgctgggattacaggcatgagccaccacacacagcctcccctactctttttctttttttttcttttctttttttttttttttgagatggattctcactctgttgccaggctggagtgcagtgacgcgatcttggctcactgcaacttct

SEQ ID NO: 75685 - DNA, 601 bp, Human
atagtaaccggtgtgctgcctggatgtattgacacctaatggggtgatttaatgactttatccagctttaaagcccagccctgctcccctcttccaaaccactttttcctcgatggttattatctcagaccttcttaaccgtggctctcccctccttcagaatatcctccttgtggaaccctgcccagttctaagatctttgtattcctttggcacttgtagactcatgctatctgaatctgcacctattcatagatttatttatacaagcagttttgaagtaatcatgcttgcatttctyatttcatgagtgaggtcttggggagaaggaacaggagctctgcttgtcaagtctcctcccctccctatccgctactatttactgcatgcagtagataactggtgacatggactgagcacatttgaggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaa

SEQ ID NO: 75686 - DNA, 601 bp, Human
tcagaccttcttaaccgtggctctcccctccttcagaatatcctccttgtggaaccctgcccagttctaagatctttgtattcctttggcacttgtagactcatgctatctgaatctgcacctattcatagatttatttatacaagcagttttgaagtaatcatgcttgcatttcttatttcatgagtgaggtcttggggagaaggaacaggagctctgcttgtcaagtctcctcccctccctatccgctactatttactgcatgcagtagataactggtgacatggactgagcacatttraggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaatcccagcactttgggaggccgaggcaggcggatcacctgaggtcaggagttcgagaccagcctggcccatatggcaaaaccccatctctactgaaaatacaaaaattagctgggcgtggtggtg

SEQ ID NO: 75687 - DNA, 601 bp, Human
tatttactgcatgcagtagataactggtgacatggactgagcacatttgaggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaatcccagcactttgggaggccgaggcaggcggatcacctgaggtcaggagttcgagaccagcctggcccatatggcraaaccccatctctactgaaaatacaaaaattagctgggcgtggtggtgcacacctgtggtcccagctactcaggaggctgaggcaggagaattgcttgaaccagaaggctgaggttgcagtgagctgagatcgcgccactgcactccagcctgggtgacagagcaagactccatctcaaaaaaagaaaaaagaaaaagaaaatggggcctgcccattaaatggaccaacacacaacacttgataaacatcagggtgaaagtacaggaagtgactcaccaagaagccttgaatggaaaagt

SEQ ID NO: 75688 - DNA, 601 bp, Human
tgataaacatcagggtgaaagtacaggaagtgactcaccaagaagccttgaatggaaaagtgtagcagatggttgctaaaagaaatctgacaaagcctggggaactctgtagggtgcagagactttgacaatgtgtatgagagacattctctaggtatcattactttagctcatgttttgttgcattttagtcttctcagcaggaagactgtttccaagaaaaatgtattatttattgaccaggcgcggtggctcatgcctgtaatcccagtactttgggaggccgaggcaggcagatcaygaggtcaagagatcgagaccatcctggccaacatggtgaaatcctgtctctactaaaaatacaaaaattagctgggcgtggtgacatgcaccagtagtcccagctactcaagaggctgaggcaggagaattgcttgaacctgggaggcagagcttgcagtgagccgagatcatgcaactgcactctagtctggcaacagagcaagactctttgtctcaaaaaaaatttttttatttattttacaaacacttatgtggtagttaccatatatgccacatatttatgagataggtactatta

SEQ ID NO: 75689 - DNA, 601 bp, Human
ggattacaggcatggtgtcttcatttctttatctgtgtctatgtgtcaacccacctccttgtctctgtctgtctgaccttgtccttctgtcttccttggggtcctctccacctgctcagctcagggattgggttaggggcttccagaaagacagaagcttgtcaggagaactggggctgggacagctgtgccttctcttctctcagcaacccctgagttgtgtactcttcccaggcgctcccacctagcagccctctgtgcccagcactctcactcccatctcagcccccagggccagtgyggtggtccccatgctgctgcagtgggggaaatagggctcagagaggcgactggcccaatgccaccagcccagcaggtgtgtggcagagctgggtcttgagcccagccctgctccacaacaatgcctcctcttgcggccgtgtttgtaaaagcccatgttgctgctgctgagcccagggaggaagtgggggctccatccaccgagcagagaaggacccctgagtcctcaaatactctggctgggcctggagtcagctgcggaggggcagagatctactgctgggtgctctgtgaccttgcg

SEQ ID NO: 75690 - DNA, 601 bp, Human
gcgtaaaagtgatttctacatcaaagcatctccttggctgggcccttggagactgggcaggggctgggtctcattaatctctgtgaacttgggcccagcacggccagcccagttgctccagggatgagcaagagggcgggagaggcagtgagggcctctggccagagccggcctccttggtggcctcctgccctgccctggtcacaagctgggggagggtgctggggagctctcgaccccgtccgtgtctctccctgctgcctctttgtctctgtccctctgttcttctctgtctctgacraactctcctatgtgtgtgcctccctgtgcatatctttctgtctctatagaactatttctgtctttctgtctctttgtctttttgggtctgtctgtttctccctctctgtgggtctctgtctcagtctctgtcctgtctctgtgcatctgcctctctgtccacctgtctttatctctctctctctgtttctccctgtgtctctctctgtctccatctcagtctccacctgtcccatccacctgccctgcacactcaccgcccgatgtgggacacctttatgcggctgtcgggcaccagctc

SEQ ID NO: 75691 - DNA, 601 bp, Human
gtggcactatcagggttcccattttagagaagaggaaactgaggctcacagagattataattgacccatggtcatgagtggcaaagctggagctgggccccaggacccccacttttgatccttgctcttccctctgtgagtggaggggaggcctgcgtgggtgggttgcgggaaagtgagcagaaccaagactcaggggccccaagacttaccctgcctgggtacgaagtcaatcttgacctctgcaagagaaggaagagcaagtagcacgggggcaaaggcagggcccagtgacaggggytcctggccccactgccccgacccaccctaccctggagcaggctcacccatgaagtggagcttggctgacaggttgcaggcgaagccctcgggcacaaagctgtagtcagcctcgtcggcaggtgtgacgtcgtcaatggtcagtttgtggaccctgcaggggagcagtggctcaggggaccccactgggccacacacccctggccttgccagataccccagccagggtcccaggaggccctcaccttgtcctggcttgttggtattctgatttttaaaaatgcctttttttttctatatt

SEQ ID NO: 75692 - DNA, 601 bp, Human
ccgagatcgcgccacttctctccagcgtgggcgacagagggagactccgtctcaaaaaaaataaaaataaaaaaaaaggaagaagaagaaaagatgtaataataacagtcacacgtgtgacagcacttgacaggtctgatacatcatgtcacctcatctttataactatcctatgaggtggcactatcagggttcccattttagagaagaggaaactgaggctcacagagattataattgacccatggtcatgagtggcaaagctggagctgggccccaggacccccacttttgatccttsctcttccctctgtgagtggaggggaggcctgcgtgggtgggttgcgggaaagtgagcagaaccaagactcaggggccccaagacttaccctgcctgggtacgaagtcaatcttgacctctgcaagagaaggaagagcaagtagcacgggggcaaaggcagggcccagtgacaggggctcctggccccactgccccgacccaccctaccctggagcaggctcacccatgaagtggagcttggctgacaggttgcaggcgaagccctcgggcacaaagctgtagtcagcctcgtcggcaggt

SEQ ID NO: 75693 - DNA, 601 bp, Human
ccccgtctctactaaaaatacaaaaaataattagctgggcatggtggcgggcgcctgtagtcccagctactcaggaggctgaggcaggagagtggtgtgaacctgggaggcggagcttgcagtgagccgagatcgcgccacttctctccagcgtgggcgacagagggagactccgtctcaaaaaaaataaaaataaaaaaaaaggaagaagaagaaaagatgtaataataacagtcacacgtgtgacagcacttgacaggtctgatacatcatgtcacctcatctttataactatcctatraggtggcactatcagggttcccattttagagaagaggaaactgaggctcacagagattataattgacccatggtcatgagtggcaaagctggagctgggccccaggacccccacttttgatccttgctcttccctctgtgagtggaggggaggcctgcgtgggtgggttgcgggaaagtgagcagaaccaagactcaggggccccaagacttaccctgcctgggtacgaagtcaatcttgacctctgcaagagaaggaagagcaagtagcacgggggcaaaggcagggcccagtgacagg

SEQ ID NO: 75694 - DNA, 601 bp, Human
acatgcacgcacacatgcacacattaaaaaggttccctggccaaataaatcaggaatctgccctcagttaaacaaagcaaagcagtctggacgcagtggctcacgcctgtaatcccagcactttgggaggccgaggcaggcagatcatgagatcaggagatcgaaaccatcctggctaacatggtgaaaccccgtctctactaaaaatacaaaaaataattagctgggcatggtggcgggcgcctgtagtcccagctactcaggaggctgaggcaggagagtggtgtgaacctgggaggcrgagcttgcagtgagccgagatcgcgccacttctctccagcgtgggcgacagagggagactccgtctcaaaaaaaataaaaataaaaaaaaaggaagaagaagaaaagatgtaataataacagtcacacgtgtgacagcacttgacaggtctgatacatcatgtcacctcatctttataactatcctatgaggtggcactatcagggttcccattttagagaagaggaaactgaggctcacagagattataattgacccatggtcatgagtggcaaagctggagctgggccccaggacccc

SEQ ID NO: 75695 - DNA, 601 bp, Human
agatctggaacattcccatcaccccaggacgttggctgggaggcttgtaatattcaggtcaggtcacctagcatagcattttgaaaactgggggaacatcagtgtcttgccacacacatacacacacacacaatacacacacacacacgcatatacacatacacacagacacacatacacatacacacatgcacacacagacacacacatgcacacagacacaaatacacatacatacacgcacacacacagacacagacacacatatatacatacacacacagacacatgcacacacacrcacgcgcgcacacatgcacgcacacatgcacacattaaaaaggttccctggccaaataaatcaggaatctgccctcagttaaacaaagcaaagcagtctggacgcagtggctcacgcctgtaatcccagcactttgggaggccgaggcaggcagatcatgagatcaggagatcgaaaccatcctggctaacatggtgaaaccccgtctctactaaaaatacaaaaaataattagctgggcatggtggcgggcgcctgtagtcccagctactcaggaggctgaggcaggagagtggtgtga

SEQ ID NO: 75696 - DNA, 601 bp, Human
ctccatggagacctcgccaagggctcggcaccacgtaggtagaaagtgatgaaagacaaacgagcctcctcctgacctcagtctcactcaccttcttgtcaaacacccactcatcgctgtcacctgtgtcctctggggcatctggggctggcctggctggggccttattcccctgggaacagggcaggagggaagtagggagcagaggagctgactcagcctggaagcgcccctctgctgcttcttccaccccctgacccacactgcccaccttgcctgccccctgaccagtctctcccayggggtagccaacagcagggcgtgcacatgtgggtggggtgtgcagcaggtcctagcacttggctggttccacacacccatcttatagatggggagactgaggagggacccacagtacctgcgtgatagccttctgccagatcacagtgggagcagggtccccagagatagggacgtccagacgtagcttatttccagctacaaccacaatggtgtctggtatgcggcctgggcagtccaggtggatcttgggaggttctgcagaagacacaatgtagttcagagaaacgggagagccagg

SEQ ID NO: 75697 - DNA, 601 bp, Human
tccggtgcccttgcactcacccaggatgggctgcccgccatcgtaggcaggcggctcccactgtactgtgcaggagtcctctcccacgttgctgatcttgggggccgcaggtgcgtctggcacgtctggatggggtgggatggacccacatcagccctgccccgctcagggccttgagtaacgttgctcgtccccttcccactccaactaaccgccacaggctgcccccaccacccccagatccaaagagatctttctagaatgcatttctttcttcttttcctttttttttttttttttttagtgatatggagtctcactgtgttgtccaggctgggtctcaacaggatgcatttctgatcatgtcgccagccctccgtcaaccctttaaggcttctcactgcccatattcacccctgtcctggctctgatcctcccaaccccacccagtcctctcctgacatgtttcattcattctccacacccaaaaggccctttccctcctccacccctttgtacacagtttcctctgcctgggatgcctttcctcaccatcttctcagcctcctaaaggcatcacccccaggcacagggatggctc

SEQ ID NO: 75698 - DNA, 601 bp, Human
caggcacggtggctcacgcctgtaatcccagcactttgggaggccgaggtgggaggatcacctgaggtcaggagttcaagaccagcctggccaacatggtgaaactccgtctctacaaaaatacaaaaattagctgggcatggtggtggatgcctgtaatcccagctactcagaaggctgaggtgggagaattgcttgaacctgggaggtgaaggttacagtgaccccagatcgcgccaggactgcactccagtctgggtgacagagcgagactccatctcaaaaaaaaaaaaaaaaaaawaaaactaaaactaaaactacagaaaacatgggaatttcctggcacgtatgattaggtgagttgactaagaactgaacaaaccaggaatcagtccctaaaacgagaggcctggacccttctccccacaggccccgattcctgccatcttcccaagctgtgccccatccctgggcccaggggtccttggcctgcccttgccacaggcagctgcccccggactcacccaccctagtgggaacaggtgtcctcctgagccctgccacagtctcaacacctgttctgcccactcagaccccatta

SEQ ID NO: 75699 - DNA, 601 bp, Human
ccaggcacggtggctcacgcctgtaatcccagcactttgggaggccgaggtgggaggatcacctgaggtcaggagttcaagaccagcctggccaacatggtgaaactccgtctctacaaaaatacaaaaattagctgggcatggtggtggatgcctgtaatcccagctactcagaaggctgaggtgggagaattgcttgaacctgggaggtgaaggttacagtgaccccagatcgcgccaggactgcactccagtctgggtgacagagcgagactccatctcaaaaaaaaaaaaaaaaaamaaaaactaaaactaaaactacagaaaacatgggaatttcctggcacgtatgattaggtgagttgactaagaactgaacaaaccaggaatcagtccctaaaacgagaggcctggacccttctccccacaggccccgattcctgccatcttcccaagctgtgccccatccctgggcccaggggtccttggcctgcccttgccacaggcagctgcccccggactcacccaccctagtgggaacaggtgtcctcctgagccctgccacagtctcaacacctgttctgcccactcagaccccatt

SEQ ID NO: 75700 - DNA, 601 bp, Human
cttaaaaacaaacagcaacagcagccaggcacggtggctcacgcctgtaatcccagcactttgggaggccgaggtgggaggatcacctgaggtcaggagttcaagaccagcctggccaacatggtgaaactccgtctctacaaaaatacaaaaattagctgggcatggtggtggatgcctgtaatcccagctactcagaaggctgaggtgggagaattgcttgaacctgggaggtgaaggttacagtgaccccagatcgcgccaggactgcactccagtctgggtgacagagcgagactcyatctcaaaaaaaaaaaaaaaaaaaaaaaactaaaactaaaactacagaaaacatgggaatttcctggcacgtatgattaggtgagttgactaagaactgaacaaaccaggaatcagtccctaaaacgagaggcctggacccttctccccacaggccccgattcctgccatcttcccaagctgtgccccatccctgggcccaggggtccttggcctgcccttgccacaggcagctgcccccggactcacccaccctagtgggaacaggtgtcctcctgagccctgccacagtctcaacacc

SEQ ID NO: 75701 - DNA, 601 bp, Human
ttctcccaggtccaggccattcttgaaccaggaaatcttgggctataaataaggtaaagagagggagggaagccatccaggctgagaggggacctggcagggacccagggagacacatctgtgtttctactcggggggtcccacgagagtccctgactatgcccaaggctggaaacaaacatggaaccaagagtgagtaccatggccctgcccagggggaggaacccggtccatacaccccaaggtggagagaaagcaggggagacaggctggggagaggactgctcaacgtcggggcctrtgagccctgcctcctggtcggcctggaccagcgcctaaagttccctaccttggggctaccccggacagcacagcagagcatagcagtgtagcccgcgatgaccgagcggttcaccaggggctgggtgaagcttggggcctcggagaagtccagggccttatagttgggtggctcataggtgatgcctgttggtgacaggacttggtaccgagagggccacacaaagctaggcccctctccctgttcccacagcctccctgccccagcccctggttggaagaatgagggtacagcacctgg

SEQ ID NO: 75702 - DNA, 601 bp, Human
cctggagcccacaccccgccaggctcagacacagaacaccagacaggaaggctgaaacctacaatgggcttgagacccacaaaccctcgaccctgaggctggagaacctcagtctcagagactcgggcaccacagttcaaggccacaggcctgaatctgatgccaagactcagtatctaagacccagggccttagatataaattcagagcctcgggccctggctgccagcctgtgggacacaggggagcccgaggaggccgagaggggactggggagcctgggagacatccggccccagcytgaccctcgaacgcccccaggccgggtacacccaccttcagcatctccttgtagcggcccatctccgagtgggctgtgaccaggcagcccagcacgcggaagcgccccatgaggtccgagctcttctccagcacctttgtccacacctgcaatgccttctctgtctggttggactggtacagctggagccccttctcgatctgctgcttggtctggtcctgccccatcctccccaagccctgtgtcccacgtggggtgatccctggtggctccgtgcctctaggcactcatggggcagga

SEQ ID NO: 75703 - DNA, 601 bp, Human
agtggcagtgagccgagatcgagccactgcactccagcctaggcaacagagcgagactgtctcaaaaaaaaaaaaaaaaaaaaaagccaaaagaacagcaaagaaatcttaaacttcattcagttgtctttattttctagagtaatattggtattgtcttttggaattattttacgtattttgtagggtaaagcaaatatttaattatgtggttagaaactaagatttttcatctaagagaaaagacaatcaagtttaaaataagttaaggggagctcctgaaacattagatttgaattgraaatgtcagtataaacttccattattctgataactgaaaagatttagaagcacggacatcccactagcaatgaacaccccacaagcccacacttgggctttttttttttttctctcacacagggtcttgctctgttgcccaggctggaatgcagtggaacactcatggctcactgcagcctcaaactcctgggctcaagcgatcctcccgcctcagcctcctgagtagctgaaacaataggtgtgagccaccatgtctggttcatttttaaagtttggtgcagatggggtcttgctatgc

SEQ ID NO: 75704 - DNA, 601 bp, Human
ggcacagtggctcacaccggtaatcccagcactttgggaggctgaagcgggtggatcaccaggtcaagagattgagaccatcctggccaacatggtgaaaccccgtctctactaaaaatacagaaaattagctgggcatagtggcgtgtgccggtagtcccagctactcgggaggctgagccaggagaatcgcttgaacccgggaggcagaagtggcagtgagccgagatcgagccactgcactccagcctaggcaacagagcgagactgtctcaaaaaaaaaaaaaaaaaaaaaagccawaagaacagcaaagaaatcttaaacttcattcagttgtctttattttctagagtaatattggtattgtcttttggaattattttacgtattttgtagggtaaagcaaatatttaattatgtggttagaaactaagatttttcatctaagagaaaagacaatcaagtttaaaataagttaaggggagctcctgaaacattagatttgaattggaaatgtcagtataaacttccattattctgataactgaaaagatttagaagcacggacatcccactagcaatgaacaccccacaagccca

SEQ ID NO: 75705 - DNA, 601 bp, Human
ttttggccgggcgcagtggcttatgcctgtaatcccagcactttgggaggccaaggcgggtggactacaaggtcaagagatccagaccatcctggctaacatggtgaaaccccgtctctactagaaatacacacacaaaaaaaattagcggggcgtggtggcaggcgcctgtagtcccagctactcgggaggctgaggcaggagaatggcgtgaacccgggaggcggagggtgcagtgaccgagatcgtgccactgcactccagcctgggtgacagagtaagactccgtctctaaaaaaawatatatatatattatttcaatgactttggaacaaaagtactcagtttacccatagtgggatacattacaaaaacaaggctgggcacagtggctcacaccggtaatcccagcactttgggaggctgaagcgggtggatcaccaggtcaagagattgagaccatcctggccaacatggtgaaaccccgtctctactaaaaatacagaaaattagctgggcatagtggcgtgtgccggtagtcccagctactcgggaggctgagccaggagaatcgcttgaacccgggaggcagaagtggcag

SEQ ID NO: 75706 - DNA, 601 bp, Human
ttttcctaatatgccttattacatacttttgaagccacataaatgttttacagattaaaaaattaaatttaatttgaaaaatacctaaaaatagaaaatggaggtcaggtgcaatggctcatgtctgtaatcccagcactcggggaagctgagttgggagaacagcttgaggccaggagttcaagatcagcctgggcaacattgcaagaccactgtctctacaaaaaatttaaaaattagccagatgtgaaagaatgtgcctgtagtcccagctactcaggaagctgaggagggaggatcrcttgaacacaggagttttaggttacagtgaaccgtgattgagccactgcactccatcctgggtgacagagcaagatcctgtctcaaaaaaaaacaaaaacaaaaacaaaaacaaaaacctaaggctgggtgcagtggctcacacctgtaatcccagcactttgggaggccaagatgggcagatcatgaagtcaggagatcgagaccatcctggctaatatggtgaaaccccatctccactaaaatacaaaaaaactagctaggtgtggtgacaagtgcctgtggtcccagctacttggga

SEQ ID NO: 75707 - DNA, 601 bp, Human
ttgttttgagataaggtctcactctgttacccaggctggagtgcagtggagcaatcacagctcactgcagccttgacctcctgggctcaagctatcctcccacctcagcctcccaagtagttgggacctcaggtgtgtgccacaacagctggctaattttaaaacattttttgtagaggccgggcctggtggctcatgcctgtaatcccagcactttgggaggccgaggcaggtggatcacctgaggtcaggagtttcagacaagcctggccaacacagtgaatccccatctctataaaaratacaaaaattagcccagtgtggtggcgggtgcctataatcccagctactcaggaggctgaagcaggagaatcacttcaacctgggaggcagaggttgcagtaagctgggatcgcgctattgcactccagcctgggagacaagagcaaaactcaatctcaaaaatgtttttttcttttcttttcttttcttttttagagcatgggtctcattatgtagcccaggctgctctcgaacttctgggctcaagtgatcctcctacctcggcctcccaaaattctaggattatagatgtgagcca

SEQ ID NO: 75708 - DNA, 601 bp, Human
caggtgatctgcccacctcggcctcccaaaatgcaggtgtgagccaccgcacccggccttggttttggtttttaggccatgctaatcttctctgtattgttccaatttcagaatatgggctgccaaagcaagcactagataccattattaaatttggaacatgggctttgtagttaaaacagacaagttagtaggtgtgggaccttggacgcctctttgagcctcacttttcctcatctgtaaaatggggcttgctgtactcacctcacagggagagagtgaggactggacccagtacccrtaaggaccctgtgtgtgctcagtgctcagggagtggaggccactgttagtttttgtttgttttgagataaggtctcactctgttacccaggctggagtgcagtggagcaatcacagctcactgcagccttgacctcctgggctcaagctatcctcccacctcagcctcccaagtagttgggacctcaggtgtgtgccacaacagctggctaattttaaaacattttttgtagaggccgggcctggtggctcatgcctgtaatcccagcactttgggaggccgaggcaggtggatcacctg

SEQ ID NO: 75709 - DNA, 601 bp, Human
tcgtagaaatgcacatctggaaggctttgagaagtggtgaacctgttttcaagattttaaggttttaataagattatgacgatttttttttttttttttttttagatggagtcttgctctgtcacccaggctggagtacagtggcacaatcttggttcatggcaacctccacctcccgggttcaagtgattctcctgcctcagcctcccaagcagctgggattacaggcgtgcactaccacacctggctaatttttgtatttttagtagagacagagtttcaccatgttggtcaggctgayctcaggtgatctgcccacctcggcctcccaaaatgcaggtgtgagccaccgcacccggccttggttttggtttttaggccatgctaatcttctctgtattgttccaatttcagaatatgggctgccaaagcaagcactagataccattattaaatttggaacatgggctttgtagttaaaacagacaagttagtaggtgtgggaccttggacgcctctttgagcctcacttttcctcatctgtaaaatggggcttgctgtactcacctcacagggagagagtgaggactggacccagtac

SEQ ID NO: 75710 - DNA, 601 bp, Human
tctctgggaccttgcttcctttcatgcagaatgaggcggtgggtgagatcagaagacttcaccccccagaactgcctggagaccccatgtttttgacagattttatgaccaaacctggtgcacagactccataataatttgcggcagggcgccgtggctcatgcctgtaatcccagcacttggggaggccgaggcaggtggatcacctgaggccaggagttcgagaccagcctggccaacatggcgaaaccccatctctactaaaaatacaaaaattagccgggggtggtggtgagtgccygtaatccctgctactcaggagactgaggcaggagaatcgcttgaacccaggaggcggaggttgcagtaagccgaaatcgcaccactgcactccagcctgggctctaatagtgaaactccgtctcaaaaaaaataataattaatctgctttcctgtttttattaattaaatatacacacaatagctcatcagcatttctgatcagcctgatacccaggtaaaccagagtggctataatccaaccaaattttggcattttggttggactgtgcacaggatctcgtagaaatgcacatctgga

SEQ ID NO: 75711 - DNA, 601 bp, Human
tgggattacaggctcccaccaccatgcctgggtaatttttgtatttttagtagagacggggtttcaccatgttggccaagatgatcttgaactccggggctcaagtgatcagcccgcctcggcctcccaaagtgcttgcgagacagacgtgaggcaccacgcctggccaaggttaagtgtttgctattagtattattgctgtgattaagccagctgggccctagagtgccccgaagagatcctgcccacccctgtccacccccccaggagcccccacctgaggtggaagatgtgggagcarggtagggcctgcagccggctgttcttctcgcctatggactcgccgcacaggccgcagtagagctccgtctcctccacgcactcgtggaacctcacaacgtgcgcccgcagttcccgctgcagccctttgctgcggtaaatgctctcgctcagacagtgcagcttgagctggctcagctggggcccgcaggagtggagagcgccagtgggggatgagaacaaagtcagtgcaggtaggctccggtctcagccacttccctgtcttgctgatggaccttggaaaaatgtcctgccctctctg

SEQ ID NO: 75712 - DNA, 601 bp, Human
cagggcagagcaggggctgggagttgagaggatgggatggaaccagacccacggcaggtctggccctggacgtccgacctaatgacctttgaggggcctctctgactcctctttggggattatgaaaagaatggccacagatctcagctcactgcagcctctgcctcccgggttcaagtgattctcctgcctcagcctcccgagtagttgggattacaggctcccaccaccatgcctgggtaatttttgtatttttagtagagacggggtttcaccatgttggccaagatgatcttgaacyccggggctcaagtgatcagcccgcctcggcctcccaaagtgcttgcgagacagacgtgaggcaccacgcctggccaaggttaagtgtttgctattagtattattgctgtgattaagccagctgggccctagagtgccccgaagagatcctgcccacccctgtccacccccccaggagcccccacctgaggtggaagatgtgggagcagggtagggcctgcagccggctgttcttctcgcctatggactcgccgcacaggccgcagtagagctccgtctcctccacgcactcgtggaacct

SEQ ID NO: 75713 - DNA, 601 bp, Human
ggctgttcagcagcagtggaagggaagggaacggtccccccaggctcccactgcacccggcttgcccctctcctcctctgccccagggacctccagggcagagcaggggctgggagttgagaggatgggatggaaccagacccacggcaggtctggccctggacgtccgacctaatgacctttgaggggcctctctgactcctctttggggattatgaaaagaatggccacagatctcagctcactgcagcctctgcctcccgggttcaagtgattctcctgcctcagcctcccgagtagytgggattacaggctcccaccaccatgcctgggtaatttttgtatttttagtagagacggggtttcaccatgttggccaagatgatcttgaactccggggctcaagtgatcagcccgcctcggcctcccaaagtgcttgcgagacagacgtgaggcaccacgcctggccaaggttaagtgtttgctattagtattattgctgtgattaagccagctgggccctagagtgccccgaagagatcctgcccacccctgtccacccccccaggagcccccacctgaggtggaagatgtgggagca

SEQ ID NO: 75714 - DNA, 601 bp, Human
cttccttgcctgccctctgcaggggctgggatgcatcctggtggctgttcagcagcagtggaagggaagggaacggtccccccaggctcccactgcacccggcttgcccctctcctcctctgccccagggacctccagggcagagcaggggctgggagttgagaggatgggatggaaccagacccacggcaggtctggccctggacgtccgacctaatgacctttgaggggcctctctgactcctctttggggattatgaaaagaatggccacagatctcagctcactgcagcctctgccwcccgggttcaagtgattctcctgcctcagcctcccgagtagttgggattacaggctcccaccaccatgcctgggtaatttttgtatttttagtagagacggggtttcaccatgttggccaagatgatcttgaactccggggctcaagtgatcagcccgcctcggcctcccaaagtgcttgcgagacagacgtgaggcaccacgcctggccaaggttaagtgtttgctattagtattattgctgtgattaagccagctgggccctagagtgccccgaagagatcctgcccacccctgtcca

SEQ ID NO: 75715 - DNA, 601 bp, Human; identical to SEQ ID NO: 75702

SEQ ID NO: 75716 - DNA, 601 bp, Human; identical to SEQ ID NO: 75703

SEQ ID NO: 75717 - DNA, 601 bp, Human; identical to SEQ ID NO: 75704

SEQ ID NO: 75718 - DNA, 601 bp, Human; identical to SEQ ID NO: 75705

SEQ ID NO: 75719 - DNA, 601 bp, Human; identical to SEQ ID NO: 75706

SEQ ID NO: 75720 - DNA, 601 bp, Human; identical to SEQ ID NO: 75707

SEQ ID NO: 75721 - DNA, 601 bp, Human; identical to SEQ ID NO: 75708

SEQ ID NO: 75722 - DNA, 601 bp, Human; identical to SEQ ID NO: 75709

SEQ ID NO: 75723 - DNA, 601 bp, Human; identical to SEQ ID NO: 75710

SEQ ID NO: 75724 - DNA, 601 bp, Human; identical to SEQ ID NO: 75711

SEQ ID NO: 75725 - DNA, 601 bp, Human; identical to SEQ ID NO: 75712

SEQ ID NO: 75726 - DNA, 601 bp, Human; identical to SEQ ID NO: 75713

SEQ ID NO: 75727 - DNA, 601 bp, Human; identical to SEQ ID NO: 75714

SEQ ID NO: 75728 - DNA, 601 bp, Human
gaggactttcatgttgtgaagagcattctgagcttctaatgcagctttacgggtgtaaaatgtaacaaaacagcaccctgcaataaataagatttcataaaatcaaactttggaaagcagagaattcctagagcaatccttcctccactgacagatcagatcttaaaagagggctgggtttattaaaattagtgagagggggagggtagtggaaaagaacgaatagaatatctagcagaggaataagagattattttctatacactttattgttttagtctcctcctagttagttacactrtaagtcttatttagctgctcatgtaacttctctggaaaatacgacttctcataaagaaaggtcatgtgccatttgactcaacctaccctacttggaacaccaggtggtatatgagacaacaagacagatggggctctatacttttgcagcctgtagtctaccaggaactctttctttccctgctctctcagaataaaccactccctacttcgtagccagattctaccatatgcctcaaacataattatcacttattaaattataaaatgacttaagagcaagcacctcttaacatctttt

SEQ ID NO: 75729 - DNA, 601 bp, Human
tctgtccaaacgaagagaacatgactcggatgtcattttcagtgcacttcttggaaatcataccaataaacagcttcctgtcttccactgctaagagagtaaaacagaaaagacttgaatattactacttaaagaggcaatgtggcacagatttgggagccagaccgcctgggtttgaatcctggctctgtaccatattttacagattcaaagacacacatttgttttttgtatttttcacatctctttttttcttgtttttgagatggagtttcgctcttgttgcccaggctggagtgtratggcgcgatctcggctcaccgcaagctccgcctcccggattcaagtgattctcctgcctcagcctcctgagtagctgggattacaggcatgcgccaaaatgcctggctaattttgtatttttagtagagatggggtttctccatgttggtcaggctgttcttgaactctcgacctcaggtgatccacccgcctcggcctcccaaagtgctgggattacaggtgtgacccaccacgcccggcttcacgtctctttttataaccaatgttatcttaaaattataattagaagcatttagat

SEQ ID NO: 75730 - DNA, 601 bp, Human
aatgcttgacaggagaaaggaggactcatatcctctagttcctcttgaaaataaaagaaaatggaagaagaaagtatttccattttggcatcaaggatcttgcaaagcaccaaaagagaaaattttaatacatgacaatgaaatatagaatgtagactccttagaggggctgggagacaaaaagaatgaactgataggaggagtcaagacaggacatagatatacagcaggaagcagcaggcccaacctctttatcttgactgggccatattggctagggaatcactgttgctagtttccmccggtcaaattaaaaagattccaagcccggtgcagtggctcacacctacaatcctggcactttgggaggccaagatgacaggatcgtttgagtccaggagttcaagaccagcctgggcaacacagggagaccttttctctataaaaaatttaaaaattagctgggtgtcatgatgcatgcctgtggtcccagctactcaggaggctgatcctgggaggttcaggctgcagtgagttgtgaaggcaccactgcactccagcctgggtgagagagagcaagaccttgtctccaaaaaaaaaa

SEQ ID NO: 75731 - DNA, 601 bp, Human
aaaacggtcgctattaaaaaaaaatacaaaaattaactgggcgtgctggtgtgcacctgtagtcccagctacttgagtggcagaggtaggggggatcacttgagcctgggtggttggggctgcagtgagccatgatattcccactgcactccagcccaggtgacaaagtaagaccccatctcaaaaaaaggggtagggagagcatttccaatacgttaattttaaagaaatcagtggtttttaactttaagatgttggctgtttaaccttctgggcaatcagatgctgcacatgctgctgractttaatggccaactgtcccagcattcccaagctgaggaattttccccatcacctatctgctccctacctccatggtctgtgcttggtgcattgccttgatagccgtctgtgccatggctcttgttgtaaaagtcacaaatgcacaacctggtaagagaagagtcagtaactcatgcattcatttatttctctgacaaacattaactgagcacctactatgtgctgactatcatgctagcaatacagacacagtccctgttttcagggaatcatgtgctggtatgttgcaacagggtga

SEQ ID NO: 75732 - DNA, 601 bp, Human
taaataaataaagcaaaaaaagaaaaaaaatctcttgatctctcaagtccgctgaaagaaacatttatcatactctttaggaaagactcaataaggattttaatgatgccctctacatctggtagaaagagatatggagaaagacactggtagttaagattccctcaggaatttctttcttggaggcaaggacacaagatgtttctaaatctttaaaacgggaaaccaggaattcactttagttgcagcaaaagcctcaagatataaccagagatgcatgtccagagatacatatatatakagagagaaagagactaacaggactaaaagaaatagtactacctgaatttttacatataatttctatatgccaaaagttgtaaatgccactgtgtttgttggctagggacagcagaagaaggaacagctgggagcttgcacagtctgcagaaagcaaaccacaaagactcactgctaaatactggggtccaagagtatttagaccagcaaggtttccccacacagatgctgcgctgatttgctgcatctgctgctggagctgctgggccattctcttctgttctttgtccttctgtgtatc

SEQ ID NO: 75733 - DNA, 601 bp, Human
ggaaataaagagttcttgcaattttttccccttatcagagaacagcctcagtctataggagctaaacagcccttttccatattcttcttcaacagtgacctaaaaggttaggaggcaccagataacgtcagagcaatgtggcatcaactagccatagagccactgtacagagacaagaaaattgagtcctgggatgtttatcctaggtcaggtttacataataagcaaaaaaatgttttcacagaaacgatgccaaactcccaagactgttgttagctgggtctgctggcctgggtgctgytgctcctctgcagcagtgaaacacttacctcccattgggtggaggctgctcagggtgttgaggttcccagaggaggcagtctgctgaaggagctgcaaataaagctagacattacaccaaaaaacagaacaagagtgagagtgagggctggttctgcatctgggataactctacagcacagcaaagcgagagtgcagaggcccccagagagaagaaagtcaaagacaagaacccaagccaacacaacagaaacatgaggcttatgacagcacaggacaaaaaaaaaacacagctaaagca

SEQ ID NO: 75734 - DNA, 601 bp, Human
taggaattcacctaagaaacaagaagatacacaggtaaaccaaatgcctgggttctagaagcttcaaggtagggcatttgcatggaagccatctttggcttttctgcagtcactggaaaagtcactttataatggaaataaagagttcttgcaattttttccccttatcagagaacagcctcagtctataggagctaaacagcccttttccatattcttcttcaacagtgacctaaaaggttaggaggcaccagataacgtcagagcaatgtggcatcaactagccatagagccactgtayagagacaagaaaattgagtcctgggatgtttatcctaggtcaggtttacataataagcaaaaaaatgttttcacagaaacgatgccaaactcccaagactgttgttagctgggtctgctggcctgggtgctgctgctcctctgcagcagtgaaacacttacctcccattgggtggaggctgctcagggtgttgaggttcccagaggaggcagtctgctgaaggagctgcaaataaagctagacattacaccaaaaaacagaacaagagtgagagtgagggctggttctgcatctgggata

SEQ ID NO: 75735 - DNA, 601 bp, Human
tgattttctttttttttctttctttttttttgagatagaggctcactctgttgcccaggttggagtgcagtggcgtgaactcaggtcactgcaacctccgcctcccgggttcaagcaattctcctgcctcagcctcccgagtagctgggattacaggcaggcgccaccatgcctggcgtatttttagtagcgatggggtttcaccatgttggtcaggctggtctcgaactcctgatctcatgatctgcctgccttggcctctcaaagtgctgggattacaggcgcgagccactgcgcccakcctactcaatgattttctaaccaaaaagctttattacaattgcagtccagccattctccagccaccctggcctccctgtttttttcaaacacatcagggaacattgctgcctcagggcctctgtacttgcttttcctatgcccctgttactcttctttctctagattcaggcatgacttgcttcctacttccttcagttctctgcttaaatgtcaatctagagagacattctctgagcattctgcataaaatgcagtgcctctgacactccctatctctcttcccggcttgtcattctcc

SEQ ID NO: 75736 - DNA, 601 bp, Human
gatcgggccagaccttgacccccagccacctccttccctcttgtcaatggcgtctccctgcgggccccggttcccggaccgccagctcgcccggtgcccacctcggcctcatcccacacggtcgccatcttctcctgccgagtcactggactctcaatattcggcagcagattcatttcctggaggagcgggcagaagatgggaccaggcgggagccgcaacgggagattaataccgtctttcttaaagccttctcttgaccagtggaaaacctctccccacaaatcccgactcttgaccsgaccagctccggccgtgctgcggagcagcgaatctgcctctccgattccaaagaccaacccctggccacaggccccgcccccgcggaccccgaaacgttcccgcccgcgtcctatttttgccgggcgcgagaggtggggccgctattggccgacacgcgcgttgggggcggggcctatgtgtaaaaccggaaagggagggagaagggtgggatccgcgagggcctttgggaaatgtagtctttaatctggcccgtgacagatgcttgcggaggggcgcgttcaaactcagaccgtgaccc

SEQ ID NO: 75737 - DNA, 601 bp, Human
cataggttttaggttctgcctcatagtaagaactgggtgctttatcgcagtacaaacctctctgggcctgtctcctcatctgtaaaataggcattttactaaaagaaggattcttgagaggattattcccagttctcactgggaaaggcaatctgataacttctcatctcagcccaggcctcccaccaccccctacctgtcttcttgtcccttttaaggcttagttttctttcctctcttcctgatatgagggggaagcccgagccccatgtctcccccagggtgcccgattaggaagtaygagaggcgactcggatcgccggggcctgtcctgtgggggctccatcgcccgcacaggagctgtgcgcccaccttgatctcactgtccagcagccgtgtgcgctggatgatctcctccgtggacatcttgagcacctcctccccaattccatcttgctgtaaaaaattatttgtttatttatatatttacttttactcaggacaagcatccctcgttctccgaacccactcacagcctcagtttccacgcccataaaaccaggatggagtcaggacccctgcccacatcccaaacaacccc

SEQ ID NO: 75738 - DNA, 601 bp, Human
tggctttagcttttcagcatccaccaacccaatcacaggaaggaagtacgtctgtggacaagttacaggggcagtctcagttagtgtcctcagggaaggctccctagtcctgtcccacatccgctcctcaccctcctccagtctctcattgctgagccacgctcacctgtcgtgtagaggttttgatcacagcacacttgcccttcctctgggagtccaggtcaatattggcaccatcctcctcttggtcattaggatcaacatccaggagctgggaaggaaaaaatactcagctccttgwactccccaaggcccagtgcttcctaagacagttcctaatacctgcagggctggccatccttacctccctcctccaatagccctgagcccaccaaacgtgggtgcccctgctaagcccagggattgatctctgtgtaggtgctgctcctctgcacagggctcatctaccccggaggagacataaccaacagaaaaggagacacgtgagacctcccaggactttgcaggccccgtcttccccatgaaagtgccccaggaggtgtagctctgacatgcagtttggcctcaatacctccaccca

SEQ ID NO: 75739 - DNA, 601 bp, Human
ccccaagttctcaaacttctccttgtggttcattggcaagacaatggcctccaccagctgccaggaggaagtcctgggtgaggagatgaagccctgagggcttctacagcccaacccttcatggctccaaccccaatctgcatccctcctactctaactcagggacacgcccatttctttccccatatcaagaggacacaaggctgggcgcggtggctcacgcctgtaatcctagcactttgggaggctgaggcgggcggatcacaaggtcaggagatcgagaccatcctggctaacacgrtgaaactccgtctctactaaaaatacaaaaacattagccgggcggggtggtcgggtgcctgtagtcccagctactcaggaggctgaggcaggagaatggcatgaacccgggacgcggagctcgtagtgagccaagatcacgccactgcacaccagccagcctgagcggcagagcaagactccgtcacaaaaaaaaaaaaaagaggacacagaacactcatccccacccaggctggctatggactctccaggaacgggagtatatggcagaaaagacaccgggccaggggctgggagcagt

SEQ ID NO: 75740 - DNA, 601 bp, Human
tcccaagttcaagtgattctcctgcctcagcctcccaagtagctggaattacaggcgcacaccaccacacccggctaatttttctatttttagtagagatgtgtttcaccatgttggccaggctggtctcgaattcctgacctcaagtgatctgcccacctcagccttccaaagtgtagggaatacaggagtgagccactgcacccagccagggtttttaacaggattggtttatgtcagggaccactgtgggttcatgtgagcgaggtggccagattcctgctttggcttttttgttttsttttctttttttttttttgagacagagtctcactctttcaccaggctggagtgcagtggcgcaatcttggctcactccaatctctgcctcccaggttcaagtgattcttgtgcctcagcctcccaggcatctgggactacaggcgcctgctaccacgcccagctaattttttgtatttttagtagagacagggtttcaccatgttagccaggatggtctcgatctcctgacctcgtgatccgcctgcctcggcctcccaaagtgctgggattacaggcgtgagccagccgtgcccggccc

SEQ ID NO: 75741 - DNA, 601 bp, Human
aggccaaggtgggcggatcacaaggtcaggaaatcgagaccattctggctaacaaggtgaaacctcgtctctactaaaaatacaaaaaattagccgggtatggtggcgggcgcctgtagtcccagctactcgggaggctgaggcaggagaatggcgtgaacccaggaggcggagcttgcagtgagccgagatcgcgccactgtactccagcctgggcgacagagcgagacactgtctccaaaaattaaaaaaaaaaaaaaaagtaaggctgagagagggcatgccacctgctgagagtcawacatatctgaactcaagtccatctggtcccggccattcctagcgtgtgttaatgggctgaggtgtgaggccaggaaactaagtgcctccagcctctgtgccttcagatgaggggtggagtctaaggagcagagcacccagaattacgacatgggccctggcaagacgctacatcacacaactgaggagaaacggaggctggcgtgtggaacggtgctgtgtgtgcctggggcctgggaggtggtggtcgtggaggctggggaagatcagtacagagaagcatggcagagacatcctcctg

SEQ ID NO: 75742 - DNA, 601 bp, Human
cactgcgcttgacactgtcacatctaatccttaccacgaccctgtgaaatcagtgctatcatccccaagtcccaaataagaaaagtgaggctgaggccgggcgtggtggctcatgcctataatcccagcactttgggaggccaaggtgggcggatcacaaggtcaggaaatcgagaccattctggctaacaaggtgaaacctcgtctctactaaaaatacaaaaaattagccgggtatggtggcgggcgcctgtagtcccagctactcgggaggctgaggcaggagaatggcgtgaacccrggaggcggagcttgcagtgagccgagatcgcgccactgtactccagcctgggcgacagagcgagacactgtctccaaaaattaaaaaaaaaaaaaaaagtaaggctgagagagggcatgccacctgctgagagtcatacatatctgaactcaagtccatctggtcccggccattcctagcgtgtgttaatgggctgaggtgtgaggccaggaaactaagtgcctccagcctctgtgccttcagatgaggggtggagtctaaggagcagagcacccagaattacgacatgggccctggcaa

SEQ ID NO: 75743 - DNA, 601 bp, Human
gaagttaatgcaggttataacaggttatttctagggtctcttgagctctggccttctagaaatctgcatctgggactccagggactgactgtcctcatcctgtgcccagcactgcgcttgacactgtcacatctaatccttaccacgaccctgtgaaatcagtgctatcatccccaagtcccaaataagaaaagtgaggctgaggccgggcgtggtggctcatgcctataatcccagcactttgggaggccaaggtgggcggatcacaaggtcaggaaatcgagaccattctggctaacamggtgaaacctcgtctctactaaaaatacaaaaaattagccgggtatggtggcgggcgcctgtagtcccagctactcgggaggctgaggcaggagaatggcgtgaacccaggaggcggagcttgcagtgagccgagatcgcgccactgtactccagcctgggcgacagagcgagacactgtctccaaaaattaaaaaaaaaaaaaaaagtaaggctgagagagggcatgccacctgctgagagtcatacatatctgaactcaagtccatctggtcccggccattcctagcgtgtgttaatg

SEQ ID NO: 75744 - DNA, 601 bp, Human
ggtgagctccgtggcacccctgcgcagtgcgatcatgccctacagccgggacaaacagagtctaggtctgaacgcctgaatgccttccctggctccctgaggctcaggcctcttccctcagccgtctccaccagccaaatgcccccatcctgtccagggagggggcaagaaggcacaaagcaacgcacccaccccagctgaccactcaccgcctccacacacacagccttgcactgggccccattgaagtcatctgtgcagcgggccagctcctcgtagttcacgtcaggactggggacargacagataccacaggctcagtggcttatgcggaatgggcagaggggccaaatatcctcccctggccccgtcaagcaacaaagtcaagttgccctgtgatcagaggcaagtcccttactcaatgcgccttgttttcttctcagtacaagatgtgggggatgaagggaggaagttaatgcaggttataacaggttatttctagggtctcttgagctctggccttctagaaatctgcatctgggactccagggactgactgtcctcatcctgtgcccagcactgcgcttgacactgtcacatc

SEQ ID NO: 75745 - DNA, 601 bp, Human
ccgccgagacgcgtgactacaactaccacaatccccagcgcctgcggttccagcgtcgccttgctctagacgggcggcggcgctgcgcggggaaccggcgtggggtcacgtggtaccggcgcatcacgtgggcgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcsctggccgtgggtgaggccgggtcctggcgggcgggagcagcatcgcggccgagctggccgggtcggaactcggcggggaagtggcctgcggggaatactggccccccgcgcgctctgcacccgaggctctggggacttgcgcctgcgagggcctctgactccgacaaaggagacccggatttccagctgcttgaggaggggtgcgggcgggtaggggccgcgagggcagcactcccccgtcctgccactatcgctgtctcccctcgctcccacgtctcactgctgtcccccctttcttgc

SEQ ID NO: 75746 - DNA, 601 bp, Human
tctcctttccactccttacccctaatctctaccactaccagcatcatcttctgtgaggctgtggccatctacggcatcatcatggcaattgtcattagcaacatggctgaggtatggaaggccagggtggtggcgggaatccattccagtgtgttctacacattccttagagattggatggggtgcatcaggatggtttctgattacttttcttcttccctcagcctttcagtgccacagaccccaaggccatcggccatcggaactaccatgcaggtgggtggatgggcgtatgaatgcmaaatgctgggacttcatgcctgcttccactctcccccatcccagcttgggccatcattttgatattctctcacctactttttctgctttgcagagtggggatggtgattggccccattagcccatatctcccccattcctggcttagcctcactgcacccctctctatcctcccaggctactccatgtttggggctggcctcaccgtaggcctgtctaacctcttctgtggagtctgcgtgggcatcgtgggcagtggggctgccctggccgatgctcagaaccccagcctctttgtaaa

SEQ ID NO: 75747 - DNA, 601 bp, Human
aactggccgaaggagagctccatgaagaagagggggatcccgcagaagatgagcatgatgaagtaggggaacatgaaggcgcctggtaggcagggagaggtctggctcaggagtgggcttggagggatctcaccctgggcttcctgctcagaactcaacagcaaaaccttcgcgattgggtaggacccagggaggagtgtgccaggcttgagcaggagcctgggctgaggcacaccacccccagcctgtctttcaacttgacagaggctctcaggaattctgcttggagtggaatccaggycccagagcctccatacttgggtgggatttgatggtttaaacaagcgatttcacaagcataagttgctgagatcctcaacatccctgaaccatttaggggggctgctgaaccccagggaatagaacagggagccttgtgggcgggggggggggggggttaggtccttttctcacctctcctcacctcaaagggggccaactggcagggccagcccccaacaacagactgccagggtctggggtggcctgccttaggcaaagggtgcctaagccagggatgggggcgaaggaggccagggcc

SEQ ID NO: 75748 - DNA, 601 bp, Human
gtcttgatctcctgacctcgtgatccgcctgcctcggcctcccgaagtgctgggattacaggcgtgagccaccgcgcccggcctttttttttttttttttttttttgagacggagtttttgcttttcttgcccaggctggagtgcaatggcgcgatctcggctcactgcaacctccgcctcccaggttcaagcgattctcctgcctcagcctcccgagtagctgggattagaggcatgcgccaccatatctggataattttgtatttttagtagagatggggtttccttttttttttttttgacatggagtctccctctgtcgcccaggctggagtgctgtggcatgatcttggctcactacaagctctgcctcccgggttcacgccattctcccgcctcagcccccagagtagctaggactgcaggcacctgccaccacaccaagctaattttgtttttgtatttttagtagagacagggtttcaccgtattagccagtatggtcttgatctcctgaccttgtgatccgcctgccttggcctcccaaagtgctgggattacaggggtaagccaccgcgcccggccaagatggggtttctc

SEQ ID NO: 75749 - DNA, 601 bp, Human
cgcctggctaatttttttgtatttttagtagagacggggtttcactgtgttagccaggatggtcttgatctcctgacctcgtgatccgcctgcctcggcctcccgaagtgctgggattacaggcgtgagccaccgcgcccggcctttttttttttttttttttttttgagacggagtttttgcttttcttgcccaggctggagtgcaatggcgcgatctcggctcactgcaacctccgcctcccaggttcaagcgattctcctgcctcagcctcccgagtagctgggattagaggcatgcrccaccatatctggataattttgtatttttagtagagatggggtttccttttttttttttttgacatggagtctccctctgtcgcccaggctggagtgctgtggcatgatcttggctcactacaagctctgcctcccgggttcacgccattctcccgcctcagcccccagagtagctaggactgcaggcacctgccaccacaccaagctaattttgtttttgtatttttagtagagacagggtttcaccgtattagccagtatggtcttgatctcctgaccttgtgatccgcctgccttgg

SEQ ID NO: 75750 - DNA, 601 bp, Human
ctgcctcaacctaccgagtagctgggactacaggcgcccaccaccacgcctggctaatttttttgtatttttagtagagacggggtttcactgtgttagccaggatggtcttgatctcctgacctcgtgatccgcctgcctcggcctcccgaagtgctgggattacaggcgtgagccaccgcgcccggcctttttttttttttttttttttttgagacggagtttttgcttttcttgcccaggctggagtgcaatggcgcgatctcggctcactgcaacctccgcctcccaggttcaagcrattctcctgcctcagcctcccgagtagctgggattagaggcatgcgccaccatatctggataattttgtatttttagtagagatggggtttccttttttttttttttgacatggagtctccctctgtcgcccaggctggagtgctgtggcatgatcttggctcactacaagctctgcctcccgggttcacgccattctcccgcctcagcccccagagtagctaggactgcaggcacctgccaccacaccaagctaattttgtttttgtatttttagtagagacagggtttcaccgtatta

SEQ ID NO: 75751 - DNA, 601 bp, Human
gttgcccaggctctgacacccaggctggagtgcagtggcggaatcttggctcactgcaagctccacctcctgggttcatgccattctcctgcctcaacctaccgagtagctgggactacaggcgcccaccaccacgcctggctaatttttttgtatttttagtagagacggggtttcactgtgttagccaggatggtcttgatctcctgacctcgtgatccgcctgcctcggcctcccgaagtgctgggattacaggcgtgagccaccgcgcccggcctttttttttttttttttttttttgagacggagtttttgcttttcttgcccaggctggagtgcaatggcgcgatctcggctcactgcaacctccgcctcccaggttcaagcgattctcctgcctcagcctcccgagtagctgggattagaggcatgcgccaccatatctggataattttgtatttttagtagagatggggtttccttttttttttttttgacatggagtctccctctgtcgcccaggctggagtgctgtggcatgatcttggctcactacaagctctgcctcccgggttcacgccattctcccgcctcagcccc

SEQ ID NO: 75752 - DNA, 601 bp, Human
agcacaggggactggaaggcaagattgtgaagagggtggcgagggaggggaggaccctgagtgagaagggtgagtgggtgagaggcagacatgggctcagaaatctgccgtttgagcttctctcgctttagagtctcttcatcttacttttgattagcttccctcatttgtaaaatggtgatttttaaaatccctacacaagctacctaacagggtttttgtggcactccagtgagatcgcgcagctgtccaaagggtcattggagagtgtggactaaacacctgcacagccacccccacytaattcaccccggcacacccagcaacagcagcaccagacgggcgcaacacacacagattctgatacagcgactgctgcctagctccttaacctctaaacggcagtttctgagtctgaaaatatggatactaatatctacttagataacatgcctggcacctagtaggtgctcaacaataagggtgcttcctttcctcccttgctgaagccagcctgggttgctctcttcagggccatttccctggatctccaggagagggcagcagggagccgtgctgccgggaaggtatcccgcatggg

SEQ ID NO: 75753 - DNA, 601 bp, Human
aagggtatcggaggccacgtaaagccatccaggctgctggggacctggcccgagacccctccaaagtgctttggacctcccagcaaccctccactcccacccctccccccagctgctatcttggcatccaaaggacatgtaaacactggggacatgagcatgaatgactgcactagcagtggtgaccaaggtgacagcagccgtcctggccagggcgtggcagggggcaggcagagacacctggcctctgcctcaccagtctctgcggtgggagcacggggtgggggtggggccactcccytggcagctgtgctcatatccgggagtcctggaggcggctggagccattactgcccacaatggggatctgcgccttgtccgggtgcagtggctggacctcgaagccgtcctcaggagagggggctatggtgggggcgtagcgccctgtccggtgctccaggagggcagggccccagtctctgcttggctttgtggcatttttcaaacgctgcatgaggtaggcatggggcacaggggcagggcacgtcaggagggagcccttaagccccttccagctggcccctcccattttgcctggcta

SEQ ID NO: 75754 - DNA, 601 bp, Human
tggtctctccaagggctgggggaagaggaggtgcaggagagggagagaagagagctggcagggctgggcaggtcagggttcccgaggggagcagctcccacctcttctggcagtggctttgctggtggagaagagggcctttctctccgctcattccagaaaggccactcaccgatcccctctccaggaacctttctggttctagcctggagactgcaggttggggcaggggctcaggggtcagcgcctcccactgaatgctccctgctagtcctagtccagagtctggtgcttaggcctrcatggccaggacccctgcagccccaattctcaggggaccccaggcttgctgggctgtgactgcctatagaccctatgcttgtcattttgttggagagacaagtgaatctagcccagacctgtcctggtctcagaggctgcccaggcagccggatgcagctccagggagcctgaggctcctgcatcttagacactggtcatttggggcattcgttgtttgtctcactgcatgactctatacacagcagggaggggaccagggctggccatctccagaatccccgctagcacaaaggagaga

SEQ ID NO: 75755 - DNA, 601 bp, Human
accgcgacaagcataacgaacctaaccctcagaggtgaccccagcaccctcaccccttactccccagaggcaacttcccaatatccccaactcttgaccccaagtggcccaatccctgatcccccagtgggggacctccaagcatccttgactccaaaaaggtgactcccagtgccactgattccctgatgtgatccaaggcccctcaggactgctggcacccctgatcgttgtcccccaacccccagcccagcctcagcccaatatctctgacctctggcctgattcctagaggtgaccrgaatttaatgtcagggcctaaatagtcattgagtagattgcattcctattggtgccctcgaagacctcacttgtgcacctgtgggacccctgccggggcagataggacacgagctaatgggtgctgggcacagctcctgtggacctgacaaaggggacctgagcagtatgggaagggggtgtggaaagacagtgcccacccctctgaaattgaaggaggtggatgtatctcttaggaggtagccacatttggtatcaggctggctgggagaagggcctaaagggtgtgtgaaatgtaaac

SEQ ID NO: 75756 - DNA, 601 bp, Human
ggaaggcgaaagcctggcatagccgctgggtggagcaggagagaaagtcagcccggcctgaaggaatcgatggagtccaagggagcatagtggtacagggcctggggatggaggtgctgtgtccccagcttgagcaggagggtttttctactctgaacacggggtaggagtgggggaggtggtttgtagccctggtgtggggttggtgcctgggagaagcatgaggcactggggaggcacagggagctgatgaaaaagtggttctgatgaaaactatggtcagcaggaaacaggtaagagmccaagaggagaggggcttcagggcatctggggaggagtggagctccacagtacacgccaggagccttggtcctgtttcaggagtagcctgcctgagtgccaccatcaattacacatgtctggcttggttgtagatgtggcaagatagcaagaagtttctggcttaaagaactctgtgaatgttggattcatggattgggtatgactactctgggtctgccacccccagaaagtttagcacaagtcacagagcagcgtcaggaagcccttgtttacatttcacacaccctttaggcccttc

SEQ ID NO: 75757 - DNA, 601 bp, Human; identical to SEQ ID NO: 75754

SEQ ID NO: 75758 - DNA, 601 bp, Human; identical to SEQ ID NO: 75755

SEQ ID NO: 75759 - DNA, 601 bp, Human; identical to SEQ ID NO: 75756

SEQ ID NO: 75760 - DNA, 601 bp, Human; identical to SEQ ID NO: 24783

SEQ ID NO: 75761 - DNA, 601 bp, Human; identical to SEQ ID NO: 24784

SEQ ID NO: 75762 - DNA, 601 bp, Human; identical to SEQ ID NO: 24785

SEQ ID NO: 75763 - DNA, 601 bp, Human; identical to SEQ ID NO: 24786

SEQ ID NO: 75764 - DNA, 601 bp, Human; identical to SEQ ID NO: 24787

SEQ ID NO: 75765 - DNA, 601 bp, Human; identical to SEQ ID NO: 24788

SEQ ID NO: 75766 - DNA, 601 bp, Human; identical to SEQ ID NO: 24789

SEQ ID NO: 75767 - DNA, 601 bp, Human; identical to SEQ ID NO: 24790

SEQ ID NO: 75768 - DNA, 601 bp, Human; identical to SEQ ID NO: 24791

SEQ ID NO: 75769 - DNA, 601 bp, Human; identical to SEQ ID NO: 24792

SEQ ID NO: 75770 - DNA, 601 bp, Human; identical to SEQ ID NO: 24793

SEQ ID NO: 75771 - DNA, 601 bp, Human; identical to SEQ ID NO: 24794

SEQ ID NO: 75772 - DNA, 601 bp, Human; identical to SEQ ID NO: 24795

SEQ ID NO: 75773 - DNA, 601 bp, Human; identical to SEQ ID NO: 24796

SEQ ID NO: 75774 - DNA, 601 bp, Human
tttaatatatatttagtgagcatctacagtgtcatggggcaaaaaaatagcaacttacaatattaatttctataggcagcccccaaatttgaatcatttcctgaaaaattacttctgcttttgtgaagtttcctgctagcagtttagagattgggctgtttcctcactgatacatatcccttcacacttctataatttaactctctcaactgcatgtgaaagatcttagctgaagatgactgacagtgttatttattccatgttagagttgcctacggcaacccaagcccagaatgactayggaccacagcaaaaatgtgagttaaccaaggtagcatggaagacgatgcatagcaacagtaggctatggatgaatggggagtagaataagtttaaagcagagggtgcagaagaattgaggataatttgaggaaatacttttggttcagtttaaagtccagagttggaatatgaaaagttggtgtatggtacaggatctgatcttaggtctcaggtaaactcttttctaactgttcacttctttgatcgcatcttagaaacccaacttagggcattgccgttattccttcttgctcttagc

SEQ ID NO: 75775 - DNA, 601 bp, Human
aacctgtcatctgactcaggattgtgctttgactctgttgttgcagcttcctcttccaggccttcttgttcttgccttgtggcaatagctttggggcttctgactgcagttcttctgagtgtgctgctataccagtggatcctgtgccagggtaagtgcaaacttaaaccaaaattaatctttcattttatattataaaagcaatataacatagcagaagctttgaaaaatcaaaaaataattcaaacaaaataactctccatctgtatacagctatttcctgggtatagcctttgaccaygtgcacttgtgtaagcttgtattttcttttttctttttgttttttgagacagggtctccctcaatcagccaggctgtaggtgatagatttgtgtgctgctataccagcggatcctgtgccactgtacagtcacagctcactgcagccttgacctccttaggctcaagtgatccacctcagcctctcgagtagctgggaccacaggcacataccaccatgcctggctaatttttgtattattattattatttttttttttttgtaaagacatttcaccatgttgcccaggctgatctcaaa

SEQ ID NO: 75776 - DNA, 601 bp, Human
ataactctccatctgtatacagctatttcctgggtatagcctttgaccacgtgcacttgtgtaagcttgtattttcttttttctttttgttttttgagacagggtctccctcaatcagccaggctgtaggtgatagatttgtgtgctgctataccagcggatcctgtgccactgtacagtcacagctcactgcagccttgacctccttaggctcaagtgatccacctcagcctctcgagtagctgggaccacaggcacataccaccatgcctggctaatttttgtattattattattattwttttttttttgtaaagacatttcaccatgttgcccaggctgatctcaaactcctgggctcaagccatttgcccttcttggcctcccaaagtgctgggattataggtgtgagccactgcacctgaccatattttcttaatagaactgcagtcaagtcctcttaaaatttctcccacctttctttcttttaatgcaaggctgagaatagttcttatcgtagtatgctcataattttgtatattgctttttaattttatgttgccagaaacatttccttactgccatatttattgggatgatt

SEQ ID NO: 75777 - DNA, 601 bp, Human
tgattctgcctgatttaagcaatatacattatgcaattatgcaatatatacacagagcaaagacagtacacagatgcatatcatatgaattcacagttatctggtgtgtgtatattacatgtgcacagagatctctagcacaagtcaagtacttgctccagagttttcaggcagattgttgtatgctttcttctttgttccttcagttatagtcatattcttgtgtagtggaatatatacttagtagatgatggagttggacattatgaggacattatgaggtattcaaattgacaccacrcattgttacacatttctctaacccttaatctgaaaagtggtggagcagggaagacccagggctgccatattccattttatctcccatttcatttccaagactgagtggtccataaagatgtgaaccaggtcctcttctctcctaggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacg

SEQ ID NO: 75778 - DNA, 601 bp, Human
gatttgggggggatactatattcttccccttccctcttcttctctttcctcttctacttctgccttcttccctctccctccccactctttacccttatgctgtctgacccaacaaacctcagttacagcaacccagatgcttgtatagcatgtaagtgtgtatgtggggcaaggaggcagaaggatggtgagtgttttggagaggaatgagacctgaaatacaggtctagttaaaagaagtcttaggtccggaaacctacaggtccaacaacaaggcagcagattctttttttttttttttgacagagtctccctctgtcatccaggctggagcacagtggtgtgatcttggctcactccaacctccgcctcccaggttcaagcgcttctcctgcctcagcctcccaagtagctggaactacaggcgtgtgccaccatgcctggctaattttttgtatttttagtagagatgggatttcaccatgttagccaggatggccttgatctcctgaccttgtgatctgcccgcctcggcctcccaaagtgctgggattacaggcatgagccaccgtgccagtccttatatagtggaacttgggag

SEQ ID NO: 75779 - DNA, 601 bp, Human
aattttttgtatttttagtagagatgggatttcaccatgttagccaggatggccttgatctcctgaccttgtgatctgcccgcctcggcctcccaaagtgctgggattacaggcatgagccaccgtgccagtccttatatagtggaacttgggagggagggaaagatagagatcacggggacagagtgattgtggcaagggcttaaatgccttcttttaaaaagttttcccttaattcactggaatccaataagttccagactgcaatgttgagaaagttgggatataaggaagaaaacaygcgtgcacgtgcatgtgtgtgtgtgtgtggtggcctccacttccttcaggcccctcagatccttcctatccacccagcaatctcttggaaaagagcttgctattggtcctagaccatctcaaggcaatacaaggaactgacatcctgaggttgcctagtataaaaatcaatcaaattctaatttgtcaacataaataacatctataaggaaaacaagaaatcttagttttgtgttagtgctaatttgatactgatttttgtgttttgctattgttttctgttttcttttattgggtagga

SEQ ID NO: 75780 - DNA, 601 bp, Human
cacagcatagatggtaggggaattgctttactctggaggtcttcacagtctggtaatgtgcatcttttgtcacgcttctttataatcagattaagcagctagtgtcaactgcataacaagggatgggcatgataagctaggatatttccactattttttaacttaaaaaattgtgggaaaatatgcatagcataaaatgtactattttaaccattttcaagtgtacaattgagtggcattaagtacattcacattgttgtacaaccatcactaccatcatctccagaactttttcatcatycccaattgaagctctgtacctcttaaacaataactcccctccctctagcccctggtaatcactattctacttaccatatctatgtatttgcctattctgtcctttagtgtctcacttattcacttagaatactgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaatttggatatcc

SEQ ID NO: 75781 - DNA, 601 bp, Human
catagatggtaggggaattgctttactctggaggtcttcacagtctggtaatgtgcatcttttgtcacgcttctttataatcagattaagcagctagtgtcaactgcataacaagggatgggcatgataagctaggatatttccactattttttaacttaaaaaattgtgggaaaatatgcatagcataaaatgtactattttaaccattttcaagtgtacaattgagtggcattaagtacattcacattgttgtacaaccatcactaccatcatctccagaactttttcatcattcccarttgaagctctgtacctcttaaacaataactcccctccctctagcccctggtaatcactattctacttaccatatctatgtatttgcctattctgtcctttagtgtctcacttattcacttagaatactgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaatttggatatccatcta

SEQ ID NO: 75782 - DNA, 601 bp, Human
gataagctaggatatttccactattttttaacttaaaaaattgtgggaaaatatgcatagcataaaatgtactattttaaccattttcaagtgtacaattgagtggcattaagtacattcacattgttgtacaaccatcactaccatcatctccagaactttttcatcattcccaattgaagctctgtacctcttaaacaataactcccctccctctagcccctggtaatcactattctacttaccatatctatgtatttgcctattctgtcctttagtgtctcacttattcacttagaayactgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaatttggatatccatctattgacagacactgtttccacaagcttttaaaaagtggagcaaatgatggtttacggagcagggcttactgacttttagcattgtgtacttacacaaaattatagggaaaattcttattgatatta

SEQ ID NO: 75783 - DNA, 601 bp, Human
ttttcatcattcccaattgaagctctgtacctcttaaacaataactcccctccctctagcccctggtaatcactattctacttaccatatctatgtatttgcctattctgtcctttagtgtctcacttattcacttagaatactgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaayttggatatccatctattgacagacactgtttccacaagcttttaaaaagtggagcaaatgatggtttacggagcagggcttactgacttttagcattgtgtacttacacaaaattatagggaaaattcttattgatattaagctctagtaatttgtaacctgtcagattttcctttgaaatttcttaacgttatttgcatgtttttagatgatggtaattaatgtgttcatattataggatatctgaaaagtctggaaacaggctaaacttatttttaaacagtatgttggttacatttt

SEQ ID NO: 75784 - DNA, 601 bp, Human
ctgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaatttggatatccatctattgacagacactgtttccacaagcttttaaaaagtggagcaaatgatggtttacggagcagggcttactgacttttagcattgtgtacttacacaaaattatagggaaaattcttattgatattaasctctagtaatttgtaacctgtcagattttcctttgaaatttcttaacgttatttgcatgtttttagatgatggtaattaatgtgttcatattataggatatctgaaaagtctggaaacaggctaaacttatttttaaacagtatgttggttacattttcaagtaatatgctctatatttttactcaatcttgagacatgttttcaagtgaaacatctctaaatttaaagcaatagatataattatttttagaccttatgagtactctgtattgtaaatttttttcaaattagtaattaca

SEQ ID NO: 75785 - DNA, 601 bp, Human
gtaattaatgtgttcatattataggatatctgaaaagtctggaaacaggctaaacttatttttaaacagtatgttggttacattttcaagtaatatgctctatatttttactcaatcttgagacatgttttcaagtgaaacatctctaaatttaaagcaatagatataattatttttagaccttatgagtactctgtattgtaaatttttttcaaattagtaattacatcctttgctttaaatacttcacctgaaaaagtgtctgaagaaaaacatattaatgatattattttaaaatatragactgtagggttccccagtgcctggctttctttctgtgtattggctgaaaatcgcagagggccttgaccgctctgtgacccgcccagctacaggtttttcccctgcaggctctacccaaaccccagccttgaacatttccagtcactgataaaggtatctaggttgctgctcaaaacactgaaataaactagccccagccctaagtcagattccttaaaccctcataaaatctccatctctgaccccctggccgtggacatatgtaggtcaaatgctccttttctctggctgtccatcg

SEQ ID NO: 75786 - DNA, 601 bp, Human
atactttgaatgcagtaacatttatttttgaatcttttagatcatggctatcattcacaccaattttgtgaaaatattaaaaaaaatccattctttttttcctaatttaaataattctttaaacaagttggttaagaaatgcaaaaattttaagctatcttgaaaattacagtgtcatttcatctgtcgtatacttcattcactctccggtctaccttcttacccccagcatgcacagttaagtgctccacagagagaaagtaaaaaatacagagtttgtgttcagagggtttttttttttctttttcttttttattattattatactttaagttttagggtacatgttcacaatgtgcaggttagttacatatgtatacatgtgccatgctggcgtgctgcacccattaactcgttatttagcattaggtatatctcctaatgctatccctccccccttcccccaccccacaactgtccccagagtgtgatgttccccttcctgtgtccatgtgttctcattgttcaattcccatctatgagtgagaacatgcggtgtttggttttttgtccttgcgatagtttactgagaatgatgatt

SEQ ID NO: 75787 - DNA, 601 bp, Human
gcaaagggattttgcaaaccttagagtacaatacaaatgtaagagataattgttttcaggatactgggctctgagagaacaaagttatcataaggaatagattatttgggaagaaaagcactgataaacaagttgtactgatttttcaaatgctttgtctaggagccaccacagtcatgtcctgaatggaaacaggactgaaacccagtgaagagaaaatagaggttattctgaccatgagaaatagcacaaaagactccttttctctcctgtagtgtctccactagaagtgcaaagagggtttttgcctctctttattttattttgtttttttgagacagagcctcactccgtcacccaggctggagtgcagtgatgccatctcggctcactgcaatctctgcctcctgggttcaagcgattctcatgcctcagtctcccaagtagctgggattacaggtgcccgccaccatgcctaattttttatttttatttttgtttttagtagagacaggctttttgtaccacattcaccaggctggtctcaaacttctgacctcaagtgatccactagcctcggcctccctaagtgctgggatca

SEQ ID NO: 75788 - DNA, 601 bp, Human
gccaccacagtcatgtcctgaatggaaacaggactgaaacccagtgaagagaaaatagaggttattctgaccatgagaaatagcacaaaagactccttttctctcctgtagtgtctccactagaagtgcaaagaggctttttgcctctctttattttattttgtttttttgagacagagcctcactccgtcacccaggctggagtgcagtgatgccatctcggctcactgcaatctctgcctcctgggttcaagcgattctcatgcctcagtctcccaagtagctgggattacaggtgccmgccaccatgcctaattttttatttttatttttgtttttagtagagacaggctttttgtaccacattcaccaggctggtctcaaacttctgacctcaagtgatccactagcctcggcctccctaagtgctgggatcacaggtgtgagccactgtgcctggccctcccttaactttagaagagcaactctttatttgtgctgatgcagggtccaagtaggcaaagagacagttaagagcagagcccataaatgtttactcttcagcaaccatctttcaggagtggaataaaaacaacatcaa

SEQ ID NO: 75789 - DNA, 601 bp, Human
gcaatctctgcctcctgggttcaagcgattctcatgcctcagtctcccaagtagctgggattacaggtgcccgccaccatgcctaattttttatttttatttttgtttttagtagagacaggctttttgtaccacattcaccaggctggtctcaaacttctgacctcaagtgatccactagcctcggcctccctaagtgctgggatcacaggtgtgagccactgtgcctggccctcccttaactttagaagagcaactctttatttgtgctgatgcagggtccaagtaggcaaagagacarttaagagcagagcccataaatgtttactcttcagcaaccatctttcaggagtggaataaaaacaacatcaaaatgggacatctggtggtatcataatcaccataggcagttgaaattgtattgctttcttagtagtttctagataaaaaagaatattttattccaaaggtatttaaccaattaagctgtcattagaaaatattgaaagtgtaattgttaattacaccaacactaaatcctacaacaaaattaccttggattatctttctaaccttttattttaatctattttaatcttta

SEQ ID NO: 75790 - DNA, 601 bp, Human
ctttctaaccttttattttaatctattttaatctttaacattttattttatttcatttatagaggcaattctctttggatataaacttcttcatttgaatgtcagactttgcagatcaaagtcttttatctctgttctgttgggtaacgtggcacacataagtggtgtagccaatttacctttaccttaaacttgttcccttaagaactgtttttttcttgccacatacaagattgatgaggatgcggaaaatgagacctcagtggggaaaaaaacaagaatattgctataggcttaatcrtaatttatatatttaaggatgatgggaaagatgaccacttctgcagcaaatgtttagcttctttcttttgaaataatctgaatacctatcaggtgctccctttaattaaggagaaaattgcaatggaaggtagagatgtaatattatcttatttgctacattataagaatccagttattgacagaaaggtcaattctaggatgctgctcctctctacagctaacacatctttagaattagatgttaaatgagaaattagttatttagagtgaataattgtcttagcttgggctgctctaa

SEQ ID NO: 75791 - DNA, 601 bp, Human
ttcatttatagaggcaattctctttggatataaacttcttcatttgaatgtcagactttgcagatcaaagtcttttatctctgttctgttgggtaacgtggcacacataagtggtgtagccaatttacctttaccttaaacttgttcccttaagaactgtttttttcttgccacatacaagattgatgaggatgcggaaaatgagacctcagtggggaaaaaaacaagaatattgctataggcttaatcgtaatttatatatttaaggatgatgggaaagatgaccacttctgcagcaaaygtttagcttctttcttttgaaataatctgaatacctatcaggtgctccctttaattaaggagaaaattgcaatggaaggtagagatgtaatattatcttatttgctacattataagaatccagttattgacagaaaggtcaattctaggatgctgctcctctctacagctaacacatctttagaattagatgttaaatgagaaattagttatttagagtgaataattgtcttagcttgggctgctctaacaaaataccatagactggatcgcttgaacaacagatgtttctctctctcag

SEQ ID NO: 75792 - DNA, 601 bp, Human
cccttaagaactgtttttttcttgccacatacaagattgatgaggatgcggaaaatgagacctcagtggggaaaaaaacaagaatattgctataggcttaatcgtaatttatatatttaaggatgatgggaaagatgaccacttctgcagcaaatgtttagcttctttcttttgaaataatctgaatacctatcaggtgctccctttaattaaggagaaaattgcaatggaaggtagagatgtaatattatcttatttgctacattataagaatccagttattgacagaaaggtcaattcyaggatgctgctcctctctacagctaacacatctttagaattagatgttaaatgagaaattagttatttagagtgaataattgtcttagcttgggctgctctaacaaaataccatagactggatcgcttgaacaacagatgtttctctctctcagttctgaaggctggaaaatccaacatcaaggttctctggctcctggtgaggacctacttctggcttgcacatggctgcctttttgttgtatcctcacttggcaaagagagtgctttgatctcttcctcctcttataaggacactaat

SEQ ID NO: 75793 - DNA, 601 bp, Human; identical to SEQ ID NO: 27676

SEQ ID NO: 75794 - DNA, 601 bp, Human; identical to SEQ ID NO: 27677

SEQ ID NO: 75795 - DNA, 601 bp, Human; identical to SEQ ID NO: 27678

SEQ ID NO: 75796 - DNA, 601 bp, Human; identical to SEQ ID NO: 27679

SEQ ID NO: 75797 - DNA, 601 bp, Human; identical to SEQ ID NO: 27680

SEQ ID NO: 75798 - DNA, 601 bp, Human
gctcacacctgtaatcccagcactttgggaggccgaggcctgcagatcatctgaggtcaggagtttgcgaccagcctgactaacacggtgaaaccctgtctctactaaatacaaaaaattagccagttgtggtggcgcatgcctataatccaagctacttaggaggctgagacaggagaatcacttgtacttgggagatggaggttgcagtgagccgagatcgcgcaattgtactacagcctgggtaacaagagcgaaactctgtctcgaaaaaaaaaaaaaataaaagggtctcactatrttgcccaggctgatctcaaactcatggcctcaagtgatcatcccacctcaacctcccaaagtgcttggtattacaggcatgagccaccacaccaggcaagacagttcatcataccttatgatatgtctgcgagaaaagcatctaaagtcttaacacaggactggttcctaatcagcccagaaaaatgaattccgattttcagttttgctggtactaaaatctcgggaggcctttcccctagtctgaagtctagtcacattcctgcccttttttcctagattcagatttagattcagaaac

SEQ ID NO: 75799 - DNA, 601 bp, Human
ccttttctttttttgagagagtctcactctgttgcccaggctgcagtacagtggtgccatcatagctcctttgcagcttcgaactcctgggctcaagcgatcctttcacctcagccttctgagtagctaggacaaccagcaaaccaccacacctggctttttttttttttttttttaagagatagggtctcaggctggcagcagtggctcacacctgtaatcccagcactttgggaggccgaggcctgcagatcatctgaggtcaggagtttgcgaccagcctgactaacacggtgaaacsctgtctctactaaatacaaaaaattagccagttgtggtggcgcatgcctataatccaagctacttaggaggctgagacaggagaatcacttgtacttgggagatggaggttgcagtgagccgagatcgcgcaattgtactacagcctgggtaacaagagcgaaactctgtctcgaaaaaaaaaaaaaataaaagggtctcactatattgcccaggctgatctcaaactcatggcctcaagtgatcatcccacctcaacctcccaaagtgcttggtattacaggcatgagccaccacacca

SEQ ID NO: 75800 - DNA, 601 bp, Human
gaatccaagtctgttccaatcccacaggatatttgaaaaaccactaacctgaatcattccagagactgcaggagaggagtggagcctctcccgggtgtagcccaatccttcctggttccctttctctagaggcctagctacattccagtccagccactcacagaaacaggagcaaagcaatgggggaacagagggcttgagaatgtatcctagctgtctctgggatttcagggcagagtactgcttttctgcatatacctcagtttaaccaactgttccaagagctatcaccatataaatrctttatctagtattcatgaagttctctctgaaaaaaaaaattaacgtattttcttttccttttctttttttgagagagtctcactctgttgcccaggctgcagtacagtggtgccatcatagctcctttgcagcttcgaactcctgggctcaagcgatcctttcacctcagccttctgagtagctaggacaaccagcaaaccaccacacctggctttttttttttttttttttaagagatagggtctcaggctggcagcagtggctcacacctgtaatcccagcactttgggaggccgag

SEQ ID NO: 75801 - DNA, 601 bp, Human
tgacaaaaaagcctcttaacctttcacactcattatgggctttcttctttcagaacacttttttttttaagtaggatgtcattgattggaagaacaatcttttaacaaaaggaatccaagtctgttccaatcccacaggatatttgaaaaaccactaacctgaatcattccagagactgcaggagaggagtggagcctctcccgggtgtagcccaatccttcctggttccctttctctagaggcctagctacattccagtccagccactcacagaaacaggagcaaagcaatgggggaacwgagggcttgagaatgtatcctagctgtctctgggatttcagggcagagtactgcttttctgcatatacctcagtttaaccaactgttccaagagctatcaccatataaatgctttatctagtattcatgaagttctctctgaaaaaaaaaattaacgtattttcttttccttttctttttttgagagagtctcactctgttgcccaggctgcagtacagtggtgccatcatagctcctttgcagcttcgaactcctgggctcaagcgatcctttcacctcagccttctgagtagctagga

SEQ ID NO: 75802 - DNA, 601 bp, Human
aggcttgacaaaaaagcctcttaacctttcacactcattatgggctttcttctttcagaacacttttttttttaagtaggatgtcattgattggaagaacaatcttttaacaaaaggaatccaagtctgttccaatcccacaggatatttgaaaaaccactaacctgaatcattccagagactgcaggagaggagtggagcctctcccgggtgtagcccaatccttcctggttccctttctctagaggcctagctacattccagtccagccactcacagaaacaggagcaaagcaatgggrgaacagagggcttgagaatgtatcctagctgtctctgggatttcagggcagagtactgcttttctgcatatacctcagtttaaccaactgttccaagagctatcaccatataaatgctttatctagtattcatgaagttctctctgaaaaaaaaaattaacgtattttcttttccttttctttttttgagagagtctcactctgttgcccaggctgcagtacagtggtgccatcatagctcctttgcagcttcgaactcctgggctcaagcgatcctttcacctcagccttctgagtagc

SEQ ID NO: 75803 - DNA, 601 bp, Human
gtctggccaacatggtaaaatcccatctctactaaaaatacaaaaattagctgggcatgggtggtgcatgcctgtagtcccaattactcaggaggctgaggcaggagaatgaattgaactcaggaggcggaggttgcagtgagctgagatcttgccactgcactccagcctgggacagagtgagactctgccaaaaaaaaaattcatcaggcttgacaaaaaagcctcttaacctttcacactcattatgggctttcttctttcagaacacttttttttttaagtaggatgtcattgattrgaagaacaatcttttaacaaaaggaatccaagtctgttccaatcccacaggatatttgaaaaaccactaacctgaatcattccagagactgcaggagaggagtggagcctctcccgggtgtagcccaatccttcctggttccctttctctagaggcctagctacattccagtccagccactcacagaaacaggagcaaagcaatgggggaacagagggcttgagaatgtatcctagctgtctctgggatttcagggcagagtactgcttttctgcatatacctcagtttaaccaactgtt

SEQ ID NO: 75804 - DNA, 590 bp, Human
gcgtgtgccaccatgcccgactagtttttgtatttttagtagagacagggtttcaccatgttggccaggctggtcttgagctcctgacctcaggtgatccaaccaccttggcctcccgaagtgctgggattacaggcataagccaccatgcccggcctgacttctttttttaacttcagattctattaataaatgtcagatgtaaatctgatgggaacaaatatttttataaagcatatcagagttatggataattataaaaaaggtgaaatacaaataaagcatttcayaggaatttcccttgcttacctcatcctgttttctaaattccagatagaaattcatcaggtttggctgggcttcatggttcatgcctgtaatcccagcattttgggaggccaaggcatgcgtatcacttgaggtcaggagtttgagaccagtctggccaacatggtaaaatcccatctctactaaaaatacaaaaattagctgggcatgggtggtgcatgcctgtagtcccaattactcaggaggctgaggcaggagaatgaattgaactcaggaggcggaggttgcagtgagctgagatc

SEQ ID NO: 75805 - DNA, 601 bp, Human
ttgacattcataattctttttttttttttttttttgagacggagtctcgctctgtcgcccaggctggagtgcaggggcgcgatctcggctcactgcaagctccgcctcccgggttcacatcattctcctgcctcagcctcccaagtagctgggactacaggcgcccgccacagcgcccggctaattttttgtatttttagtagagacggggtttcaccgtggtctcgatctcctgacctcgtgaaccgcccccctcggcctcccaaagtgctgggattacaggcgtgagccaccgcgcccrgcccataattctgatataattgggtatgaatttgctgatatgcttaggagtgttcataaaaggtagtattgttttttttttttttaagagtctcgctctgtcacccaggctgaagtgagtggccagtctcggctcactgcaacctccgcctcttgggttcaagcaatttttgtacctcagcttcccaagtagctgggattacaggcgcataccaccatgcctggctaatatatatatatatacacacacacacacacacacatatatatacacacatacacacacacacatatatataca

SEQ ID NO: 75806 - DNA, 601 bp, Human
tgatgacttctttgcaatacttatttaaaatgaaatcggatataccaaaggcattgtgattttgacattcataattctttttttttttttttttttgagacggagtctcgctctgtcgcccaggctggagtgcaggggcgcgatctcggctcactgcaagctccgcctcccgggttcacatcattctcctgcctcagcctcccaagtagctgggactacaggcgcccgccacagcgcccggctaattttttgtatttttagtagagacggggtttcaccgtggtctcgatctcctgacctygtgaaccgcccccctcggcctcccaaagtgctgggattacaggcgtgagccaccgcgcccggcccataattctgatataattgggtatgaatttgctgatatgcttaggagtgttcataaaaggtagtattgttttttttttttttaagagtctcgctctgtcacccaggctgaagtgagtggccagtctcggctcactgcaacctccgcctcttgggttcaagcaatttttgtacctcagcttcccaagtagctgggattacaggcgcataccaccatgcctggctaatatatatatat

SEQ ID NO: 75807 - DNA, 601 bp, Human
aagcatagtgcccagcggagttgagtatcccacaaatgtttttccttgactgcttacaataatgacaaacgattgatgacttctttgcaatacttatttaaaatgaaatcggatataccaaaggcattgtgattttgacattcataattctttttttttttttttttttgagacggagtctcgctctgtcgcccaggctggagtgcaggggcgcgatctcggctcactgcaagctccgcctcccgggttcacatcattctcctgcctcagcctcccaagtagctgggactacaggcgcccrccacagcgcccggctaattttttgtatttttagtagagacggggtttcaccgtggtctcgatctcctgacctcgtgaaccgcccccctcggcctcccaaagtgctgggattacaggcgtgagccaccgcgcccggcccataattctgatataattgggtatgaatttgctgatatgcttaggagtgttcataaaaggtagtattgttttttttttttttaagagtctcgctctgtcacccaggctgaagtgagtggccagtctcggctcactgcaacctccgcctcttgggttcaagcaa

SEQ ID NO: 75808 - DNA, 601 bp, Human; identical to SEQ ID NO: 27681

SEQ ID NO: 75809 - DNA, 601 bp, Human; identical to SEQ ID NO: 27682

SEQ ID NO: 75810 - DNA, 601 bp, Human; identical to SEQ ID NO: 27683

SEQ ID NO: 75811 - DNA, 601 bp, Human; identical to SEQ ID NO: 27684

SEQ ID NO: 75812 - DNA, 601 bp, Human; identical to SEQ ID NO: 27685

SEQ ID NO: 75813 - DNA, 601 bp, Human; identical to SEQ ID NO: 27686

SEQ ID NO: 75814 - DNA, 601 bp, Human; identical to SEQ ID NO: 27687

SEQ ID NO: 75815 - DNA, 601 bp, Human; identical to SEQ ID NO: 27688

SEQ ID NO: 75816 - DNA, 601 bp, Human; identical to SEQ ID NO: 27689

SEQ ID NO: 75817 - DNA, 601 bp, Human; identical to SEQ ID NO: 27690

SEQ ID NO: 75818 - DNA, 601 bp, Human; identical to SEQ ID NO: 27691

SEQ ID NO: 75819 - DNA, 601 bp, Human; identical to SEQ ID NO: 27692

SEQ ID NO: 75820 - DNA, 601 bp, Human; identical to SEQ ID NO: 27693

SEQ ID NO: 75821 - DNA, 601 bp, Human; identical to SEQ ID NO: 27694

SEQ ID NO: 75822 - DNA, 601 bp, Human; identical to SEQ ID NO: 27695

SEQ ID NO: 75823 - DNA, 601 bp, Human; identical to SEQ ID NO: 27696

SEQ ID NO: 75824 - DNA, 601 bp, Human; identical to SEQ ID NO: 27697

SEQ ID NO: 75825 - DNA, 601 bp, Human; identical to SEQ ID NO: 27698

SEQ ID NO: 75826 - DNA, 601 bp, Human; identical to SEQ ID NO: 27699

SEQ ID NO: 75827 - DNA, 601 bp, Human; identical to SEQ ID NO: 27700

SEQ ID NO: 75828 - DNA, 601 bp, Human; identical to SEQ ID NO: 27701

SEQ ID NO: 75829 - DNA, 601 bp, Human; identical to SEQ ID NO: 27702

SEQ ID NO: 75830 - DNA, 601 bp, Human; identical to SEQ ID NO: 27703

SEQ ID NO: 75831 - DNA, 601 bp, Human; identical to SEQ ID NO: 27704

SEQ ID NO: 75832 - DNA, 601 bp, Human
aggattaggtgttattctcatacatccatagtaatcataaatgtaggaatagaataagttctatgacaataacctatcaaaaactgcacataaagacattatgaggaccttaaccaaattcacacctaagaggtaagttaagctacgtctgaacaaatggaaagattagttaatagtaaaagtgccattaactgcctaacaattgggcctttaacattaaataacttgcttgaatgaatttgtctccttataatggacacaatcatagtgactttcaagcaattaatttagaatgcttggyatttctaaaattacaaattttcttactatagctaaattatttcagtaacgcctccctaggaaagtgtgtcttcaagttgttttactgttgaatatttacaaaattattacgaaaattagcactaccgtttttagtacagtactgctattaccttttcatgatttgagtctctaaagatttgctatgttaatattattaccataaattagtttcaaccatggtacaaatctcaggacgaatcagtacattgtacgcactacttcttttgccacatgaaaaagagggaaatcaagagaagtc

SEQ ID NO: 75833 - DNA, 601 bp, Human
accatagtaccaaccaccattactattactatattagcatataataaccctttgtatatataagctcaacacataataggtgcttaataagtacagaagaaaagaaattctctctttgaggcccagtgttaaacagattaagcatcatctcttaccaataaatccctcttatattaacttaccctcctgggctgtgtagatgagaaaggcagaggaatctacatctttttacatgcaccttggttggcggggtgtgtgtttgtgtgtgtgtgtgtgtgtgtgtgtgtgtgtgtgtgtgtgtgtgtggagagagagagagccttatcataaggaagaaaaagtgtcctggaagtatagataagaaggatgtggcatagataaaggactttgggtggatttttgggtcctactctacatgaaaatacaataagcctacactgtttctgtcacatgttaccagtcagagtgaaatgaattgcgtgatcctgacctgctagttaactttgttgatccattacttcccttctctggttaggggcctgtttccagctccctgttctcgtcatttctgtcctgagtaggaaggactttaccgagggag

SEQ ID NO: 75834 - DNA, 601 bp, Human
aaagtgctgggattacaggtgtgagcctctatgcctgccctgatttgctttctgtaactataagttactttcattttctagaatttcgtatggcatacattatctcctccttcatgtctgactctttcatttagcgtcatgactttgggattcatccccaagtagcttcttcctttgtactgcagggtggtattccattgcatggatatagcacattttgtttatttgttcacttgttgatggatatttggatagtctctactttggggttttgtgaataaaggtactatgaacattcacrtaccagtctttgtgtggatatacattgagaattgatattttaataatgtagtgcaggtgacagaccctgactttaaaagttaaataccaaaatatcagcctaactaagtagctcatctaggacaacagctctttgtagttgtttccatttatttttaatttttcttcttatttttttgaggcaaggtctggtcctgtcacccaggctggagtgcagtggcgcaagcactgctcagtgcagccttgacctcctgggctccaaagattctcctgcctcagccccctagtagctgggaccaca

SEQ ID NO: 75835 - DNA, 601 bp, Human
tgtctgcctccagtccctccaaaataacattccccacactgtcaccaccatgatctcacaaaaaccaggtgcaccatgccattcccatgctgaagaccccctgatggttctcttctgcctgcagaataaactccaaactctttaatgtggtgtttaggccactttttacagttggatcttgatctaaatttctttttttaaatttttttttttttgttacggtctcactttgtcgcccaggctgaagtatactggcatgatcttggcttactgtagcctcaacctcccaggctcaggcagrtctgccaggctccgcggatcctcctgcctcagcctcctgagtagctgggattacaggcgcccaccatcatgcccaggtaatgtttgtatttttaatagagacggggtttcaccatcttggccaggctggccttggactcctgacctcgggtgttctgcccgccttggcttcccaaagtgctgggattacaggcgtgagccactgcaccggcctattttttaatgtataagagcaatacctggctgggcgcagtggctcacacctgttttttaatgtataagagcaatacttggccgggcg

SEQ ID NO: 75836 - DNA, 601 bp, Human
cgagccagacgatgaccttccaccccacggatgcttccctgagattccaccaagcccagacgtcacagcgtgttaggagagaggagatacccgtgggcagaagtttatgtaaacccatctggattttggtgaagaagtctcttggaaatgtaattctctcgggtagccgaaagatcaatttaattaatcatcagccgaggcttctctgagttttctggggatcaccatgttgaatgtattcactggcctacgacccatgtgagtaggagggaaaagaaatcatttggaaaacagaattgarccaccgttaattttttcccaaattcttcttccttaattttcaaaaatgcttaagacacaatttgtttttcacatttaaaatttttgcttggacaagctgataatattctcccatataaaaatgcttttagcttaattaatctcaaaggcaattcagatgctgaggaaagctggtaaacagtttgggagcagttgttcttggcactgaaggaaggagtggtattagggtgcccagcattactggggaggaattaaatcacatattttgggccatgtctaatatgggtgcatggacatggaa

SEQ ID NO: 75837 - DNA, 601 bp, Human
ccatcaaacaacgagccagacgatgaccttccaccccacggatgcttccctgagattccaccaagcccagacgtcacagcgtgttaggagagaggagatacccgtgggcagaagtttatgtaaacccatctggattttggtgaagaagtctcttggaaatgtaattctctcgggtagccgaaagatcaatttaattaatcatcagccgaggcttctctgagttttctggggatcaccatgttgaatgtattcactggcctacgacccatgtgagtaggagggaaaagaaatcatttggaaracagaattgaaccaccgttaattttttcccaaattcttcttccttaattttcaaaaatgcttaagacacaatttgtttttcacatttaaaatttttgcttggacaagctgataatattctcccatataaaaatgcttttagcttaattaatctcaaaggcaattcagatgctgaggaaagctggtaaacagtttgggagcagttgttcttggcactgaaggaaggagtggtattagggtgcccagcattactggggaggaattaaatcacatattttgggccatgtctaatatgggtgca

SEQ ID NO: 75838 - DNA, 601 bp, Human
aaaaggggaaatagattttggtaaagcagacagatgggtattgtaagagaagtaataggcactgccatgagaagtaaatgaaagtgcttgataaaatcaaagccttctgaaatagaatgtgtcatgtcaccgaataggaaggagattgggatgtattcaatacaaatgtaggcaaagaaaattgcatggtaatataaccatcaaacaacgagccagacgatgaccttccaccccacggatgcttccctgagattccaccaagcccagacgtcacagcgtgttaggagagaggagatacccrtgggcagaagtttatgtaaacccatctggattttggtgaagaagtctcttggaaatgtaattctctcgggtagccgaaagatcaatttaattaatcatcagccgaggcttctctgagttttctggggatcaccatgttgaatgtattcactggcctacgacccatgtgagtaggagggaaaagaaatcatttggaaaacagaattgaaccaccgttaattttttcccaaattcttcttccttaattttcaaaaatgcttaagacacaatttgtttttcacatttaaaatttttgcttgga

SEQ ID NO: 75839 - DNA, 601 bp, Human; identical to SEQ ID NO: 30021

SEQ ID NO: 75840 - DNA, 601 bp, Human; identical to SEQ ID NO: 30022

SEQ ID NO: 75841 - DNA, 601 bp, Human; identical to SEQ ID NO: 30023

SEQ ID NO: 75842 - DNA, 601 bp, Human; identical to SEQ ID NO: 30024

SEQ ID NO: 75843 - DNA, 601 bp, Human; identical to SEQ ID NO: 30025

SEQ ID NO: 75844 - DNA, 601 bp, Human; identical to SEQ ID NO: 30026

SEQ ID NO: 75845 - DNA, 601 bp, Human; identical to SEQ ID NO: 30027

SEQ ID NO: 75846 - DNA, 601 bp, Human; identical to SEQ ID NO: 30028

SEQ ID NO: 75847 - DNA, 601 bp, Human; identical to SEQ ID NO: 30029

SEQ ID NO: 75848 - DNA, 601 bp, Human; identical to SEQ ID NO: 30030

SEQ ID NO: 75849 - DNA, 601 bp, Human; identical to SEQ ID NO: 30031

SEQ ID NO: 75850 - DNA, 601 bp, Human; identical to SEQ ID NO: 30032

SEQ ID NO: 75851 - DNA, 601 bp, Human; identical to SEQ ID NO: 30033

SEQ ID NO: 75852 - DNA, 601 bp, Human; identical to SEQ ID NO: 30034

SEQ ID NO: 75853 - DNA, 601 bp, Human; identical to SEQ ID NO: 30035

SEQ ID NO: 75854 - DNA, 601 bp, Human; identical to SEQ ID NO: 30036

SEQ ID NO: 75855 - DNA, 601 bp, Human; identical to SEQ ID NO: 30037

SEQ ID NO: 75856 - DNA, 601 bp, Human; identical to SEQ ID NO: 31391

SEQ ID NO: 75857 - DNA, 601 bp, Human; identical to SEQ ID NO: 31392

SEQ ID NO: 75858 - DNA, 601 bp, Human; identical to SEQ ID NO: 31393

SEQ ID NO: 75859 - DNA, 601 bp, Human; identical to SEQ ID NO: 31394

SEQ ID NO: 75860 - DNA, 601 bp, Human; identical to SEQ ID NO: 31395

SEQ ID NO: 75861 - DNA, 601 bp, Human; identical to SEQ ID NO: 31396

SEQ ID NO: 75862 - DNA, 601 bp, Human; identical to SEQ ID NO: 31397

SEQ ID NO: 75863 - DNA, 601 bp, Human; identical to SEQ ID NO: 31398

SEQ ID NO: 75864 - DNA, 601 bp, Human; identical to SEQ ID NO: 31399

SEQ ID NO: 75865 - DNA, 601 bp, Human; identical to SEQ ID NO: 31400

SEQ ID NO: 75866 - DNA, 601 bp, Human; identical to SEQ ID NO: 31401

SEQ ID NO: 75867 - DNA, 601 bp, Human; identical to SEQ ID NO: 31402

SEQ ID NO: 75868 - DNA, 601 bp, Human; identical to SEQ ID NO: 31403

SEQ ID NO: 75869 - DNA, 601 bp, Human
tgcactttcaaactgtagaaaaacgaaatgaaaagtgaatctcagaacaaaaatcacccaagcaataacttagctcaccttatttaaaaattctcaaagcacacgtgaactgcatactttcactgagaagagatatatatttaggaagagtattagttataaataacccaatcaggtcacaggaaggatacagaaagacctcaacagacaccctaatggatatttctaatattattcattccccattcttagcaccaaagtcagcagcaccacctaccacatcaacttccacatcactttytgagcctgaccctgtctgagtcccttagggaggcaactagtggcctggatcatgcagcccaacgtataaaggctactaaggtatttagataatcattgctttgcgtgaattctttttttttttttccaatatgaacaaaacacctcactggtgtcagatttaggattataccccaccccgcccccacaaaaaaagaaaaaaaaaaaaaaaaaaaaaaaaaacggggccactgactgtggctattcgtgcaccatggcactaacattttataaagtgagagactgtatgaaaaataacatg

SEQ ID NO: 75870 - DNA, 601 bp, Human
gcccaggaggttgaggctgcagtaagccatgatggcatcactgcactccagcctgagcaacagagcaagactgtgtctcaaaaaaaaaaaaaaaaaaactttctatttttagtattatttaccccatggcaactgttaaaaccctgtccttgcatatacctgtggtctcagctacatgggaggctgaggtgggaggactgcttgagcccaggaggtcaaggctgcagtgaatggtgttcacacaccactgcactccagcctgggtgacagagcaagtctgtctcaaaaaaaaaaaaagaaagaaagaaaaaaactgtcctttttaatgtagtagaatcttttcagatgttttgctattaataatacaacctactagttaaaagtcaacagaaccaaagaactaataaactgccgcaagaacttaaatgcaccacagccaaaagagtttctcagctacacaccttagctaaactggactgcactttcaaactgtagaaaaacgaaatgaaaagtgaatctcagaacaaaaatcacccaagcaataacttagctcaccttatttaaaaattctcaaagcacacgtgaactgcatactttcact

SEQ ID NO: 75871 - DNA, 601 bp, Human
agagcccaggaggttgaggctgcagtaagccatgatggcatcactgcactccagcctgagcaacagagcaagactgtgtctcaaaaaaaaaaaaaaaaaaactttctatttttagtattatttaccccatggcaactgttaaaaccctgtccttgcatatacctgtggtctcagctacatgggaggctgaggtgggaggactgcttgagcccaggaggtcaaggctgcagtgaatggtgttcacacaccactgcactccagcctgggtgacagagcaagtctgtctcaaaaaaaaaaaaaraaagaaagaaaaaaactgtcctttttaatgtagtagaatcttttcagatgttttgctattaataatacaacctactagttaaaagtcaacagaaccaaagaactaataaactgccgcaagaacttaaatgcaccacagccaaaagagtttctcagctacacaccttagctaaactggactgcactttcaaactgtagaaaaacgaaatgaaaagtgaatctcagaacaaaaatcacccaagcaataacttagctcaccttatttaaaaattctcaaagcacacgtgaactgcatactttc

SEQ ID NO: 75872 - DNA, 601 bp, Human
ttatttcaataattttctaagaaaactctccaaaagacagaagcatgctaaaattgaggttctaaacagaccaggactagtcagaagtactacatataaagctgttattagtattaaagccacaaaagaaaaaagagaagacattagttttaatacaaatttgcaaatattatatagtcctaaaaatatgcagtattctcaccttgagagtattagcaagaactgatatatgtgatatggactttcataagaactgatatgctgggttcacagacttggtgtgaaagaagaaaaaaaaaaaggaaagaaaagaaaaaaaaagaactgatatgctaggtcagatcctgctctacccagccctgtatcaccttgacacaacagcatgaataaacatgtaatgacatggtatgggtcgatttaacaattaactgaggatcttccataaaattatctaaccttctgttaaatacatttacatttccaacctacatctctaactttgctagtcactgttttactcacacttcaaagtgcaattctaggaattctaaccattccagtctatcctcatctcctgaatcactttgactgtttttcccca

SEQ ID NO: 75873 - DNA, 601 bp, Human
acataatttcactgaatataaataaggttactgtaaatggtcacacagcagatccccagttgcctaaatatctcctttccacaaggactattagcattcctgagctatcagaatcaactggagaacgcagaagcacacaagaaaaatttgcaagtatcctaagagattatttcaataattttctaagaaaactctccaaaagacagaagcatgctaaaattgaggttctaaacagaccaggactagtcagaagtactacatataaagctgttattagtattaaagccacaaaagaaaaaasagaagacattagttttaatacaaatttgcaaatattatatagtcctaaaaatatgcagtattctcaccttgagagtattagcaagaactgatatatgtgatatggactttcataagaactgatatgctgggttcacagacttggtgtgaaagaagaaaaaaaaaaaggaaagaaaagaaaaaaaaagaactgatatgctaggtcagatcctgctctacccagccctgtatcaccttgacacaacagcatgaataaacatgtaatgacatggtatgggtcgatttaacaattaactgagga

SEQ ID NO: 75874 - DNA, 601 bp, Human
ccaacactattttcatgggttttatagatttatatctgcacaatatcctagagtttgatccaacctcttgtcccaatatgaacactcttcctttctggctaacatatttttgactgttaactgtcttaattcttaggacataatttcactgaatataaataaggttactgtaaatggtcacacagcagatccccagttgcctaaatatctcctttccacaaggactattagcattcctgagctatcagaatcaactggagaacgcagaagcacacaagaaaaatttgcaagtatcctaagrgattatttcaataattttctaagaaaactctccaaaagacagaagcatgctaaaattgaggttctaaacagaccaggactagtcagaagtactacatataaagctgttattagtattaaagccacaaaagaaaaaagagaagacattagttttaatacaaatttgcaaatattatatagtcctaaaaatatgcagtattctcaccttgagagtattagcaagaactgatatatgtgatatggactttcataagaactgatatgctgggttcacagacttggtgtgaaagaagaaaaaaaa

SEQ ID NO: 75875 - DNA, 601 bp, Human
tggtcgggcatggtggctcacgcctgtaatcccaacacttcgggaggccaaggcaggaggatcacttgagtccaggagttcaggacaaacctgggcaacacggcaaaatcccatctctacaaaaattacaaaaaattagctgggtgtggtccctcattaacagattttcttcataaacacgggttcactaccaactatgtctgagaaagttttattttgtagatggagaaaattagtagatccaaagttaaaagtacttatttggattgacacacagtagtcaaatctcaagtctccattytaagggatggatatttactgttaaaatgaccacgtcaactatttcctttaaaaacaaaatcgatggcgtgaacccgggaggcggagcttgcagtgagccgagatcacaccactgcactccggcctgggtgacagagcgagactccatctcaaaaaaaaaaaaaaaaaaaatccagtaattgctactttcctattgtcttatttctcaacaatgccctttttttttttaaaaaaaatcccttttttctaacatgatgtcttagtaaatattaagatctacaaagtttgtagttctggggtt

SEQ ID NO: 75876 - DNA, 601 bp, Human
taataaaaattaatgataaagcattcaggaaatgagtgaattaaaggtaaattgaagtttttcaaaaatgtgtttttgctggtcgggcatggtggctcacgcctgtaatcccaacacttcgggaggccaaggcaggaggatcacttgagtccaggagttcaggacaaacctgggcaacacggcaaaatcccatctctacaaaaattacaaaaaattagctgggtgtggtccctcattaacagattttcttcataaacacgggttcactaccaactatgtctgagaaagttttattttgtaratggagaaaattagtagatccaaagttaaaagtacttatttggattgacacacagtagtcaaatctcaagtctccattctaagggatggatatttactgttaaaatgaccacgtcaactatttcctttaaaaacaaaatcgatggcgtgaacccgggaggcggagcttgcagtgagccgagatcacaccactgcactccggcctgggtgacagagcgagactccatctcaaaaaaaaaaaaaaaaaaaatccagtaattgctactttcctattgtcttatttctcaacaatgcccttttt

SEQ ID NO: 75877 - DNA, 601 bp, Human
gtttaagtggagggcattaatttcccatgggttctgaaaaagtgccacacttgcctttccatagaaggaaaaataaaatgtaccaaatacaattttgtcaaagaatgtagaaattattaataaaaattaatgataaagcattcaggaaatgagtgaattaaaggtaaattgaagtttttcaaaaatgtgtttttgctggtcgggcatggtggctcacgcctgtaatcccaacacttcgggaggccaaggcaggaggatcacttgagtccaggagttcaggacaaacctgggcaacacggcraaatcccatctctacaaaaattacaaaaaattagctgggtgtggtccctcattaacagattttcttcataaacacgggttcactaccaactatgtctgagaaagttttattttgtagatggagaaaattagtagatccaaagttaaaagtacttatttggattgacacacagtagtcaaatctcaagtctccattctaagggatggatatttactgttaaaatgaccacgtcaactatttcctttaaaaacaaaatcgatggcgtgaacccgggaggcggagcttgcagtgagccgagat

SEQ ID NO: 75878 - DNA, 601 bp, Human
tgtttaagtggagggcattaatttcccatgggttctgaaaaagtgccacacttgcctttccatagaaggaaaaataaaatgtaccaaatacaattttgtcaaagaatgtagaaattattaataaaaattaatgataaagcattcaggaaatgagtgaattaaaggtaaattgaagtttttcaaaaatgtgtttttgctggtcgggcatggtggctcacgcctgtaatcccaacacttcgggaggccaaggcaggaggatcacttgagtccaggagttcaggacaaacctgggcaacacggyaaaatcccatctctacaaaaattacaaaaaattagctgggtgtggtccctcattaacagattttcttcataaacacgggttcactaccaactatgtctgagaaagttttattttgtagatggagaaaattagtagatccaaagttaaaagtacttatttggattgacacacagtagtcaaatctcaagtctccattctaagggatggatatttactgttaaaatgaccacgtcaactatttcctttaaaaacaaaatcgatggcgtgaacccgggaggcggagcttgcagtgagccgaga

SEQ ID NO: 75879 - DNA, 601 bp, Human
taaaataagcatctgttgttacaactcttaagttgctaatatttgacgtagtaggaaacatctttttctatatgatataatatatacatttctgatgtttaagtggagggcattaatttcccatgggttctgaaaaagtgccacacttgcctttccatagaaggaaaaataaaatgtaccaaatacaattttgtcaaagaatgtagaaattattaataaaaattaatgataaagcattcaggaaatgagtgaattaaaggtaaattgaagtttttcaaaaatgtgtttttgctggtcgggyatggtggctcacgcctgtaatcccaacacttcgggaggccaaggcaggaggatcacttgagtccaggagttcaggacaaacctgggcaacacggcaaaatcccatctctacaaaaattacaaaaaattagctgggtgtggtccctcattaacagattttcttcataaacacgggttcactaccaactatgtctgagaaagttttattttgtagatggagaaaattagtagatccaaagttaaaagtacttatttggattgacacacagtagtcaaatctcaagtctccattctaagggat

SEQ ID NO: 75880 - DNA, 601 bp, Human
tcgcttgaccccagaattacgaggacagctggggaacataggagaccccaaccctcataaaaattaaaaataaaatggcacccatgtactcttttctctatattgccttattaaaataagaatctgggccgagcacggtggctcacgcctgtaatcccaacattttgggaggccgagatgggtggatcacctgaggttgggagttcgagaccagcctgaccaacatggagaaaccctgtctctactaaaaatacaaaattagccaggcgtggtggcgcatccctgtaatcccagctactcrggatgccgaggcaggagaattgattgaacccaggaggcagaagttgaggtgagcagagattgtgccattatactctagcctgggcaacaagaacgaaactctgtctcaaaaaaataaaataaaataagcatctgttgttacaactcttaagttgctaatatttgacgtagtaggaaacatctttttctatatgatataatatatacatttctgatgtttaagtggagggcattaatttcccatgggttctgaaaaagtgccacacttgcctttccatagaaggaaaaataaaatgtacca

SEQ ID NO: 75881 - DNA, 601 bp, Human
tgttgagggcgcacttttgagtaataatcaattttaaaatgacacccatgagctgagcatggtgggaggggcttggggggaaagtctgtagacccagctactcaggaggctgagatgggaggatcgcttgaccccagaattacgaggacagctggggaacataggagaccccaaccctcataaaaattaaaaataaaatggcacccatgtactcttttctctatattgccttattaaaataagaatctgggccgagcacggtggctcacgcctgtaatcccaacattttgggaggccgagrtgggtggatcacctgaggttgggagttcgagaccagcctgaccaacatggagaaaccctgtctctactaaaaatacaaaattagccaggcgtggtggcgcatccctgtaatcccagctactcaggatgccgaggcaggagaattgattgaacccaggaggcagaagttgaggtgagcagagattgtgccattatactctagcctgggcaacaagaacgaaactctgtctcaaaaaaataaaataaaataagcatctgttgttacaactcttaagttgctaatatttgacgtagtaggaaa

SEQ ID NO: 75882 - DNA, 601 bp, Human
agcttgaggtgagatgtgtagaaaagagcccaaatgaagccactttaatacttaatagtaacagagaataatgggccagagagtaataggaaaagcatgaaagaaaggtctatcagagaagccaaaggattaacttctcaaaaaaagtaggaaaaaccaaccatgcaaaatgatgcagagaaaaaaagcacatgagaactaaaatgggaaagaattttgcaacatggaggttattagcattcagagagcagtggaaatagaacaggttaaagagtgaatgaaaagtgggagatggaggaaratgcttggttttttgtttttattttaaaagacagggtttcactgttgcccaggctggagtgcagtggcgcaaccatagctcactgcagcctcaaactcctgggctcaagtgatcctcccacctcagtctgccaagtagctgggactacagactaagctaatttttttttttttttttttttttttttgagacagggtcttgctttgttacccaagctgatctcaaactcctgggctcaagcaatcctcccacctcaacctcccaagtaactgggattacagacttgagccactgcagcta

SEQ ID NO: 75883 - DNA, 601 bp, Human
acagtctaccatgatgagttcaggcactgaagattttagaaaaaatggacaagcacagtggctcatgcctgtaatcccagcactttgggaggccgaggcaggcagagcacctgaggtcaggagttcaataccagcctggccaacatggtgaaaccccgtctctacaaaaaaatacaaaaagtagccaggcacggtggtgggtacctgtaatcccagctactgaggctgaggcagagagacttgcttgaacctgggaggtagaggttgcagtgagctgagatcacaccactgcactccagtytgggcgacagagtgagactccgtctcaaaaaaaaaaaaaagattttagaaaaaccatcaccaattgctaccatcacctctagactagccaccctccaatctgttctgaactccttccaatctgtagtcaatcctccttccaatctgttctccactctaaacaagagtaaccttcataaaaagtaaaaattatatcatcccattgctgaaaactttctttctcttttctttttttttttttttcttgaggcagagtctcactctgttgcccaggctggagtgcagtggcgtgctctcagct

SEQ ID NO: 75884 - DNA, 601 bp, Human
cttttcagtttgacgtcattccatttatttatttttgcttttatggcctaagcttttagtgtggaatccaaaaagaaaattctagctggacaccagcactatctggtgagctttttaaaaaattccagagcctgagacccaatctaaccctctccccctaaaaagatgccaatttcattggtctggggagaggccattagctattgatataccagtacaaaaatgtgtacaattaaacaagaaaattcaaaatacaaaaatcagggttttaccatataatataaaagataaaggcaagacrttaatatacagaccacagagtactacataataaattagagccacaagaggctaggcgcagtggctcacgcctgtaatcccagcactttaggaggccgaggagggtggatcacaaggtcaggagatcaaaccatcctggccaacatggtgaaacctcacctctactaaaaatataaaaattagccgggcatggtggtgtgcacctatagtcccagctactcgggaagctgaggcaggagaactgcttgaacccgggaggaggaggctgcagtgaaccaagatctagccactgcactccagc

SEQ ID NO: 75885 - DNA, 601 bp, Human
agtaccttttcatatacctgtcagccatccttatgtcttctttgaaaaaacatctgttcaagtcttttgcccattttctaatcagattatttttctattattgaattatatgagttcttcatgaattttagatattaatcccttatcagataaatggtttgcaaatatgttttcccagaccataggttgttacattttgttgattgtttcctttgttttgaagaagcttttcagtttgacgtcattccatttatttatttttgcttttatggcctaagcttttagtgtggaatccaaaaaraaaattctagctggacaccagcactatctggtgagctttttaaaaaattccagagcctgagacccaatctaaccctctccccctaaaaagatgccaatttcattggtctggggagaggccattagctattgatataccagtacaaaaatgtgtacaattaaacaagaaaattcaaaatacaaaaatcagggttttaccatataatataaaagataaaggcaagacattaatatacagaccacagagtactacataataaattagagccacaagaggctaggcgcagtggctcacgcctgt

SEQ ID NO: 75886 - DNA, 601 bp, Human
ccacatatgagatcatgcaatatttttcttcctgtgtctggcttatttcactcagcatactgcctccaggtcatccatgttgtggcaaatggcagtatctgcattttaaggctgaataatattccattatatatgcatatcacatgttctttatccattcatctatcagtggacattcaggttgtttccacagcttggctaatgtaaataacactgcaatgaacatgggagtgcagatatctttataaggtgatctcacttcctttaggtatatgcccgataaggaattgctgggtcatayagtacttctatttttcatttctttagcaacctccatactattttccatcatggctgtaccaatccacactcccaccaacagtgtacaaggggtccattttctccacaccctcgccaacatttgttatcacttcacttttttatgacagccaccctaaggggtgtgaggtgacgcccacagtggttttgatctgcatttctgcatggctaatgctgttgagtaccttttcatatacctgtcagccatccttatgtcttctttgaaaaaacatctgttcaagtcttttgcccattttctaat

SEQ ID NO: 75887 - DNA, 601 bp, Human
tttttttattttttttaagattccacatatgagatcatgcaatatttttcttcctgtgtctggcttatttcactcagcatactgcctccaggtcatccatgttgtggcaaatggcagtatctgcattttaaggctgaataatattccattatatatgcatatcacatgttctttatccattcatctatcagtggacattcaggttgtttccacagcttggctaatgtaaataacactgcaatgaacatgggagtgcagatatctttataaggtgatctcacttcctttaggtatatgcccaataaggaattgctgggtcatatagtacttctatttttcatttctttagcaacctccatactattttccatcatggctgtaccaatccacactcccaccaacagtgtacaaggggtccattttctccacaccctcgccaacatttgttatcacttcacttttttatgacagccaccctaaggggtgtgaggtgacgcccacagtggttttgatctgcatttctgcatggctaatgctgttgagtaccttttcatatacctgtcagccatccttatgtcttctttgaaaaaacatctgttca

SEQ ID NO: 75888 - DNA, 601 bp, Human
atttgactctttttttttattttttttaagattccacatatgagatcatgcaatatttttcttcctgtgtctggcttatttcactcagcatactgcctccaggtcatccatgttgtggcaaatggcagtatctgcattttaaggctgaataatattccattatatatgcatatcacatgttctttatccattcatctatcagtggacattcaggttgtttccacagcttggctaatgtaaataacactgcaatgaacatgggagtgcagatatctttataaggtgatctcacttcctttasgtatatgcccgataaggaattgctgggtcatatagtacttctatttttcatttctttagcaacctccatactattttccatcatggctgtaccaatccacactcccaccaacagtgtacaaggggtccattttctccacaccctcgccaacatttgttatcacttcacttttttatgacagccaccctaaggggtgtgaggtgacgcccacagtggttttgatctgcatttctgcatggctaatgctgttgagtaccttttcatatacctgtcagccatccttatgtcttctttgaaaaa

SEQ ID NO: 75889 - DNA, 601 bp, Human
acctttttttttttttttttggtttgtttttgtggcaaggacagctaaaaatctattcatttagcaggaattccaaatatagtacaattttattagctacagtcctcttattagctacatgttacacattagatctctaggctctttcatcctacatacttgctattttcttacccctcacctacatttcccattccccacccacttgctcctggtaacccactcttttattcactctgtatatttgactctttttttttattttttttaagattccacatatgagatcatgcaatatttktcttcctgtgtctggcttatttcactcagcatactgcctccaggtcatccatgttgtggcaaatggcagtatctgcattttaaggctgaataatattccattatatatgcatatcacatgttctttatccattcatctatcagtggacattcaggttgtttccacagcttggctaatgtaaataacactgcaatgaacatgggagtgcagatatctttataaggtgatctcacttcctttaggtatatgcccgataaggaattgctgggtcatatagtacttctatttttcatttcttta

SEQ ID NO: 75890 - DNA, 601 bp, Human
atggttactgcagtgaagcaaattaacatatatatcaacccacatagttacctttttttttttttttttggtttgtttttgtggcaaggacagctaaaaatctattcatttagcaggaattccaaatatagtacaattttattagctacagtcctcttattagctacatgttacacattagatctctaggctctttcatcctacatacttgctattttcttacccctcacctacatttcccattccccacccacttgctcctggtaacccactcttttattcactctgtatatttgactctttttttttattttttttaagattccacatatgagatcatgcaatatttttcttcctgtgtctggcttatttcactcagcatactgcctccaggtcatccatgttgtggcaaatggcagtatctgcattttaaggctgaataatattccattatatatgcatatcacatgttctttatccattcatctatcagtggacattcaggttgtttccacagcttggctaatgtaaataacactgcaatgaacatgggagtgcagatatctttataaggtgatctcacttcctttaggtatatgcc

SEQ ID NO: 75891 - DNA, 601 bp, Human
atttcattttttaaataaattttattgtatatatttaaagcatacaacatgatgttatgggattcatatagaaagcaaaatggttactgcagtgaagcaaattaacatatatatcaacccacatagttacctttttttttttttttttggtttgtttttgtggcaaggacagctaaaaatctattcatttagcaggaattccaaatatagtacaattttattagctacagtcctcttattagctacatgttacacattagatctctaggctctttcatcctacatacttgctattttcttrcccctcacctacatttcccattccccacccacttgctcctggtaacccactcttttattcactctgtatatttgactctttttttttattttttttaagattccacatatgagatcatgcaatatttttcttcctgtgtctggcttatttcactcagcatactgcctccaggtcatccatgttgtggcaaatggcagtatctgcattttaaggctgaataatattccattatatatgcatatcacatgttctttatccattcatctatcagtggacattcaggttgtttccacagcttgg

SEQ ID NO: 75892 - DNA, 601 bp, Human
tgagtaattgtgtcagaccatatggcatgcaaagcctaaaatatttactatctggccctttacaggaaacacctgcccactcttgctctagaaaagtgattctcaactctaggtggacatcagcactacctggtgagcttttattctttttatatcaaccatatattttatttcattttttaaataaattttattgtatatatttaaagcatacaacatgatgttatgggattcatatagaaagcaaaatggttactgcagtgaagcaaattaacatatatatcaacccacatagttacctttttttttttttttttggtttgtttttgtggcaaggacagctaaaaatctattcatttagcaggaattccaaatatagtacaattttattagctacagtcctcttattagctacatgttacacattagatctctaggctctttcatcctacatacttgctattttcttacccctcacctacatttcccattccccacccacttgctcctggtaacccactcttttattcactctgtatatttgactctttttttttattttttttaagattccacatatgagatcatgcaatatttttct

SEQ ID NO: 75893 - DNA, 601 bp, Human
aatcacattttccaaatcaaaaatcaggaccagtatgacactacctgacaaattacgtgtatcctaatttcttaatctattctggaagagtataaaacttacaaaactgtaagtatcaattaatctctactgtaatcaattgaattttctatgctactgctattccaaaaaatctgagatgtgaacaaagggatattctgttcacacagaaacaagagacaaaaaataataatttattaataaattatcacatcagatcccaggcaaataggtaatttaatcacttagaaatctaaacacmaattaacaggatacaaaagcatttttaaaaaggcattcacctcagtatatgggccacaccaatacagttttggtccatcatcaaccactaccattagattctagcatagtaattaaaattcaggctgtataacaaagatcaagaaactatgtccctgctcaggccaaatacttctccccatttttgcaaataacattttactaaaacatagccacatccattccttacatatcatctatggttttcttactacaatagcagagttgagtaattgtgtcagaccatatggcatgcaaagcc

SEQ ID NO: 75894 - DNA, 601 bp, Human
tacggtctgcagaaccacaagtcaaataaattacccagcctgaagtattcctttgtagcaacacaaacagactaagacactcacttaaaccagcttacaacacagtttcacagaatagtcttagctatctccagcctagtgattcattaatcacattttccaaatcaaaaatcaggaccagtatgacactacctgacaaattacgtgtatcctaatttcttaatctattctggaagagtataaaacttacaaaactgtaagtatcaattaatctctactgtaatcaattgaattttctatrctactgctattccaaaaaatctgagatgtgaacaaagggatattctgttcacacagaaacaagagacaaaaaataataatttattaataaattatcacatcagatcccaggcaaataggtaatttaatcacttagaaatctaaacaccaattaacaggatacaaaagcatttttaaaaaggcattcacctcagtatatgggccacaccaatacagttttggtccatcatcaaccactaccattagattctagcatagtaattaaaattcaggctgtataacaaagatcaagaaactatgt

SEQ ID NO: 75895 - DNA, 601 bp, Human
agcagatgttggcaccatgcttcttatacggtctgcagaaccacaagtcaaataaattacccagcctgaagtattcctttgtagcaacacaaacagactaagacactcacttaaaccagcttacaacacagtttcacagaatagtcttagctatctccagcctagtgattcattaatcacattttccaaatcaaaaatcaggaccagtatgacactacctgacaaattacgtgtatcctaatttcttaatctattctggaagagtataaaacttacaaaactgtaagtatcaattaatctstactgtaatcaattgaattttctatgctactgctattccaaaaaatctgagatgtgaacaaagggatattctgttcacacagaaacaagagacaaaaaataataatttattaataaattatcacatcagatcccaggcaaataggtaatttaatcacttagaaatctaaacaccaattaacaggatacaaaagcatttttaaaaaggcattcacctcagtatatgggccacaccaatacagttttggtccatcatcaaccactaccattagattctagcatagtaattaaaattcaggct

SEQ ID NO: 75896 - DNA, 601 bp, Human
agtagaagcaacttgaagcactcatcagaagcagatgttggcaccatgcttcttatacggtctgcagaaccacaagtcaaataaattacccagcctgaagtattcctttgtagcaacacaaacagactaagacactcacttaaaccagcttacaacacagtttcacagaatagtcttagctatctccagcctagtgattcattaatcacattttccaaatcaaaaatcaggaccagtatgacactacctgacaaattacgtgtatcctaatttcttaatctattctggaagagtataaaamttacaaaactgtaagtatcaattaatctctactgtaatcaattgaattttctatgctactgctattccaaaaaatctgagatgtgaacaaagggatattctgttcacacagaaacaagagacaaaaaataataatttattaataaattatcacatcagatcccaggcaaataggtaatttaatcacttagaaatctaaacaccaattaacaggatacaaaagcatttttaaaaaggcattcacctcagtatatgggccacaccaatacagttttggtccatcatcaaccactaccattag

SEQ ID NO: 75897 - DNA, 601 bp, Human
caggcatggtggcatgagcctatagtcctagctactggggaggctgaggtgggaggactgcttgagcccaggaggttgaggctgcagtgagccgagatcatgccactgcactccagcctgggcgacagagcaggaccctgtctcaaaaacaaaaataaggggaaaaaaaggtaactttactaggaaattacttaagcagtataatgcatcttttaacaaactactaggtagggtggtagttaacactgtcacaatcagcaccacccttaactgacttgagaaaaagaagtacttctgtttaaaaaaaaaaaaaaacatgccaggcttggtggctcacacctgtaatcccaatgcgttgggaggtcaaggtaggaggattacctgaggccaggagtttgagagcagacacagcaacacagcaaaaccatgtctctacagaaaaaataaaaataaataaatctttaaagtttgcactttaaagatggtaaagatggcaaaaatggtagcacgtgcctgtagtcccaacaacttggaaggctaaggcaagggaactgctggaacccaggactttgggaccacagtgagctatgatcacacgact

SEQ ID NO: 75898 - DNA, 601 bp, Human
aaagaaaaaaaattaatatactggaatatcatctagtcaataaaaatgacaacctcaaaaagcacaggcaacaaagcaaagtcaaatggaattacataaagctaaaaagctcctgcacaagaaaggaaacaatcaacaaagtaaaacgacaacccatagatggaagaaaatatttgcaaactatccatctgacacaggaccaacaaccagaatatataaggagctcatacaatgcaatggcaaaaaaacaaataatccaaaaggaaaatggcaaaagatctggacagatacttctcaagacatacaaaacacaaacacacacacacacacacacacacacacacacacacacaaaagaagacatacgaatggcaaacaggtatgtgaaaaaatattcaacatcattaatcagagaaacacaaatcaaaaccacaatgcaacagaccaggcacggtggctcacgcctgtaatcccagcactttgggaggccaaggcaggcggatcacctgaggtcaggagttcgagaccagcctaggtaacatagtgaaaccctgtctctactaaaaatacaaaaattaagccgggcacagtagctcatgcc

SEQ ID NO: 75899 - DNA, 601 bp, Human
aaaaagaaaaaaaattaatatactggaatatcatctagtcaataaaaatgacaacctcaaaaagcacaggcaacaaagcaaagtcaaatggaattacataaagctaaaaagctcctgcacaagaaaggaaacaatcaacaaagtaaaacgacaacccatagatggaagaaaatatttgcaaactatccatctgacacaggaccaacaaccagaatatataaggagctcatacaatgcaatggcaaaaaaacaaataatccaaaaggaaaatggcaaaagatctggacagatacttctcaagacatacaaaacacaaacacacacacacacacacacacacacacacacacacacaaaagaagacatacgaatggcaaacaggtatgtgaaaaaatattcaacatcattaatcagagaaacacaaatcaaaaccacaatgcaacagaccaggcacggtggctcacgcctgtaatcccagcactttgggaggccaaggcaggcggatcacctgaggtcaggagttcgagaccagcctaggtaacatagtgaaaccctgtctctactaaaaatacaaaaattaagccgggcacagtagctcatg

SEQ ID NO: 75900 - DNA, 601 bp, Human
cgcttgaacccggaaggtggaggttgcagtgagctgagaccacgccactgcactccagcctgggcgacagagcgagattccatctcaaaaatacaaaaaagaaaaaaaattaatatactggaatatcatctagtcaataaaaatgacaacctcaaaaagcacaggcaacaaagcaaagtcaaatggaattacataaagctaaaaagctcctgcacaagaaaggaaacaatcaacaaagtaaaacgacaacccatagatggaagaaaatatttgcaaactatccatctgacacaggaccaayaaccagaatatataaggagctcatacaatgcaatggcaaaaaaacaaataatccaaaaggaaaatggcaaaagatctggacagatacttctcaagacatacaaaacacaaacacacacacacacacacacacacacacacacacacacaaaagaagacatacgaatggcaaacaggtatgtgaaaaaatattcaacatcattaatcagagaaacacaaatcaaaaccacaatgcaacagaccaggcacggtggctcacgcctgtaatcccagcactttgggaggccaaggcaggcggatc

SEQ ID NO: 75901 - DNA, 601 bp, Human
cctgtaatcccagctactcaggagggtgaggcaggagaatcgcttgaacccggaaggtggaggttgcagtgagctgagaccacgccactgcactccagcctgggcgacagagcgagattccatctcaaaaatacaaaaaagaaaaaaaattaatatactggaatatcatctagtcaataaaaatgacaacctcaaaaagcacaggcaacaaagcaaagtcaaatggaattacataaagctaaaaagctcctgcacaagaaaggaaacaatcaacaaagtaaaacgacaacccatagatggragaaaatatttgcaaactatccatctgacacaggaccaacaaccagaatatataaggagctcatacaatgcaatggcaaaaaaacaaataatccaaaaggaaaatggcaaaagatctggacagatacttctcaagacatacaaaacacaaacacacacacacacacacacacacacacacacacacacaaaagaagacatacgaatggcaaacaggtatgtgaaaaaatattcaacatcattaatcagagaaacacaaatcaaaaccacaatgcaacagaccaggcacggtggctcacgc

SEQ ID NO: 75902 - DNA, 601 bp, Human
taagcacaaacaatgacaaatatgccatgaccgctgactggctgatgactttttaaggacatgattacttgtaaagtgtttcccaatttcagagatactaagtaggggaggggcagttactagaattcatgaaatacagtatataagaaacacttctcaatttaacggccttttaaaaaataaagtatgttggccgggcgcagtggctcactcctgtaatcccagcactttgggaggccaaggcgggcggatcacgaggtcaggagatcaagaccatcctggctaacacaatgaaaccctrtctctattaaaaaatacaaaaaaattagctgggaatggtggcgggcgcctgtagtcccaactacctgggaggctgaggcagaagaatggcgtgaacccaggaggcggagcttgcagtgaaccgagatcacgtcactgcactccagcctgggtgacaaagtgagactccatctcaaaaaataaaataaaataaaataaataaataaataatgtatgttaacaccaatggaaaggattttaaatctcaggttttaatacctgttgcaggaataattttatacactatgaagtacacaaaaac

SEQ ID NO: 75903 - DNA, 601 bp, Human
caaattcacataagcacaaacaatgacaaatatgccatgaccgctgactggctgatgactttttaaggacatgattacttgtaaagtgtttcccaatttcagagatactaagtaggggaggggcagttactagaattcatgaaatacagtatataagaaacacttctcaatttaacggccttttaaaaaataaagtatgttggccgggcgcagtggctcactcctgtaatcccagcactttgggaggccaaggcgggcggatcacgaggtcaggagatcaagaccatcctggctaacacartgaaaccctatctctattaaaaaatacaaaaaaattagctgggaatggtggcgggcgcctgtagtcccaactacctgggaggctgaggcagaagaatggcgtgaacccaggaggcggagcttgcagtgaaccgagatcacgtcactgcactccagcctgggtgacaaagtgagactccatctcaaaaaataaaataaaataaaataaataaataaataatgtatgttaacaccaatggaaaggattttaaatctcaggttttaatacctgttgcaggaataattttatacactatgaagt

SEQ ID NO: 75904 - DNA, 601 bp, Human
aacttccaaaaaaaaaaaatacaaaacatgtggctgggcatggtggttcacatctgtaatcccagcagtttgggaggcccaggcaggtggatggcttaaggtcaggagttcaagaccagactggccagcatggtgaaaccccatctctactaaaaatacaaaaattagccaggagtggtcgcaggcacctgtaatcccagctactcgggaggctgaggcgtaagaatcacttggacccaggaggcggagcttgcagtgagccgagatagtgccactgcactccagcctgggcgacaaagcragactctgtctcaaaggaaaaaaaaacctctttacgtatgttttattttattccatatgatctaagatctaatcaaagattgttcatagctgttaacagtcatatttctatttcatatccttaaatacagaacacactcccaatcctgacccttttctcctttcaaaacatagaaattattttttaaatccaggtatcttgtaaaaaaatcctacaacctggattcatctgattgtttcctcatgattagattcagattgaacattgtgtcaagaatactatatattaatagctgatgct

SEQ ID NO: 75905 - DNA, 601 bp, Human
aaatgtcacatctgtcacaacatatttgtcttttatagcttttaacttatctctaatccaaacctatacccaaatttctccaacttccaaaaaaaaaaaatacaaaacatgtggctgggcatggtggttcacatctgtaatcccagcagtttgggaggcccaggcaggtggatggcttaaggtcaggagttcaagaccagactggccagcatggtgaaaccccatctctactaaaaatacaaaaattagccaggagtggtcgcaggcacctgtaatcccagctactcgggaggctgaggcrtaagaatcacttggacccaggaggcggagcttgcagtgagccgagatagtgccactgcactccagcctgggcgacaaagcgagactctgtctcaaaggaaaaaaaaacctctttacgtatgttttattttattccatatgatctaagatctaatcaaagattgttcatagctgttaacagtcatatttctatttcatatccttaaatacagaacacactcccaatcctgacccttttctcctttcaaaacatagaaattattttttaaatccaggtatcttgtaaaaaaatcctacaacc

SEQ ID NO: 75906 - DNA, 601 bp, Human
taaccccacttagataacaaaacaagggtcccatgtgcatttttttaagttttctaccattttgtttccatgtctttaactctcctcccattccttctagaaatgtcacatctgtcacaacatatttgtcttttatagcttttaacttatctctaatccaaacctatacccaaatttctccaacttccaaaaaaaaaaaatacaaaacatgtggctgggcatggtggttcacatctgtaatcccagcagtttgggaggcccaggcaggtggatggcttaaggtcaggagttcaagaccagmctggccagcatggtgaaaccccatctctactaaaaatacaaaaattagccaggagtggtcgcaggcacctgtaatcccagctactcgggaggctgaggcgtaagaatcacttggacccaggaggcggagcttgcagtgagccgagatagtgccactgcactccagcctgggcgacaaagcgagactctgtctcaaaggaaaaaaaaacctctttacgtatgttttattttattccatatgatctaagatctaatcaaagattgttcatagctgttaacagtcatatttctatttcatatc

SEQ ID NO: 75907 - DNA, 601 bp, Human
ttgggcatgggggctcatgactgtaatctcagcattttgggaggtcatggcgagaggactgcttaagctcaggagttcgagaccagcctgagcaacatagtgacaccctgtctctacaaaaataaaaaatcagataggcctggtggcttatgcctgtggtcccagctacttgggagcttgaggtgggaggatcagttgggccagggaggttgaggctgcaatgagctgtgattgcaccactacactccaagcctgagcaacagaacaagaccctgtctcctttaaaaaaaaaaaaaaaaaaaaaactaccaaactattttacaaagaaacagaaacaacattatttggcattctcactagaaacttatgaaaattctagtgctccacatccttgccaacacttggtatggtcagtctttttaattttaaatattctagtaggtatatagtggtatctcattatggttttaatttccattttgctatcaaatcataatgttttcaagtgcttgtgcagcatccatttcttcattgataaaatgttcaaatattttgcccatttttttaattttaaagacagtgtctttctctgtacccaagg

SEQ ID NO: 75908 - DNA, 601 bp, Human
gtatcataatttgtttctccatttatcagctgatggacatttgggttgtttccagttctgggctactatgaatatttgagtagaaggtcttgtgtggaggtatgttttcatttcttttgggtaatacctaaagatacaactgctgagtcacatggtaagttaagtgtatatttaacattgtaagaaactaccagttgggcatgggggctcatgactgtaatctcagcattttgggaggtcatggcgagaggactgcttaagctcaggagttcgagaccagcctgagcaacatagtgacacsctgtctctacaaaaataaaaaatcagataggcctggtggcttatgcctgtggtcccagctacttgggagcttgaggtgggaggatcagttgggccagggaggttgaggctgcaatgagctgtgattgcaccactacactccaagcctgagcaacagaacaagaccctgtctcctttaaaaaaaaaaaaaaaaacaaaactaccaaactattttacaaagaaacagaaacaacattatttggcattctcactagaaacttatgaaaattctagtgctccacatccttgccaacacttggta

SEQ ID NO: 75909 - DNA, 601 bp, Human
ggtacagtagtataaccaccatgataaagaacatttccctcataactccctccccatcctccggaccctggaaaccactgacttcctttctgtcacaacagttttgccttttctagagtttcatataaatagaattgaaagctacagtcttctgtatctggcttcttccacttagcagaatgcccttaagattcatccttgttaccgctaagtagtgttctattttatggatgtatcataatttgtttctccatttatcagctgatggacatttgggttgtttccagttctgggctactawgaatatttgagtagaaggtcttgtgtggaggtatgttttcatttcttttgggtaatacctaaagatacaactgctgagtcacatggtaagttaagtgtatatttaacattgtaagaaactaccagttgggcatgggggctcatgactgtaatctcagcattttgggaggtcatggcgagaggactgcttaagctcaggagttcgagaccagcctgagcaacatagtgacaccctgtctctacaaaaataaaaaatcagataggcctggtggcttatgcctgtggtcccagctacttggga

SEQ ID NO: 75910 - DNA, 601 bp, Human
acgaaatgcatacattaaaatttaaaaattttcagtgtacaattcaatgtgctttgataaatgggtacagtagtataaccaccatgataaagaacatttccctcataactccctccccatcctccggaccctggaaaccactgacttcctttctgtcacaacagttttgccttttctagagtttcatataaatagaattgaaagctacagtcttctgtatctggcttcttccacttagcagaatgcccttaagattcatccttgttaccgctaagtagtgttctattttatggatgtatcmtaatttgtttctccatttatcagctgatggacatttgggttgtttccagttctgggctactatgaatatttgagtagaaggtcttgtgtggaggtatgttttcatttcttttgggtaatacctaaagatacaactgctgagtcacatggtaagttaagtgtatatttaacattgtaagaaactaccagttgggcatgggggctcatgactgtaatctcagcattttgggaggtcatggcgagaggactgcttaagctcaggagttcgagaccagcctgagcaacatagtgacaccctgtc

SEQ ID NO: 75911 - DNA, 601 bp, Human
attaatattaagtacgaaatgcatacattaaaatttaaaaattttcagtgtacaattcaatgtgctttgataaatgggtacagtagtataaccaccatgataaagaacatttccctcataactccctccccatcctccggaccctggaaaccactgacttcctttctgtcacaacagttttgccttttctagagtttcatataaatagaattgaaagctacagtcttctgtatctggcttcttccacttagcagaatgcccttaagattcatccttgttaccgctaagtagtgttctattktatggatgtatcataatttgtttctccatttatcagctgatggacatttgggttgtttccagttctgggctactatgaatatttgagtagaaggtcttgtgtggaggtatgttttcatttcttttgggtaatacctaaagatacaactgctgagtcacatggtaagttaagtgtatatttaacattgtaagaaactaccagttgggcatgggggctcatgactgtaatctcagcattttgggaggtcatggcgagaggactgcttaagctcaggagttcgagaccagcctgagcaacata

SEQ ID NO: 75912 - DNA, 601 bp, Human
gctgctttccttaaacctcatgaacccgctggcttccaacttttcttctatagctttctcacctcacctctctcagccttcacagaactgaacagttagggccttgttctgaattaggctttggcttaagggaatattgtggctagtttgattttttttttttttcttttttgagacggagtctcgctctgttgctcaggctggagtgcagtggcacaatcttggcttactgcaacttccacctcccaggttcaagagattctcctgcctcagcctcccaagtagctgggactacaggcaygagccaccatgcctgcctaattttttgtatttttagtagagacaggatttcatcatgttgtccaggctggtcttgatctcctgacctcatgatccaccagcctcggcctcccaaagtgcaaggattacaggcgtgagccaccgtgcccggcctggtttgaccttctttttttttatctcgagacagagtctcactctgtcgcccaggctggagtgcagtggcgtgatctcggctcaccgcaagctccttctcccaggttcatgccattctcctgcctcagcctcccaagcagctggcact

SEQ ID NO: 75913 - DNA, 601 bp, Human
tcccaatagaagactgtttcgtctacatggaaaatctgatattaagtgtagcaaccttcgataatcttagctagatcttctgggtaacttgctgcagcttctacatcagcacttgctgctttaccttgcactttcacgttatagagatggctgctttccttaaacctcatgaacccgctggcttccaacttttcttctatagctttctcacctcacctctctcagccttcacagaactgaacagttagggccttgttctgaattaggctttggcttaagggaatattgtggctagtttgattttttttttttttcttttttgagacggagtctcgctctgttgctcaggctggagtgcagtggcacaatcttggcttactgcaacttccacctcccaggttcaagagattctcctgcctcagcctcccaagtagctgggactacaggcacgagccaccatgcctgcctaattttttgtatttttagtagagacaggatttcatcatgttgtccaggctggtcttgatctcctgacctcatgatccaccagcctcggcctcccaaagtgcaaggattacaggcgtgagccaccgtgcccggc

SEQ ID NO: 75914 - DNA, 601 bp, Human
aagaaactatttcctttgttcacctataaggaacaactcatccattcaagttttcttgtgagattgcagccacttcttcgggctccaattctaattctcattagttctcttgctgttcccaccatatctgcagttacttcctccactgaagtcttgaacccctcagcatcatccatgagggctggaatcaacttcttccaaaatcctgttaatgttgatattctgacctcctcccatgaattactaatgttcctaatggcatccagaatggtgaatcctttccagaaagttttcaatttayttttcccaagttcatcagaggaatcactatctaaggcagctatagccttacaaaatgtatttcttaaatagtaagattggaaagtcaaaattactctatggggctgcaaaataagtatgtgttagcaggcatgaaaacaacattaatctccttatacatcaccatcttagatgactaggtgcactgtcaatgagcagtaatattttgaatggaatctttttatccgagcaggtctcaacagttggcttaaaagattccataaaccatgctgtaaacagatatgctgtcatccaggcttgg

SEQ ID NO: 75915 - DNA, 601 bp, Human
tgtacacagttattcactgcagcactatctataatagcagaagactggaaacaacccatataactatcaataggagactgtttgaataagctataatatctccacacaatagagtattatactgccataataaggacaaggaattcaaggaatttctctgttaccatgactccatgatctccagaatattgctaaggtgaaaaaaaaaatgtgggaaaaaatgtgtataatatgctacttcttaacagagggaaatatgaaaatgcatgtttttttaaaggaaaaacaaaccttggcattaaaaaaaaaatcacatacaggaggagaggtaataaataggatagagaaaacatggacagtagatagaatcccttaagcatatcttgtttcacagatttctctttggaactacatacaggcacactgcaaagatactgcggttttggctagagacagtgtatatataaaagttatgtttatattatgctgtagtctattaaatgtgcgatagtactatgtctaaaaaaactaggtacatgccttaattaaaaatactttattgcttaaaacagaatgctaaccatcttcagagccttcagag

SEQ ID NO: 75916 - DNA, 601 bp, Human
cacaaagatttgcatacaaatgttttcataggatttgtaatagccaaaacctaaaaacaacccagatttccatcaacatgtgaacacataaacaaaatgtgtaacaatagaaactactcagcaataaaagagtgaactacttttacatgcaaaaacatgaatgaatctcaaaataattatccatagtaaaacatgccagaccaaaaaaaaaaatagtaaatactatatgattccatttatataaaaatttagaaaatgtaaactaatctctagggacagaaaccctaaggacaagggacamgagggagggattacgtaggagaatgaagaaatttggcagggggaaaggggatggttcattatcttgaatgtgttgatggtcacatgggtatacatgtgtgtcaaaacttataaaaattctgttctttatgtacaaataactttacgtcagaaaagctcttaacagtaggacagtggtgacagttgtacaatgtgaatgtacttaatgctactgaattatacacttaaaaatggttaaaatggtcaattttatgttatgtttaccttatcatgataaaaaaaggactaaaagaaaaacagc

SEQ ID NO: 75917 - DNA, 601 bp, Human
ttcttctaaagtgaaacagacacctaccacatgacctctccattctgcacagaggtacttacccaaaagaaataaaagcatatgaccacacaaagatttgcatacaaatgttttcataggatttgtaatagccaaaacctaaaaacaacccagatttccatcaacatgtgaacacataaacaaaatgtgtaacaatagaaactactcagcaataaaagagtgaactacttttacatgcaaaaacatgaatgaatctcaaaataattatccatagtaaaacatgccagaccaaaaaaaaaawtagtaaatactatatgattccatttatataaaaatttagaaaatgtaaactaatctctagggacagaaaccctaaggacaagggacaagagggagggattacgtaggagaatgaagaaatttggcagggggaaaggggatggttcattatcttgaatgtgttgatggtcacatgggtatacatgtgtgtcaaaacttataaaaattctgttctttatgtacaaataactttacgtcagaaaagctcttaacagtaggacagtggtgacagttgtacaatgtgaatgtacttaatgctact

SEQ ID NO: 75918 - DNA, 601 bp, Human
gaaacaaaaattcctaatacacacacaaaccaatgtaattcaccatattaatagacatatatatatatacatacacacacatatatatgatcatttcaacaaatgcaaagaagcgtttgataaaattcaccacccattcctgataagaacactcagcaaactaagactaagtggtataaccactttgaaaaacaatttggtaggttcttctaaagtgaaacagacacctaccacatgacctctccattctgcacagaggtacttacccaaaagaaataaaagcatatgaccacacaaagatttgcatacaaatgttttcataggatttgtaatagccaaaacctaaaaacaacccagatttccatcaacatgtgaacacataaacaaaatgtgtaacaatagaaactactcagcaataaaagagtgaactacttttacatgcaaaaacatgaatgaatctcaaaataattatccatagtaaaacatgccagaccaaaaaaaaaaatagtaaatactatatgattccatttatataaaaatttagaaaatgtaaactaatctctagggacagaaaccctaaggacaagggacaagagggagg

SEQ ID NO: 75919 - DNA, 601 bp, Human
gagcgagactccgtctcaataaaagaaaaaagaaagtgcatgacaccaacagccctaagacaggagagaagtggaatcaactattacaaagtcttaaacatactcctgaagtaatagcatagtctaccttcaagtgatattaaaaagtttaaagatgtttaccagaagccctaaggcaaacatgaatgaaataataaaagagagaagcagaacaaagtgttacaccaaatcagcaccccccccaaaaaaaattcactccattaacacacaaggaggcagaaaaagaggataaaaggaaagytggaatggttgtattcatatcagacaaagcagatttctgaagaatactacccaagataaaaagaggctttacaaagataaagggtctattcatcaagtggacctaacaagccaaagcatttgtgtacctaatatagtatcacttcaaaatacgtaacagaaaaaagactaaaatgcaaagaaaaatagacattcagaattatagttggagatttcaatttaccttccttaataattgataaaacaattagatagaatcagtaaagatacagaagaattgaatattatcaaccaacttgac

SEQ ID NO: 75920 - DNA, 601 bp, Human
gtggcgacttatacctgtaatctgtaatcccagtactctgggagaccgaggtgggtggatcacgaggtcaggggttcaagaccaacctggccaagatggtgaaaccctgtctctactaaaaatacaaaaattagccgggcatggtggcgggcacccataatcccagctactcactcgggaggctgagacagagaattgcttgcacgtgggaggcagaggttgcagtgagccgagatcgcaccactgtactccagcctgggtgacagagcgagactccgtctcaataaaagaaaaaagaaartgcatgacaccaacagccctaagacaggagagaagtggaatcaactattacaaagtcttaaacatactcctgaagtaatagcatagtctaccttcaagtgatattaaaaagtttaaagatgtttaccagaagccctaaggcaaacatgaatgaaataataaaagagagaagcagaacaaagtgttacaccaaatcagcaccccccccaaaaaaaattcactccattaacacacaaggaggcagaaaaagaggataaaaggaaagctggaatggttgtattcatatcagacaaagcagatt

SEQ ID NO: 75921 - DNA, 601 bp, Human
acagaaaggacttatcagtaattacttcaccaaggaaagctactaatatttggtaacttaatctaagacaggaaaaatgggggataaaattgttaaaatagaaaactttataaatctaaaacatgtcaacacacaaacagaaagttaaaagctccacactgaaaggaaagggactctttcctgaaataattaaggtttagtttatccaagtcctgatagaattggagatgatttttgtttgttttagtttaaaaattttttgaaactgaaaactcaaacaagctctgaattctaaattttragattatgtcctaattggcacataatctatgctgtattaagagattataaagcagaattttaactaaaaacacaccactcaacagccaaggtatgacagatgtaaatccctcataaagctctgagagatttaaaaaaaaatttctttcactacaatgcatttacttaaacaatgttttaagaatagcaatttggaagagcaaggaaatactctttttaattccccaattaagaataaatgccccccccaaaagcctgtttttatgtaaatttagccaattagatttcagctgcatttaag

SEQ ID NO: 75922 - DNA, 601 bp, Human
ctacaggtggggatgtattatcaaattgggtgattcttttaaaatgggagcatgatggcctgcatataatattcgcaatacataatctataggaactaaactgtaataaccacataaagcaatagttctctgactgatctaaagactcctgaagtccccaagatcctgtcttttctaactacatatttttgtgaagcaaaatttcttcacatacttcaacccaaacaacaaatcacaacagagtgaatgaagaagcagacatgagaacccagtgatcgtctaccaaacattttaaagacaytttcagaaatgtaaaacaatgccactcttctcataaatttatttgttttggataacagtttttttcattaaaatgttatttgtactaacagtggatttcttttattgttaaatgagttaaatactttttaaatttgtttgaatatctgatatgataaatactggaagatctacccaatgaatccaaagcccacgtagatcctcaataatttaagatgtaaaaggttcctaacaaaacatctgagaaaccagagcactgactcagttagtgtttccattctaggtacccgccctacctccc

SEQ ID NO: 75923 - DNA, 601 bp, Human
tgacggagagccaaaagaaactacaggtggggatgtattatcaaattgggtgattcttttaaaatgggagcatgatggcctgcatataatattcgcaatacataatctataggaactaaactgtaataaccacataaagcaatagttctctgactgatctaaagactcctgaagtccccaagatcctgtcttttctaactacatatttttgtgaagcaaaatttcttcacatacttcaacccaaacaacaaatcacaacagagtgaatgaagaagcagacatgagaacccagtgatcgtctaccaaacattttaaagacattttcagaaatgtaaaacaatgccactcttctcataaatttatttgttttggataacagtttttttcattaaaatgttatttgtactaacagtggatttcttttattgttaaatgagttaaatactttttaaatttgtttgaatatctgatatgataaatactggaagatctacccaatgaatccaaagcccacgtagatcctcaataatttaagatgtaaaaggttcctaacaaaacatctgagaaaccagagcactgactcagttagtgtttccattct

SEQ ID NO: 75924 - DNA, 601 bp, Human
ctgaggaaatctaagataaataccaacagtccattaggaatctgaagaagccccttcataatggggataatggcaccaaaaatatcaccaagtagtcagtcagtaaggatgaaacaaaaaatgtatgacggagagccaaaagaaactacaggtggggatgtattatcaaattgggtgattcttttaaaatgggagcatgatggcctgcatataatattcgcaatacataatctataggaactaaactgtaataaccacataaagcaatagttctctgactgatctaaagactcctgaagtycccaagatcctgtcttttctaactacatatttttgtgaagcaaaatttcttcacatacttcaacccaaacaacaaatcacaacagagtgaatgaagaagcagacatgagaacccagtgatcgtctaccaaacattttaaagacattttcagaaatgtaaaacaatgccactcttctcataaatttatttgttttggataacagtttttttcattaaaatgttatttgtactaacagtggatttcttttattgttaaatgagttaaatactttttaaatttgtttgaatatctgatatgat

SEQ ID NO: 75925 - DNA, 601 bp, Human
aatgacctaggtgtggtggtgcacacctgtaatcctagctacttgggaggctgaggcaggagaatcacttgaatccaggaggcggaggttgcaatgggtcaagatcacgacactgcactccagcctgggccacagagcaagattccatccccccgccaaaaaaaaaaaaatcatgaaacacctttaagaaactggctgaggaaatctaagataaataccaacagtccattaggaatctgaagaagccccttcataatggggataatggcaccaaaaatatcaccaagtagtcagtcagtaaggatgaaacaaaaaatgtatgacggagagccaaaagaaactacaggtggggatgtattatcaaattgggtgattcttttaaaatgggagcatgatggcctgcatataatattcgcaatacataatctataggaactaaactgtaataaccacataaagcaatagttctctgactgatctaaagactcctgaagtccccaagatcctgtcttttctaactacatatttttgtgaagcaaaatttcttcacatacttcaacccaaacaacaaatcacaacagagtgaatgaagaagcagaca

SEQ ID NO: 75926 - DNA, 601 bp, Human
acaaaaatgacctaggtgtggtggtgcacacctgtaatcctagctacttgggaggctgaggcaggagaatcacttgaatccaggaggcggaggttgcaatgggtcaagatcacgacactgcactccagcctgggccacagagcaagattccatccccccgccaaaaaaaaaaaaatcatgaaacacctttaagaaactggctgaggaaatctaagataaataccaacagtccattaggaatctgaagaagccccttcataatggggataatggcaccaaaaatatcaccaagtagtcagtcagtaaggatgaaacaaaaaatgtatgacggagagccaaaagaaactacaggtggggatgtattatcaaattgggtgattcttttaaaatgggagcatgatggcctgcatataatattcgcaatacataatctataggaactaaactgtaataaccacataaagcaatagttctctgactgatctaaagactcctgaagtccccaagatcctgtcttttctaactacatatttttgtgaagcaaaatttcttcacatacttcaacccaaacaacaaatcacaacagagtgaatgaagaagc

SEQ ID NO: 75927 - DNA, 601 bp, Human
ttgaaggttctggtgaaagtttatatccataatagctggaaaaaagtataaaagtgatagtgctaatgacaacataagagggctatattagtttgctaggactgccataacaaagtaccacaggtaagtggctaggaaatttactttctcacgactcaggaagctacaagtccaagatcaacatgttaccaggactgaattcttctcagggcctttctccttgacttacagatggccatcttctctttgcgtcttcaccctcttctttcaagaataccagtcatactggactagggcctaytctgtaacctcattttaacttaattacctcttcaaagaccccatctccaaatacagtcacactctgagggactgggagttatgacttcaaaatataaatttgttggcggggggacacacaactcagccagtaagtgccaaagaagagtaccatgcttgatgttaaaattcatgaaatggccagacgtggtggctcatgcctgtaatctcagcactttgggaggccaaggcaggtggatcacttgaggtcaggagttcaagaccagcctggtcaacatggtgaaaccccgtctctaagaaa

SEQ ID NO: 75928 - DNA, 601 bp, Human
cacagctatgttccaataaaactttatttataaaaatggagggggaaggactagatgtggctcatggatcacagtttacggacccctgcactagattaactcgtctgatggcatgaaggtctggttaccacaccaacaactaatagtctgggagagtttagtacacctgttcttttaaaaaaaaaaaaattaactgatacaaattatattttagccaaaatgtgtttccttggcaggaaatgttaaaggaaggaaaaaagtaagggggtagggaaagaaagaaaaaggggaagagggagaraggaggaaggagaaggaaagaaaatacaaaggaagaaaacctaatgctatcagaaatcactggtatattttagagtatcttttatttaatttcaaaaatttcagatatctaaaatatattaaaattcataaatttctgcaattaacatgaagtaacttactataactaaggttataagtaagctcatagtagtaccaggctctctgctaggtgctattaagaatccctgtagaataattttgaaacaaatgtttatcaatgtaataattaagaaaattttattttagataatactgagct

SEQ ID NO: 75929 - DNA, 601 bp, Human
aaaaaaacaactggccgggcacggtggctcacgcctgtaatcccagcactttgggaggccgaggcaggcggatcacctgaggtcaggagtttgagaccagcctggccaacatggtgaaacctcgtctctaccaaaaatacaaaaattagccgagcatggtggtgggcgcctttaatcctagctactcgggaggctgaggcacgagaatcacttgaacccgggaggcggaggttgcagtgagccgagattgtgccactgcactccagactgggcgacagagtgagacttatctcaaaaaaaraaaaaaaattactagtcctcacagtaatccctacactttgggacaccaagatagaaggatcacttgaacccaagagttcgagaccaccctgggaaacatagtgagaccccatctctacaaaaagatgaaaaaaccagccaagcacggtggcatgcatctgcagtcctagctactcgggaggctgggtgggcggatcccttgagccagggagtttgaggatacagtgagctatgatcacaccattgcacaccaatctaggtgacagagcgagaccctatgtccaaataaataaataaataa

SEQ ID NO: 75930 - DNA, 601 bp, Human
tgttgtggtcaccatgaactctgccctctgggtcacaagctatatgcagtttcctaactgagttttagctgtctagcatggtgcaaaactagctacaaaaatagcaaacccagccgggcatggtggctcacgtttgtaatcccagcactttgggaggccaaggtggatggatcacttgaggtcaggagttggaggccagcctggccaaaatggtgaaaccccgcctctattaaaaatacaaaaattagctgggcgtggtggtgcatgactgtagtcccagctactcgggaggctggggcaraagaattgcttgaacccaggaggcagaggttgcagtgagctgagatcgcaccattgcactccagcctgggcgtcacgagactctgttcaaaaaaacacaaaaaagtagcaaaccaaccagggctatttcatttttaaaagtgtataataacaatctcttatctgtagtttcggtctgctattagttgttcttcaggtactctttgttttttatattttgttcagagtttaagttatctgtaagaagactcatttgataggaactattctgttattaccacaggaagaatgtttggttggt

SEQ ID NO: 75931 - DNA, 601 bp, Human
aaacaatgaattagactagaatcagtatcctaaaattccctttgactacaaaaagttttaagtccctgaatccacaagttgtcacacataagaaatcatcatttgtccaacatgcatgtaattgcaagttttatctcaattgattatctttttttcttgaatattggccatgttttcatggttcttcctaagtatggtaattttagattacattttatatgtggtaaatgataccttacagaaactctagattctgctatagtcctttaaaaaatgttttgattttcaagggcagaaaaawtaaaaagataaagaagtagaaaagaaaaaacaaacaaaaaatgtttacagtaggccaggcacagtggctcacgcctgtaatcccagcacttttggaggcagaaggtggtggatcgcttgagcccgggaattcgacacaggtctgggcaacatggtgaaaccccatctctacaaaaaatacgaaaaattagccaggtgtggtggtgcatgcctgtagtcccagctacttgggaggctgaggtgggaggaggaggcttcacctgagcctaggaagacaaggctgcagtgaaccataatcaca

SEQ ID NO: 75932 - DNA, 601 bp, Human
agacctcagacggtgttcctattaggcagaacagaaacaggacaaactgaattccaggtaagacaaacacataattggaaaaacaaagacgcacaaatttacagctgtgtctgcaacacttcaagaagctgggcatggcagaaataggagagttgaagagaccacatcaatgagacttttatgccatgctatggtatctgaactataggaagtaaaaatccatttccagactttaaagcaagattaggctactgtgaagactcagacttcagaggtctgagcagtagcctggtgagtgaayggcttacagacaaccaaaagaacatgaaatttggaaggagactcccaaactagctgtttatactcaagctcaaggacagttccaaagtcactttttatttaaaaaaaaaaaaaaaaggtagtttttattctaaggttaatgagaacactccgttgtcatattttaggacacaacaaagaaatggtttcacccacactttgtgatcaacagggagggactgaagatttgcttccttaaccccacaaatacagattatttgaggcagaatgcaggcttaggtgattcatttctccaaaaagc

SEQ ID NO: 75933 - DNA, 601 bp, Human
aaagatacagagatgaataaaacatggtccttatctttaaagagtaaggtaaggaacacaaacatatacccaaaaatcaatgtaaaagaaggaataagttagaaggtataaaacaaagagagggccagtaactctatcctgagctgattagtgaagacctcagacggtgttcctattaggcagaacagaaacaggacaaactgaattccaggtaagacaaacacataattggaaaaacaaagacgcacaaatttacagctgtgtctgcaacacttcaagaagctgggcatggcagaaatasgagagttgaagagaccacatcaatgagacttttatgccatgctatggtatctgaactataggaagtaaaaatccatttccagactttaaagcaagattaggctactgtgaagactcagacttcagaggtctgagcagtagcctggtgagtgaacggcttacagacaaccaaaagaacatgaaatttggaaggagactcccaaactagctgtttatactcaagctcaaggacagttccaaagtcactttttatttaaaaaaaaaaaaaaaaggtagtttttattctaaggttaatgagaac

SEQ ID NO: 75934 - DNA, 601 bp, Human
ggaggtggaggatgcaacgagccatgacaggaccattacactgctgcctgggtgacagaccaggaccttgcctcaaaaagaaaaaatcaaggggccaggcacagtggctgacgcctgtcatcccagcactttgggaggtcgggagttcgagaccagccttaccaacatggagaaaccccatctctactaaaaatacaaaattagccagacatggtggcacacgcctgcaatcccagctactggggaggctgaggcgggagaatcacttgaacccaggaggcagaggctgcggtgagccgakattgtgccattgcactccagcctgggcaacaagagcaaaactccatctcaaaaaacaaaggatcaaggtcagatgaggtcaagagaagactgaggaactgtgccagactgaggaagatgaaggagacatgacatttaatgtttctgaactggatcctttcctatgaaactactggaacaactggcatacttgaatggaatttgttgattagatggtagcaatgtatcagtggtaatcacccgactttgatgagcgtaatacggtgatgcagtaaaatgtatttgtttctagaaaatacac

SEQ ID NO: 75935 - DNA, 601 bp, Human
ttgttacagcaactataggaaactaaggcgcacacactgaggtggggttggggaatgttctagaaagtatacacatttccatgaagttttcaggttcaaaaagtataaatagtcctggactgacggcatcctagaacacttagcagaacagggaatataccttcagcttagcttatcaatggtatatcccttaagtggcacagagatctcaacacatgagatcttaaaataagcttacaacacaaatttacaaaacacataaggaaaaaaattcaccacaagcaggagtcagcatgtacayatgtaacaaatctccgaaggaagttaatccaaaagaaagaaaggagaaaaaagagacagaacagatgacataagtagaaaacacaaaatgatgttgtttcatttgaattcaaatatatcattaactacattaaatgtaaattcaatagtactcctattaaaataagtatcactgtatttttgtgaatccagttatatgatttcttagaagaggcaatttttttagcttttttccagttccatctcccaaagctctgtcatccagacaaatctttaaaaacagaaaaaaactgcaagaata

SEQ ID NO: 75936 - DNA, 601 bp, Human
actaaatttgcggtgatttgttacagcaactataggaaactaaggcgcacacactgaggtggggttggggaatgttctagaaagtatacacatttccatgaagttttcaggttcaaaaagtataaatagtcctggactgacggcatcctagaacacttagcagaacagggaatataccttcagcttagcttatcaatggtatatcccttaagtggcacagagatctcaacacatgagatcttaaaataagcttacaacacaaatttacaaaacacataaggaaaaaaattcaccacaagcmggagtcagcatgtacacatgtaacaaatctccgaaggaagttaatccaaaagaaagaaaggagaaaaaagagacagaacagatgacataagtagaaaacacaaaatgatgttgtttcatttgaattcaaatatatcattaactacattaaatgtaaattcaatagtactcctattaaaataagtatcactgtatttttgtgaatccagttatatgatttcttagaagaggcaatttttttagcttttttccagttccatctcccaaagctctgtcatccagacaaatctttaaaaacaga

SEQ ID NO: 75937 - DNA, 601 bp, Human
agaacatttccttgtcattaagcaagcatgactgtattaaggattttcattaaataagtagattttaggtgctcatcacttaacaaaagtaactatgtgaaatgacagatgtgtttatctgcttcactatagtaactaatttactgtctatatgtattccataacacagcagtcccctttttggcaccagggaccggttttgtggaagacaattttccacgcactggggagacaggcgaatggttttgggattaaactgttctacctcagatcatcaggcattagattctcataaggagcrtgcaacttaggtcccttggacataaggttcacaatagggtttgcgctcctgtgagaatctaatgccacagctaatctgacaggaggcagtaatgttcgctggccctctgctcacctcctgctatgcagcccggttcctgacaagccacggactagtacaggccagtagctcaggggttggggacccctgccataacgtcatgttgtaaacctcaaatatacacagtaaaatttattttttaagtctaaaggaaagtaatttttagtctaaaactaaggacagtatagcatagtgataaca

SEQ ID NO: 75938 - DNA, 601 bp, Human
gtaaacaaatgttctaaaggaaacattaaaatattctaaaagcaattatatttagagaggaaaacattttctaaaatgtagaaataaaatgacaaactccataagcagacaagattttaaaattatcttttaagatatgattattttaaactgctgtatagaaataggttttcattttgttctttttcctctcccttgtcactctggaggaaataaaaataacacatatgcttcttttaaagatcttccagaaaaatccttcttaatcatcaaaagacagaaagccaggcaggaaagaagyatgacatagcaacactacttaacgttccatggattttctacaatatcatctcagaaggcctactatcatcctcacaactgccactgctactacaggaagggcattataggttttaagcaaagaaccttgtacataagtaaaaacacaataaatgtttgctaaaaaataactacagaatgaaaatcaaaatatttttgccctgaatagagaaaggagaggggtataaaaagggcagaagaagagagtcctgagacaagctgcacagaggaagccttcagccaagaaagagacaatctttgt

SEQ ID NO: 75939 - DNA, 601 bp, Human
ataatttatattcctttgggtatacacccagtaatgggattgctgggtcaaatggtatttctgtctctaggtctttgaggattcaccacactgtcttccacaatggttgaactaatttacattcccaccagcagtgtaaaagcattcctttttctccacaacctcgccagcatctgttatttttttgaatttttaataatagccattctgactggtatgagatggtagctcattgtggtttttatttgcatttctttaatggtcagtgatgttgaattttttttcaaatgattgttggccrcacatgtatgtcttctgagaagtgtctgttctctgttcaagtcctttgcccactttttaatggggttgtttttttttcttttaagttccttatagaagctggatattagacctttgtcagaaaaatgtggaacacttcatgaatttgcatgtcatccttgcacaggggccatgctaatcctctctgtattgttccaattttagtgtacgtgctgcagaagtgaccacttatgttgtatttttatcacataaaatgaaactgtactgcaatgggctggtaaaaatgacatagttctagtta

SEQ ID NO: 75940 - DNA, 601 bp, Human
taagtctcacgagatctgatggtttaatcaggggtttccacttttgcatccttctcattttctcttgctgccgtcgtgtaagaagggcattttgcctcccggcatgattcttaggcctccccagccatgtggaactataagcccaactgaacctctttttcttcccagtttcaggtatgtctttatcagcaatgtgaaaacggactaacacagcttatataaaatgggaatagcatattagaaactctaacattgcttgatacaaaaaagtactaaaaaataataaatctgaatcttattkatcaaactacccaatctacaactctgcaattaagataaagcatttctaaaatattaatatgaaaacatgaatgtaacacattatgtatttgaaatatgatgaatgtgatttaggttcaaatctccagttttgccactggcaatacaatttttaagaactcctcaaagccagtctaataaacattaagataccagcagtttgaggccgggtgcagtggctcacgcctgtaatcccagcactttgggacgccgaggtgggcggatcacgaggtcaggagatcgagactatcctggctaacac

SEQ ID NO: 75941 - DNA, 601 bp, Human
cggggcttcaccatgttggccaggctggtctcaaactcctgacttgacttcaagtgatttgcccgcctcggcctcctaaagtgctgggattacaggcatgagccaccatgccccgcctctctacacatcttttaaactcctcccttttctaataggtccagcactagtacaaattttagctcagttctgctcagcacagaattaagttgaggaatccctaactccatagaagggaaaatattgagatttcaatgggagttggaaaagatggaccagtatttacctaggtttgtttctaacyctcccgaacactcattctctgtctcctttctaaggtcacgttacagacagtgtctcccagttcattttcctctttatgacccctcggcaaactcatccacattcaggcttaaattaccatatatacacacaaacttttctttatctattcaagaaccctcctctaagctataggttcgtgtataaaactgacattctctcagatatttcaatggtaccttaaagtgaacgtgttcaaaatcaaacacacaggctcctcaatcctatttcaatgctcctacttcaattctctattggttta

SEQ ID NO: 75942 - DNA, 601 bp, Human
tgctctgtcgcctaggctggagttcagtggtgcgatctcggctcactgcgccctctgcctcccaggttcaagcgattctcatgtctcatgactcccgagtagctgggactacaggcatgtgcccccacacccggcttatttttgtatgttttgtagagacggggcttcaccatgttggccaggctggtctcaaactcctgacttgacttcaagtgatttgcccgcctcggcctcctaaagtgctgggattacaggcatgagccaccatgccccgcctctctacacatcttttaaactcctyccttttctaataggtccagcactagtacaaattttagctcagttctgctcagcacagaattaagttgaggaatccctaactccatagaagggaaaatattgagatttcaatgggagttggaaaagatggaccagtatttacctaggtttgtttctaactctcccgaacactcattctctgtctcctttctaaggtcacgttacagacagtgtctcccagttcattttcctctttatgacccctcggcaaactcatccacattcaggcttaaattaccatatatacacacaaacttttctt

SEQ ID NO: 75943 - DNA, 601 bp, Human
gtgttataagaaaaactgaatggatctggtcccagcctctgtcggtaagattaatcagagtgacaaatgaagttgcataatcatgggaaagaaatcttaccagaagccaagaaggtatagaaatgaagggtgaatactgttggaaggcaattatacttgagtctttcatgtttctgtacctgttgtgagtagagggactgactcattttgttccataccaacttgctacatatgtttgtattatataaggaatggtcttgagggatcaagaaacagtgtctccctcaggagtaaaaggcargtttgtttgctgtctagtacaataaagatatcatctccagttgggtgtggtggctcatgcctgtaatcccagcactttgggaggccgagtagggcagatcacctgaggtcaggagttagagaccagcctggccaacatggtgaaattccgtctttactagaaatacaaaaattagccgggcacggtggcacatgcctgtagtctcagttacttgcgggggtgctgaggcatgagaatcgcttgaacccaggagatggaggttgcagtgaaccaagatcaagccactgcactctagcctgg

SEQ ID NO: 75944 - DNA, 601 bp, Human
tgggcctagaggcattcaggacggtctaaaatcactatccaggattgttacagatagaagaatagccctacgcttcctctttgtagaccaaggccaaatctgtgctctatattctgcagtaactagattaatgccttgggccaagagtaaagtcagcacagaaacaaagagaaagccacctggctctcttaggtagaccctaaaggtttattgcatttgttctgttggctgggtcttggaccctggggagcataattgaagtcaatattgcagtctggcctcatcctgctatcctgttgayagtaactgtaatgaaatgtgttataagaaaaactgaatggatctggtcccagcctctgtcggtaagattaatcagagtgacaaatgaagttgcataatcatgggaaagaaatcttaccagaagccaagaaggtatagaaatgaagggtgaatactgttggaaggcaattatacttgagtctttcatgtttctgtacctgttgtgagtagagggactgactcattttgttccataccaacttgctacatatgtttgtattatataaggaatggtcttgagggatcaagaaacagtgtctcc

SEQ ID NO: 75945 - DNA, 601 bp, Human
attttcttgctggatttctttggtcttaaataataatgaccacttagttaagtacactgcttcccctagagtggctcatgtggacaaaagtaggagacataaaagggtctctgtaagtttaataaaagggccctttgtcactcttgcacctggcccttccagacaaaaggtctgggtttgagtcagagatgactggaaaaaaggtaaagctagctactggaatgggacacactgattttgtggcagtcaaaggggtacaacaaccctgtctggcacctgtggggaaaacaccttagatgckgggaagtaaggaaaaaggggggacattagtgatccgtcttttagaatcatccctcacaaaggacatttctctgcaaatgtgcaaaacctcaaatttaactgacaactgggtctgcccctaccccaccacacaactttgatcactactcaatcatcattctccttaactgcacagtctctcagaagcagcagaggatggtccaagctcccaaatctcccacgtgaaacacctgtccataactttaggcatcttttcaagggacagtcatttcaagggacagatgaatgccattgagttggt

SEQ ID NO: 75946 - DNA, 601 bp, Human
aaccttgaggacattattgagtgaaatacgccagtcacaaaaagacaaatattgtatgattccatttatatgaggtactagagcagtcaaattcataaagacagaaaatggagatagtgtttgcctgggggaggaaagctcaaaggacacttgtttaatgggtatagggtttaatttctacaagataaaaagagtcctagagattattggttgctcaacattgtaactatacttaacaccactgaactgcacacttaaaatggttaagatggtgatcatatatgtattttgccacaatttwaaaaaaaattttaatcaactcaaaagatttctgagtatacctctgtcacctcctcctggtctacacaggagtacagcagtttggtcactgaatgtggctgtctccaggaagagaacatctcctggccacttgggattccaccctgaccattcctaaacatgatgcttctttctttcctctaatggaaatcccaggctggcttgattggtctactctctgggtggcaacccagccaaaaggaggtctttggtataaacttaattcaggttcagccacctggaattgacgatctggattttc

SEQ ID NO: 75947 - DNA, 601 bp, Human
tcaaaaatcagctcaaaaaacctcaacaacaacaaaaaaaaaaacccgactcaaaaatgggcaaaagacttgactagacatttctccaaagaagacaggcaaatagaggccaggcacagtggctcacgcctgtaatcccaacactttgggaggccgaggcgggcagatcacaaggtcaggagatggagaccatcctggccaacatggtgaaaccccatctctaccaaaaatacaaacattagctgggcatggtggtgtgtgcctgtagtcccagctactcgggaggctgaggcaggagaawcgcttgaaccagggagtcagaggctgcagtgagctgagattatgccactgcactccagcctggcgacagagtgagactctgtctcaaaaaaaaaaaaaaaagacaggcaaatggccaataagcacatgaaaagacactcaataccacttatcattagggcaatgcaaatcaaaaccacaatgtgacacaacctcacatccataatgatggttactatcaaaaaaatcaggatgtggagaaactggagcccttgtgcacttgcagtcactctgaaacatagtatagtgattcctcacaaaa

SEQ ID NO: 75948 - DNA, 601 bp, Human
cttcaggctatcagtggggtctcactgctgatgacacttttccagggtctggtactgctattccagttcaatcagctgactccagccacagtaccgtggtccttgacactaatctgtgtcctatttttactttccacatcatttgcaatctgacaataggtacaccttttatcacaaaagtcactcaacaatgagctgttagtcaaggtaggtgacagtctaccatccacagcatcttatatcgcttagtactgcaacagccttatcaaaaatcagctcaaaaaacctcaacaacaacaamaaaaaaaacccgactcaaaaatgggcaaaagacttgactagacatttctccaaagaagacaggcaaatagaggccaggcacagtggctcacgcctgtaatcccaacactttgggaggccgaggcgggcagatcacaaggtcaggagatggagaccatcctggccaacatggtgaaaccccatctctaccaaaaatacaaacattagctgggcatggtggtgtgtgcctgtagtcccagctactcgggaggctgaggcaggagaaacgcttgaaccagggagtcagaggctgcagtgagct

SEQ ID NO: 75949 - DNA, 601 bp, Human
gaggaaccacatcacatgctactggcagattggttgcatcagacaaccttcttcaggctatcagtggggtctcactgctgatgacacttttccagggtctggtactgctattccagttcaatcagctgactccagccacagtaccgtggtccttgacactaatctgtgtcctatttttactttccacatcatttgcaatctgacaataggtacaccttttatcacaaaagtcactcaacaatgagctgttagtcaaggtaggtgacagtctaccatccacagcatcttatatcgcttagtrctgcaacagccttatcaaaaatcagctcaaaaaacctcaacaacaacaaaaaaaaaaacccgactcaaaaatgggcaaaagacttgactagacatttctccaaagaagacaggcaaatagaggccaggcacagtggctcacgcctgtaatcccaacactttgggaggccgaggcgggcagatcacaaggtcaggagatggagaccatcctggccaacatggtgaaaccccatctctaccaaaaatacaaacattagctgggcatggtggtgtgtgcctgtagtcccagctactcgggagg

SEQ ID NO: 75950 - DNA, 601 bp, Human
tcaagccactgatcaagctgcacggttaagactgctaccactgctgctggatccatcatcataccagacacagcaacatatctatcatcatagagtggatacaaagtaaaagactctatgttcctgatgcagaggctgccacctcatcctagacttatgagtcctggaaaaggactcatttgtctcatggtgagaggaaccacatcacatgctactggcagattggttgcatcagacaaccttcttcaggctatcagtggggtctcactgctgatgacacttttccagggtctggtactgstattccagttcaatcagctgactccagccacagtaccgtggtccttgacactaatctgtgtcctatttttactttccacatcatttgcaatctgacaataggtacaccttttatcacaaaagtcactcaacaatgagctgttagtcaaggtaggtgacagtctaccatccacagcatcttatatcgcttagtactgcaacagccttatcaaaaatcagctcaaaaaacctcaacaacaacaaaaaaaaaaacccgactcaaaaatgggcaaaagacttgactagacatttctccaaagaa

SEQ ID NO: 75951 - DNA, 601 bp, Human
ttgagaaagtctgatcttacattctgccacctaaaccaaatctgctagctcagtgaggcccttgattcacagaggttccctaaatgcctgggcctgtttcactgatgattcaactaagctgagacgctgtggtgcctagtgggctgtaaactccagtgcccatgatacagaactgaaaatgggtgtggttgctttgttccacgggcaaaactcaaggacattctcacagatctggccaatattccccttgaaaaccttgttatatttttactgactatcaggctattaccaactgcctagstatttagtcagccacttggaaaactacagaatgacatatttaagactgtccaaaaaccatggagatcaattgtagttgctgatcaaaccatctgggtcactaatatagatgtttacagtaagggtccattgtctgatgagaccaattataatcaagccactgatcaagctgcacggttaagactgctaccactgctgctggatccatcatcataccagacacagcaacatatctatcatcatagagtggatacaaagtaaaagactctatgttcctgatgcagaggctgccacctcatcc

SEQ ID NO: 75952 - DNA, 601 bp, Human
ccaagttctccaagttcccaaaggagactaaagaccacacacacctgggtaggctacataactttggggagagcacagactcaacattttatggctctgttggatacaggagcccaaggcaccttcatacccatcctgtggaagaataagttaccagcttccaactgctgaggtctgggtagggttcaaagtagggaagggaagctactgtgaccttttgggtggggctctttggaccattcaatgtactactgtttgtagcttccacttctgagtgtatagtggtattgatattttacakgcctgaactgtgagggctcataagctccagggagattatgctcactgcgaatagcccatgtagaaaggcattagtaggtttggggccccacaatccttatgacctgtttgagtacaagtctgtgcacagatgactttcctgactagaccctctggcaagaggaacaacctcttcaggtgactcttgggtttggattcaatgcctccctgacgtagctactaggtatgcctcttttgaaaagattcccatttgggaatgagtcaactcaaatgcaatgactaataaggtgggaaaggccca

SEQ ID NO: 75953 - DNA, 601 bp, Human
ctgtcacccaggctggagtgcagtggaacaatcacggctcactgcaatcttcaaattcttgcactcaagcaatcctctgacctcagcctcctgagcagctgggataacaggtgtatcccaccatgccaggctaattttttaaatataatatttagtagagacgaggtctcacgatgttgcccaggctggtctcgaactcctgggctcaagcaataacgatcttgcacagaatacagggttttggtagcaccaaaattactgcaggtttattggactgatcagcacacagctatagcaccaytcaaaactgaaagcaaatgtctcttgttcactggtgcaaagctactctctcccagcctccctcatccctcaacctcagctgctttatgaagaaagatgattaggagtggggccaagttctccaagttcccaaaggagactaaagaccacacacacctgggtaggctacataactttggggagagcacagactcaacattttatggctctgttggatacaggagcccaaggcaccttcatacccatcctgtggaagaataagttaccagcttccaactgctgaggtctgggtagggttcaa

SEQ ID NO: 75954 - DNA, 601 bp, Human
cacataaggttctgtttcctttggacgacagttacagagacatacatctacactgagtttgaaagtaagaaaaggtgcaaccattgtaggcagagccaaacaaatctttagaactttggctagtttgcttggaagaggaggggcatgtagttacattgctcaggcatgtaatggttgttaaagaagaatggcattttgctggctatcttagtgctcagctcctaccgcagtctaccttgtcaacattaaatcctttcaagataactggaaagggcctcagcattttctggtggtataaccrtccactacaagaaacctttgaaactctcagggaaatttccctgagacaaactcccttggacaccaaccagtctacagactcctactgtactagattgggtttaaaatgcggatcaaggtaattcactgaagaatcagaaactagctcaaagaatctagataattcttgctgtcagtcctgcagccttagaaaactccagtagccctagtattgaaatcaagcaagaatttaagagatataatcttgacattatcttaacaatggagcagtaaagagcctacattaaggcagacttctaaa

SEQ ID NO: 75955 - DNA, 601 bp, Human
tagttaacaaggataaatctcaggaccatcataattttctatagttttggcaatgaaaaagaatgctgatggggacaaaactttctagaaatggaaggaaagaccagttagtagaaattgagaaaagtccacgagaatcattaaccaacatgttgtccaaattgtatggtcaaccaggcaatgaatgatcctccactttagtgcctgtgaatgaggctgaaatgaagaggaagtttcaggataagtaccaggaagtaggcagattcaaagacaacagcctgaatgatgccttggttattgycaacactcctgcagataggaggacttccttatcaagctgacagtcagcctcagcaggtctgcttcatgaaatcttccagactaagatttgtctagaagagggagacaggggcacataaggttctgtttcctttggacgacagttacagagacatacatctacactgagtttgaaagtaagaaaaggtgcaaccattgtaggcagagccaaacaaatctttagaactttggctagtttgcttggaagaggaggggcatgtagttacattgctcaggcatgtaatggttgttaaagaagaat

SEQ ID NO: 75956 - DNA, 601 bp, Human
ttgaaaagcatgtagacttttatttttaaatgttcagtagtgaaagaaagacatagaattcacaacacaaatgggtaatatttgtctaggatttatggcttaataaccatttctaattttaatatctttttaatacagcctattcaactgataaaattgcaccccaaccttagtaaaattcatattaaatattgtatgaaaattataatgccagctgctaaagagaatctattaaaatcatctttatgacaatatttcctatccaaaatatttactggatatgcaaattagcttgttaatrtaatataaaatgcttaccttgacaccatggcccacatcatccagaactgtgtaatcgataggtttccgaatataccttacagggcgctccatattcgcaggtgctattattttgtgagttcttgatgtattcttatttgttgtcaaaataccaatctctcttcgtgccactttctccttatgaatatccacagtctatattttaatttgaacaaaacaagaaaatattatttgacataatatgtttgctatccatatacactggaccatatttaggacagaccacagggctgtacaccat

SEQ ID NO: 75957 - DNA, 601 bp, Human
agattctagctgaccccttaaaaacttataaaatattctgaagaccagaatccaaatcaaatagtcctcttggaaaggaactaccaaatttcaaaggaatagtttatcctgagcagagacagcgaaagaattttggtcattccaaatgcttgcaaaatgacccataaataccaaaaagctgacacactacaggtatccttcaagatcagctaatttcccatgcttagaaatgaacacaggcaacacatcatatctctcctgaaaatctgttgggggtttttttgtgggggagattgggggrcattaagacaaaattacatacaattttcattttttaataagttgctggcattatagatacacacacaggtatacaaatatatatacatatttagaaatgaaacgataaaagtatttataaattattttctaaagtaattttgaaaagcatgtagacttttatttttaaatgttcagtagtgaaagaaagacatagaattcacaacacaaatgggtaatatttgtctaggatttatggcttaataaccatttctaattttaatatctttttaatacagcctattcaactgataaaattgca

SEQ ID NO: 75958 - DNA, 601 bp, Human
tacatatgaaaagtcctttgtaaattatgatccaggctgttaattattactagtgttcatcaaaataaatgtaaatttctttgctaagtattcaagccttctctattctagcttcctctcaaaccttgtgctcacttacaaagatcatcttcttttcattctcctttatgaataggttctggtagtttctctatgctgggattctcttatacatatcttattattattcccaaaaatcgaaccagatttactttgggatattttgcatatttttaaattcctattaaactaacatgtaccrtttatttcatagcataaaatgcattaacacagtaaatactatttaaataaaacccagatatatttaaatacaaataccaaaacactaaaatttacatcacaaaataagaaaatgcaatggaatattaatcttggagtatggcaatcgtaagcatgaagcctagtagcgataagaaaaatattaatatatttagatataatttttaaaattctgtatgtttatttcttaaataccagaaaacatcaaagtcaaaagccaaacagcaatatgagtaaatatttgccaatatatgagggtcta

SEQ ID NO: 75959 - DNA, 601 bp, Human
ttaaataatctacataaatcctacagggaaaagcagacagacataagaagagttttcaaattttagtggctctgcagcctctatcaatacagaggaaatactgtggatcaaatgataagtaatggctcttaccttggcttttagccactttacgttggcaaaaaaagggggggaaaaagtagacattaatgctaggtaagttatatccgataggacaggtttacatttacagttactcaattcatgttaataagcttttttccagccatgtttcaactactttgtaaagaaaaagagatcyatacgtactggggaaatactcatgtgtttcatgtatttttcaaaagaattatattcataaggaaaccaccacttaattattccaatctcatgcaggctcaatgattttttaagtcagtattttgtcctatggaactaatccaaccgagtaacagatgattttaaaaatacgctcatttaaatacaaacaccataacacattagatgtgaagctattttaacatatcggtgcatgagacctaacactttactggataatgaatgtccaagtatgagtattcattacttcaatggtagtata

SEQ ID NO: 75960 - DNA, 601 bp, Human
atcaaattgttctcctggtgttttaacaccatgtattattttttttaaatatcagaatgtgaattaaggattcccagacagtttgaataaagactttggtactacagtttaaaaagtcaaggaaccacttgcacttggtcttcctattattttatgccatttatatcacattgtagccaaatacaggtgagatgactggatttaatatcttattttattgttaaacatgttcactgagatcaaacttatctgcattcaaacactgggtttcctaaaatttttgaaatgtgtgcatgaacayaaactatagatcttacttgtcaatttgctcaaatacgcatctgaaaaatcatcttcatcctaacaattcagtaacaaagtcacatatgatgtctgggaaacctcctaattgtaagtcaatgaaagcaaggcaactatcgaaaaatgagcaaagcaataaatgttagcaaaattaatgttcctatataaacacagatgtcaatatatcattgatatattaacacagccaagctaaatgttgcttatttgaactgaacttgagtattaaataatctacataaatcctacagggaaaagcaga

SEQ ID NO: 75961 - DNA, 601 bp, Human
atttttcccaaaaatatgtgagtctccctttgtgaccatgtataccaggatttaaaaatatatatgacaaagtttgtaattttaaaaaatattcttcactgggatatatgaattttgttactttaacatgaaaactaaaatttgttaccttttcctaggaaaaacataggaaagggtaatttaaagtcctaaccttatttctaaaaattatggttataattttttaaatgctcaataatagcaaactttaaaatgtacatttttctcagtacagtcacccataagccactgttctttaaayaggaagctaaatttatttacataggaagctgcaatttattcccatctcaatatggcaataaatggagatatacattctaatcattactttctcaataaatgatttcgactattctgtttaataacttcattttttttttcaggggcagagggtttaatgaataaaaatgaaaactaagaccttcttaaaagaagactgattgttgaacaacccctctgccaaaaaataagaaatccaatataatatttccagtattaagaaaaacaaccttaaagaaatataatgctttgacaagtattc

SEQ ID NO: 75962 - DNA, 601 bp, Human
cctgcctggactatgctgacttccaagcctagcaggactggtcatatagtcattaggaactgttgggggtttaacaggttccagggttttataaggagtattccgtctaaaggagcatagtggagaaaggaataatgaataaaaaagataaaattgtatttttcccaaaaatatgtgagtctccctttgtgaccatgtataccaggatttaaaaatatatatgacaaagtttgtaattttaaaaaatattcttcactgggatatatgaattttgttactttaacatgaaaactaaaatttrttaccttttcctaggaaaaacataggaaagggtaatttaaagtcctaaccttatttctaaaaattatggttataattttttaaatgctcaataatagcaaactttaaaatgtacatttttctcagtacagtcacccataagccactgttctttaaacaggaagctaaatttatttacataggaagctgcaatttattcccatctcaatatggcaataaatggagatatacattctaatcattactttctcaataaatgatttcgactattctgtttaataacttcattttttttttcagg

SEQ ID NO: 75963 - DNA, 601 bp, Human
ctgcccacgttattaagtgagagagaaaactgaagaataaaacaaatttggttatataataaatttatctggttttataaagcactcaaaaattgaagtggctatattttgggggaagaaggtcgaggcgataaccaggaaggagcatgaggggcttctgggttgctggtaatgttccattttctgatctgggtgatggttatatgagtgtgtgtccattcatcaagctgtatacttactgaagtggatacttttctgaatgcttgttatgctctgtaactaaatttttaaaaacccaccrggtaattgacttttaggacatttaaaaataataaatacaaggccaggagcggtggatcatgcctgtaatcccaacactttgggaggccgaggtgggtggatcacctgaggtcaggagttagagaccagcctgggcaacatggtgaaacctcatctctactaaaatacaaaaattagccaggcgtggtggcatgcacctgtaatcccagctactctggaagctgaggcaggagaattgcttaagcctgggtggtagaagttgcagtgagccgagatcgcgtcactgcactccagcctgggt

SEQ ID NO: 75964 - DNA, 601 bp, Human
tttatttcagccttccacaataaagctcataaatattatcatgtattaaacatagattaataaataacacacctggtccaatagtgggtggcgaaggtgtaggcacagcaatgggaatgccaatactactgctaccactgttttctcgacttccacttcctccactacttccactgaaaagaaaaaaaaaaactgtgaaaaaccaattctagagacatatttaaaaaaaaactgtaatcacccaaggccactaaatactccttttatgtcatatagtcatccctcagtatccttggaggaytggtttcaagagcccccttggataccaaaacccatggatgttcaagtcctgcagttggccctacagaaccagtggacatgaaacattggttttccttatctacaggttctgcatcccatgaatactgtattttcaacccgagactgccttactctggggatgcagaacctgaggaagaggggaagggaaggagggagggaggaagggaaaggagagagggagggagggagggagagtgggagggagagtgggagggaaagtggtaggcaatgggagggttggtgggtgcaggtgggtggg

SEQ ID NO: 75965 - DNA, 601 bp, Human
atttaaaattccttatatgctcagttcagtcatccccaacttgtgaacaatttaaatgcattttatcgagaaaactatttcatggcatcctgagatgtcataaaaactgggccatatcagagtttttcaaactatgatccacaggaaagcctcagagtaccccatcccacacatatcgtttgcctttcaatttttctcctcctgtccccaccttcaccctgatcctttgactgttgtatataccagagagttccaaattaagtttcacttgtgcggggcaggggggattagactagaaaaatctaaacaaacaacaaattaaaaacacattaagttggttataaaccaagcatttcatattatagaaaaagttgttttatatttgtttactgtataagtgcagaagcctttcaccagaagttagtgatattagatttaatactttaaactttgtattatcacctgcaacctaataactataaaagccagcactctactagcacagaggagtttattatgaattatgtaaagtgagttcaatggctccaatggctatgcaatctcacctatcacagtgctcactgggagaagtggtgccaga

SEQ ID NO: 75966 - DNA, 601 bp, Human
tggaatcaatctgtacatattgttgaattgctctttttccttgataatattttcaaaaattcatccatgtggctatgcatatcaatgtcattcatttttgctattttatttgtatgtaaatatatcataatttatttatccattctactactattagacattttggtttgagatttgtgctatcaatactactgctacgaacattcctaaatataattcctgaatctctaggacagtggttctcaaacttcatcattgatcagtatttcttcttgaagccttgtgttttgtttaagatggkgtctcactctgtcacccaggctagagcgcagtggcacaatctcagctctctgcaacctccacctcccaggctcaagccatcctcccacctcagcctcccaagtagctggggctacaggcatgcatcaccatgcccggctaaattttttgtattttttgcagagatgaggtcttgctatgttgcccaggctggtcttgaactcctggatcaagcaatccgcctgcctcagcctcccaaagtgctaggattagaggcgtgagccactgtgcccagccttacagcttgttataatatagactg

SEQ ID NO: 75967 - DNA, 601 bp, Human
tcggttttgaactcatttctgaacacgttaatgaccttaaaagtgatagccagcaatttcattatattaatttgaaggaaaactttgacaatgtttgtgtctttaattttaccattactacgctgtctcaaacatgccaataaattcagtttatttctgcaatgtttttgttctctagttctacttatgtaataaaatcgcatattaaagttaaattttggtatactcaatatagacacgtctcgataaatttagttaagtatacttggtaagtctaaattttggaagagaaagtggtaarcaattactcttaaaatggtatgattcaaggactaatatcctaaaacaaaaataaacatgaaacatcatggttttcaattgttgtctatcactggcaagaataacagtttcaaataatttccttcaaaaggagctccactgttgctgtatgcctgcaaagcacaagcttacttgaattttgagaataaagtggacctccattaacatgaggctgagcagaaaattgagcagtcacagagggagttcgtctgtatccaccagaagatgtcgaagaagtagtagagttgtgtcgagatatctg

SEQ ID NO: 75968 - DNA, 601 bp, Human
cagaaagaaatcaaaagaaattcccaccattagaattattcaaagacagagtaattaagcaggcatcacaaacagttttaatcggttttgaactcatttctgaacacgttaatgaccttaaaagtgatagccagcaatttcattatattaatttgaaggaaaactttgacaatgtttgtgtctttaattttaccattactacgctgtctcaaacatgccaataaattcagtttatttctgcaatgtttttgttctctagttctacttatgtaataaaatcgcatattaaagttaaattttrgtatactcaatatagacacgtctcgataaatttagttaagtatacttggtaagtctaaattttggaagagaaagtggtaaacaattactcttaaaatggtatgattcaaggactaatatcctaaaacaaaaataaacatgaaacatcatggttttcaattgttgtctatcactggcaagaataacagtttcaaataatttccttcaaaaggagctccactgttgctgtatgcctgcaaagcacaagcttacttgaattttgagaataaagtggacctccattaacatgaggctgagcaga

SEQ ID NO: 75969 - DNA, 601 bp, Human
ctattctaacttcctaacattatatgctaaaactattttcttttcttaccagcttttaaacactgactgcaattagtgttgagatgtgcaatttgaggtaaacagaaagaaatcaaaagaaattcccaccattagaattattcaaagacagagtaattaagcaggcatcacaaacagttttaatcggttttgaactcatttctgaacacgttaatgaccttaaaagtgatagccagcaatttcattatattaatttgaaggaaaactttgacaatgtttgtgtctttaattttaccattastacgctgtctcaaacatgccaataaattcagtttatttctgcaatgtttttgttctctagttctacttatgtaataaaatcgcatattaaagttaaattttggtatactcaatatagacacgtctcgataaatttagttaagtatacttggtaagtctaaattttggaagagaaagtggtaaacaattactcttaaaatggtatgattcaaggactaatatcctaaaacaaaaataaacatgaaacatcatggttttcaattgttgtctatcactggcaagaataacagtttcaaataat

SEQ ID NO: 75970 - DNA, 601 bp, Human
ttgaacatcttaatatggaaagtgatattaatgactaccctacactattctaacttcctaacattatatgctaaaactattttcttttcttaccagcttttaaacactgactgcaattagtgttgagatgtgcaatttgaggtaaacagaaagaaatcaaaagaaattcccaccattagaattattcaaagacagagtaattaagcaggcatcacaaacagttttaatcggttttgaactcatttctgaacacgttaatgaccttaaaagtgatagccagcaatttcattatattaatttraaggaaaactttgacaatgtttgtgtctttaattttaccattactacgctgtctcaaacatgccaataaattcagtttatttctgcaatgtttttgttctctagttctacttatgtaataaaatcgcatattaaagttaaattttggtatactcaatatagacacgtctcgataaatttagttaagtatacttggtaagtctaaattttggaagagaaagtggtaaacaattactcttaaaatggtatgattcaaggactaatatcctaaaacaaaaataaacatgaaacatcatggttt

SEQ ID NO: 75971 - DNA, 601 bp, Human
gaaaagctatgctgtgaagatactaatcattactacatttagacagaagggaaaatgtgcacatcaaaacactaaaaacattcacgtactactactactactactacaacaccaacagtaactcagattgaaggataattaatttgacaaaacataataatttatttaaaatctgaggccaaatttgctttccaatattcaaaagaatgtggtcattaattaaagtatacggtttgaaaataatccacacaagcattgctaaaataaaactataaaactatgtattatataaaaaagtcacaaaaatcctatttgcagagtaaattaaatgtctaagtggggaaaagaaaaataatacacaaaaagatgggatctaaaaattcagaatatgaaaaaaataaagttgatgaaacaagtgaagtgaattattagataatctggaatatttagacagacactggctaccttttgataccaaatgttaggtaaaatcctatttagtgaagtttaacacttctcagtagctttaatattttagtctggaaaaaaagctatataaattttgggattatttgtgaattttgatatttctgataaagtg

SEQ ID NO: 75972 - DNA, 601 bp, Human
gtttgtctagctttaaggtaatgttgtaaattaggacccaaataaataaaacaaatatataatagctatttatttcatatatcaataaaaatattaatcacaggtttcctttaaagacagttcttattatatatctaaattcacacacagctctccaggaaaaactcttgtttgtaaaacaaggttgttatttttttaagttggcaattttatgtttaaaaatatcagtcctaaatttacaagggaatatatcatgttaatcagtcagagtttcatgggatatctcaaaagtgaccttttyatcactgttctgaaaaaggaaacctgatctccaataagttaaaatacgtagttctttgcattaaagtaatttttaacaactcattggatagcttgaaacacattcatatgcatttgtggagatgacataattgacaggaaattaataccaaatactcatgtattaaaaattataacatacactagaagtaaacattcatatgtttgtgactttgtctcactttaacaagacagtaattgccaaagattgcttagaaaaagtcagtaggactagatagcaaaatttagtctatcggtagtc

SEQ ID NO: 75973 - DNA, 601 bp, Human
acataaaatttgtacttcataaaacgtttaaagtactgatacatattttaacaccaatcctcctaacacactttcaaagaaaacagaaaccaaataaagttagggaatctgtggcacaaggagaatcactgactgacccaagttcatatgtttggtaaaaagaactaatatagtaccaagagcctctttagcaaagaccacacatgcctagaataatgtacactaatactggatttctatataaagaaaagatttaccaaatagctagtcagtcactttggacccacaaaactgatgttcwttatggctattttaaattatttcctaataattcttactgatatggcagttcaaaagtttacactggccttgtttttaaactctgcagcattaatgaccagcagtttacccttactcatttatttttaaaaataagattcacatctatctatccatccatccatgcatttatttatttttgcactctatttatttttgcacgtctaggctggagtgcagtagtgtgatcatggctcactgcagccttgacgtcctggactcaaatgatgccccagcctcagcctacctggtagctggaact

SEQ ID NO: 75974 - DNA, 601 bp, Human
atttgtttcttccccacctatatttcttaatagataattatagtgaatatcgggtactataggtaaattagactttagagtagttcataatttcatgaaatacaatcctgataatttctcttgtgttttataaaatcacctaattgaaaccttaattgaggcttttctcatgatagtactaatatatttttaaagaccgatgctcctccacttacatacaatggggttatgtcccaataaacccactgtttagtggaaaatattgtaaattgaaagtacattttcaacttgtattttttttacttataacaggtttatccagacaaagctccatcataagttgagaagcatactgaatgcatatcatttttgtaccatcataaagttgaaaagatcctaaagtgaaccatcataaatcagggaccgtccatatttagatatgaaaggtaatcaatagagcttgacagaacttttaaaatctttactaattacatataactccatttttgtgccttagctgtttcatctataaaatgccgtccagcaagttaatcttcagctgaacgcatatgtagtttgaaagcaaatctaacactgcaac

SEQ ID NO: 75975 - DNA, 601 bp, Human
cacctgtaatcccagctacttaagaggctgaggcaggagaattgctggaacctgggaggcggaagttgcagtgagccgagattgcaccactgcactccagcctgggagacagagcaagactccatctcaaaaaataaaaaaatataaaaggaaaacaaatttacttttgccacatatccaaaacttgggcaggaaagaatgctgctggtctcaagagctacatctactagcttaaagtccgttaacccagtaaagtcaatagaaggaaatatatttcaaaggcaaccaaaagtgttcaacaaaatcacaagcatttttcagaactctatagaaatacagattttatttttaattgattcccacttctgcaaaaagaaatacagattttaaaatagcacagaactggatgaaaaaataaaaactagaaacaggatttgtttcttccccacctatatttcttaatagataattatagtgaatatcgggtactataggtaaattagactttagagtagttcataatttcatgaaatacaatcctgataatttctcttgtgttttataaaatcacctaattgaaaccttaattgaggcttttctc

SEQ ID NO: 75976 - DNA, 601 bp, Human
gttcaagaccagcctggccaacatggcaaaaccccatctctactaaaaatacaaaagttagctgggcgtggtggcgggcacctgtaatcccagctacttaagaggctgaggcaggagaattgctggaacctgggaggcggaagttgcagtgagccgagattgcaccactgcactccagcctgggagacagagcaagactccatctcaaaaaataaaaaaatataaaaggaaaacaaatttacttttgccacatatccaaaacttgggcaggaaagaatgctgctggtctcaagagctacakctactagcttaaagtccgttaacccagtaaagtcaatagaaggaaatatatttcaaaggcaaccaaaagtgttcaactaaatcacaagcatttttcagaactctatagaaatacagattttatttttaattgattcccacttctgcaaaaagaaatacagattttaaaatagcacagaactggatgaaaaaataaaaactagaaacaggatttgtttcttccccacctatatttcttaatagataattatagtgaatatcgggtactataggtaaattagactttagagtagttcataat

SEQ ID NO: 75977 - DNA, 601 bp, Human
ttctttataacataaatgattgcaccctccataaatgacagctcatcatccttgtcttttgtataatcatatattgcaacaactatggaaaaaacagttgaaatatcacatgagtgcactatatccaaaatttacttgaattttaagacaaagacaattaaatatatagcacagcaaaactatttttatgaagatttcttaatttttgtatctatcaatataagtaggtcagtggccaaccatgtacttaaatcattggcttaatcttagagccaaatgacaatctgattagactgaatasatcaataggttctgtcaatcactttaagaaagctctctgaattttagaatttattagatgtttcaattcattcaaataccaagtgcctatcatatgcaaagcaccggcttttcaaaataattatcaggcaaagaaagctgcatagccattcagtaaaccaggtaacaatccaagctatctaatttgaaaaaacacagttactggaaggtaaatcacatcctactcattcaaggacccatgctaatttaagggactgtccccagatttttttttaaagaatatttacttactttaaaggat

SEQ ID NO: 75978 - DNA, 601 bp, Human
taatcagtatagtgcatgattgattcaacatagttcccagggaacagaccagtcactcgattgcagactccttcataccagccatcatcattcttctttataacataaatgattgcaccctccataaatgacagctcatcatccttgtcttttgtataatcatatattgcaacaactatggaaaaaacagttgaaatatcacatgagtgcactatatccaaaatttacttgaattttaagacaaagacaattaaatatatagcacagcaaaactatttttatgaagatttcttaatttttgtatctatcaatataagtaggtcagtggccaaccatgtacttaaatcattggcttaatcttagagccaaatgacaatctgattagactgaatacatcaataggttctgtcaatcactttaagaaagctctctgaattttagaatttattagatgtttcaattcattcaaataccaagtgcctatcatatgcaaagcaccggcttttcaaaataattatcaggcaaagaaagctgcatagccattcagtaaaccaggtaacaatccaagctatctaatttgaaaaaacacagttactggaag

SEQ ID NO: 75979 - DNA, 601 bp, Human
ccgcgcgcaggtgaggttgggaggcgcgcgcccggcggggctcagaggtcacggctccaatgacagcagtgggcggaatgaatgggagcggggagcacgtgcgtcgcgacgcgggggcgcgcggggtagctccggggtagctccggggtgggactccggagctgaggggtgcccgcggtgggacggagccgcgcgttggactgaagtaggggcgccctacacggggttgcagaaagcggtgtcctggggaccccgggagcgttttggggggtggagaaagcggtgggatccgtgtcctggsggaagcgcaggagcgatcagattgaccgctgctatatggacaaggttaattaagcctggagagcgactgcagctatttactttggagttagaggaagacagatcttgcctgaaattttagagccaaagtgctcagagctctctccgagaaacggaggatcgaatcggcctcggaatagtccgaaaaggtcttgtggagaatgcagggctggtgctagggtggaccggaccttagttgtccagcagtggcttcgggaggagagcacacctggatggggctggaatgacactggaaggagaa

SEQ ID NO: 75980 - DNA, 601 bp, Human
taaagtcagaatctcagtgatagcccattctttcagggtctcctctgctgcctttgggttccgatctcctttttctccctttctggtcagtttagcccctgtaaatggacactgtgagcccttctgcactttgtaatgattctcagtgtgccatggggtaggcccatgctattagcataaccgtgcaaaatctatggactcactgttacttaagtttatttgaatttagtactcttttaattcagatttggtatactttatgtgtccgtgttctcatcaaacatcatttcccagtatgaartatataacacttataaatatctactttgtaccaaagtagatgcgtatcacaaattatccaaaacaaggcttgggccaggcgcagtggctcacacctgtaatcccagcactttgggaggctgaggtgggagaatcggttgaggccaggagtttgggaccagcctaggcaacatagcaagactctgtctctataaaaaatagaaaaaattcaccaggtggggtggtgcatgcctgtagttctacctactcaggagcctgagggaggaggattgttcgatcccaggagttcaagattacagtg

SEQ ID NO: 75981 - DNA, 601 bp, Human
ctatacgttaatatgttagcattctggtgtctgcctcaggcatgtgtattttggttacttcaagtctcttagggcctgatagtccttggggacacagaactacaataactaagccacagggacaaagagcggcaataattaagccacgtcttgctctccaccagagctctactacctcctaatggttgtacattcttctgacttcactagtagtgtgaacaaatattgtaatacaataaaaaccagtgtgcatgtgatcgtgccaaatcacttctcaatatatctttgattttttttttttaatttatttttttagagacggggactttttgtgttggccaggttggtcttgaactcttggactcaagccattcccccctcccccccaccccgcttgaggattggcacacggccatgtatttgattcttacccagcactttctctttagctgagcgtggtggctcacgcctgtaatcccaacagtttgggaggccgaggcaggagaatccctttagctcaggagttcgagaccagcctgggccacttagtgagacctcctgatacggtttggctctgtatgcccacccacatctatctcga

SEQ ID NO: 75982 - DNA, 601 bp, Human
aaatcacttctcaatatatctttgattttttttttttaatttatttttttagagacggggactttttgtgttggccaggttggtcttgaactcttggactcaagccattcccccctcccccccaccccgcttgaggattggcacacggccatgtatttgattcttacccagcactttctctttagctgagcgtggtggctcacgcctgtaatcccaacagtttgggaggccgaggcaggagaatccctttagctcaggagttcgagaccagcctgggccacttagtgagacctcctgatayggtttggctctgtatgcccacccacatctatctcgaattgtaatccccaattacatttggggaccagggagggtcaagggagggaccaggtggaggtaattggatcatgggggtggattcccccatgctgttctcatgatagggagttctcacaagatctcctggttttataagtgtttggtagttcctcctgtgttcattctgtctcctgccgccttgtgaagaaggtgcttgtttctccttctccttcttccaccatgattctaagtttctgaggcctccccagccattcagaactgt

SEQ ID NO: 75983 - DNA, 601 bp, Human
tatatctttgattttttttttttaatttatttttttagagacggggactttttgtgttggccaggttggtcttgaactcttggactcaagccattcccccctcccccccaccccgcttgaggattggcacacggccatgtatttgattcttacccagcactttctctttagctgagcgtggtggctcacgcctgtaatcccaacagtttgggaggccgaggcaggagaatccctttagctcaggagttcgagaccagcctgggccacttagtgagacctcctgatacggtttggctctgtrtgcccacccacatctatctcgaattgtaatccccaattacatttggggaccagggagggtcaagggagggaccaggtggaggtaattggatcatgggggtggattcccccatgctgttctcatgatagggagttctcacaagatctcctggttttataagtgtttggtagttcctcctgtgttcattctgtctcctgccgccttgtgaagaaggtgcttgtttctccttctccttcttccaccatgattctaagtttctgaggcctccccagccattcagaactgtgagtcaattaaacc

SEQ ID NO: 75984 - DNA, 601 bp, Human
atttatttttttagagacggggactttttgtgttggccaggttggtcttgaactcttggactcaagccattcccccctcccccccaccccgcttgaggattggcacacggccatgtatttgattcttacccagcactttctctttagctgagcgtggtggctcacgcctgtaatcccaacagtttgggaggccgaggcaggagaatccctttagctcaggagttcgagaccagcctgggccacttagtgagacctcctgatacggtttggctctgtatgcccacccacatctatctcgaaytgtaatccccaattacatttggggaccagggagggtcaagggagggaccaggtggaggtaattggatcatgggggtggattcccccatgctgttctcatgatagggagttctcacaagatctcctggttttataagtgtttggtagttcctcctgtgttcattctgtctcctgccgccttgtgaagaaggtgcttgtttctccttctccttcttccaccatgattctaagtttctgaggcctccccagccattcagaactgtgagtcaattaaacctctttcctataattataaattgcc

SEQ ID NO: 75985 - DNA, 601 bp, Human
acggggactttttgtgttggccaggttggtcttgaactcttggactcaagccattcccccctcccccccaccccgcttgaggattggcacacggccatgtatttgattcttacccagcactttctctttagctgagcgtggtggctcacgcctgtaatcccaacagtttgggaggccgaggcaggagaatccctttagctcaggagttcgagaccagcctgggccacttagtgagacctcctgatacggtttggctctgtatgcccacccacatctatctcgaattgtaatccccaattayatttggggaccagggagggtcaagggagggaccaggtggaggtaattggatcatgggggtggattcccccatgctgttctcatgatagggagttctcacaagatctcctggttttataagtgtttggtagttcctcctgtgttcattctgtctcctgccgccttgtgaagaaggtgcttgtttctccttctccttcttccaccatgattctaagtttctgaggcctccccagccattcagaactgtgagtcaattaaacctctttcctataattataaattgcccagtcatgggtaattt

SEQ ID NO: 75986 - DNA, 601 bp, Human
tcttacccagcactttctctttagctgagcgtggtggctcacgcctgtaatcccaacagtttgggaggccgaggcaggagaatccctttagctcaggagttcgagaccagcctgggccacttagtgagacctcctgatacggtttggctctgtatgcccacccacatctatctcgaattgtaatccccaattacatttggggaccagggagggtcaagggagggaccaggtggaggtaattggatcatgggggtggattcccccatgctgttctcatgatagggagttctcacaagatctsctggttttataagtgtttggtagttcctcctgtgttcattctgtctcctgccgccttgtgaagaaggtgcttgtttctccttctccttcttccaccatgattctaagtttctgaggcctccccagccattcagaactgtgagtcaattaaacctctttcctataattataaattgcccagtcatgggtaatttctttatagcagtgtgagaatggaccaatacagataattggtaccaaagtagttggcattgatataagatacctgagaatgtggaaattactttggaactgggtaaca

SEQ ID NO: 75987 - DNA, 601 bp, Human
cattctgtctcctgccgccttgtgaagaaggtgcttgtttctccttctccttcttccaccatgattctaagtttctgaggcctccccagccattcagaactgtgagtcaattaaacctctttcctataattataaattgcccagtcatgggtaatttctttatagcagtgtgagaatggaccaatacagataattggtaccaaagtagttggcattgatataagatacctgagaatgtggaaattactttggaactgggtaacaagcagaggttggaatagtttggagggctcagaagaasaaaggaagatgtaggaaagtttggaaattcctagagtcttgttgaatggctttgaccaaaatgctgaaagtgatatggatgatgaagtccaggctgaggtggtctcagatggagatgaggagcttcctgggaactgggcaaaggtcactcttgctatgctttagcaaagagactggtggcattttgccccaccctagagatctgtggaactttgagcctgagagagatgatctgaaattggaacttaaatttaaaggggaagcagagcataaacgtttggaaaatttgcagcctgaagat

SEQ ID NO: 75988 - DNA, 601 bp, Human
cctccccagccattcagaactgtgagtcaattaaacctctttcctataattataaattgcccagtcatgggtaatttctttatagcagtgtgagaatggaccaatacagataattggtaccaaagtagttggcattgatataagatacctgagaatgtggaaattactttggaactgggtaacaagcagaggttggaatagtttggagggctcagaagaacaaaggaagatgtaggaaagtttggaaattcctagagtcttgttgaatggctttgaccaaaatgctgaaagtgatatggaygatgaagtccaggctgaggtggtctcagatggagatgaggagcttcctgggaactgggcaaaggtcactcttgctatgctttagcaaagagactggtggcattttgccccaccctagagatctgtggaactttgagcctgagagagatgatctgaaattggaacttaaatttaaaggggaagcagagcataaacgtttggaaaatttgcagcctgaagatgtgatagaaaagaattttctggggaggaattcaagctggctgcagacatttgcataagtaacaaggagccgaatgttaat

SEQ ID NO: 75989 - DNA, 601 bp, Human
aattgcccagtcatgggtaatttctttatagcagtgtgagaatggaccaatacagataattggtaccaaagtagttggcattgatataagatacctgagaatgtggaaattactttggaactgggtaacaagcagaggttggaatagtttggagggctcagaagaacaaaggaagatgtaggaaagtttggaaattcctagagtcttgttgaatggctttgaccaaaatgctgaaagtgatatggatgatgaagtccaggctgaggtggtctcagatggagatgaggagcttcctgggaaytgggcaaaggtcactcttgctatgctttagcaaagagactggtggcattttgccccaccctagagatctgtggaactttgagcctgagagagatgatctgaaattggaacttaaatttaaaggggaagcagagcataaacgtttggaaaatttgcagcctgaagatgtgatagaaaagaattttctggggaggaattcaagctggctgcagacatttgcataagtaacaaggagccgaatgttaatagccaagagaatggggaaaatgtctccagagcatgtcagagaccttctctgcag

SEQ ID NO: 75990 - DNA, 601 bp, Human
gcaaagccacagaggcagagccacccaagttcttgggagcccaccctttgcatcagtgtgacctagatgtgagacatggagtcaaagatcattttggagctttaagtaatgactgccctgctgggtttggacttgcatgaggcctgtaagccccttcgttttggccaatttctaccatttggaatgggaacatttaaccaatgcctgtacccccattgtatcttggatgtaactaacttgtttttgattttacaggttcataggcggaagggacttgacttgtctcaggtaagactttggrcttggacttttgagttaatgctagaatgagttaagacttttgaggactgttcggaaggaatgattggttttgaaaaatgaggatatgagatttgggaggagcaaggggcagaacgatatggttggttctgtgtctctacccaaatctcatctcaaattttaatccccatgtgtcaaaggagggcctatgtggaggtaattggatcctgggggcagattcccccatgctgttcttgttatagcgaattcttatgagatctgatggttttataagtgattggtagttccttctgtgttcatt

SEQ ID NO: 75991 - DNA, 601 bp, Human
agcagaaaatagtagcttgattgaatagatactgtattaaatgtatattgtgtaccaggctctgagctaagagctttacatctgctctctaaattaatctccacctctctccatgagtaggtattatcagaaagacatcacaaggtaacacaaatgttgagatttgaaccgagatctgtcttccaaagtccatgctactaataattgttaggccacttggtggtaaaaagcgtcccctgtattaattagctgtgtaattttaatccttcaacccagattaggggtctataactgaataacyaaaaagttattcagttagaatagttcagttagttattaactaatcatagttatttggtcaagcgcagtgactcacgtctgtaattccagcacttggggaggctgtggcaggaggatacttctaataatagtaactattactagagacctgataataattattaagtctcttactgaagaagttttactcttccattaagatgcccttatttataagtattataataaaatactgaactcatatgaattaattacccatgtagactgaaagacataggttgtcatataatggttgtcatat

SEQ ID NO: 75992 - DNA, 601 bp, Human
taaatgtatattgtgtaccaggctctgagctaagagctttacatctgctctctaaattaatctccacctctctccatgagtaggtattatcagaaagacatcacaaggtaacacaaatgttgagatttgaaccgagatctgtcttccaaagtccatgctactaataattgttaggccacttggtggtaaaaagcgtcccctgtattaattagctgtgtaattttaatccttcaacccagattaggggtctataactgaataaccaaaaagttattcagttagaatagttcagttagttataaactaatcatagttatttggtcaagcgcagtgactcacgtctgtaattccagcacttggggaggctgtggcaggaggatacttctaataatagtaactattactagagacctgataataattattaagtctcttactgaagaagttttactcttccattaagatgcccttatttataagtattataataaaatactgaactcatatgaattaattacccatgtagactgaaagacataggttgtcatataatggttgtcatataaagcatgaaggaggattgtcactttgttttcttgtt

SEQ ID NO: 75993 - DNA, 601 bp, Human
gtaggtattatcagaaagacatcacaaggtaacacaaatgttgagatttgaaccgagatctgtcttccaaagtccatgctactaataattgttaggccacttggtggtaaaaagcgtcccctgtattaattagctgtgtaattttaatccttcaacccagattaggggtctataactgaataaccaaaaagttattcagttagaatagttcagttagttattaactaatcatagttatttggtcaagcgcagtgactcacgtctgtaattccagcacttggggaggctgtggcaggaggacacttctaataatagtaactattactagagacctgataataattattaagtctcttactgaagaagttttactcttccattaagatgcccttatttataagtattataataaaatactgaactcatatgaattaattacccatgtagactgaaagacataggttgtcatataatggttgtcatataaagcatgaaggaggattgtcactttgttttcttgttgcactgtaattgcctgggatatcatgaaagttcttactggtttaatgaatatgtaatgctgtgggggaaagaatgaaac

SEQ ID NO: 75994 - DNA, 601 bp, Human
tgtgctaaatccaatggatgtgttaccagcagcaaatttgtacaggtctgcagcaaccttaattcttgcctcctcagaagaaagaattcgactgaggggcctaaggcagaaggagagacggaggcaagttttagagcaggagagaaagtttattattaagtgtagagtaggaagggaaggaagtaaagtacacttgtaagagggccaagctggtgacctgagagaaagtgtggtttgaccttggaatttgggttttagatgttggcatacttccagggacttgcatcccgatctccccggwttcttcccttggggtgggctgcccgcatgcgcagtggcccgccagtgttggggaggggagcatgctcagtgtgtttaccggagttttgcgcatgctcacgtgaggcattcttcccataccagtcccagttttcctagaaggacatacaccaattaagctctgccattttgcctcttagtgtgcatggttgagccgactcacccaactcccgagatcttattgggaagctgatcaccagtttcaggtttttgtatctattgagagactgccgtcccttggcaccagctgtgaccaattagt

SEQ ID NO: 75995 - DNA, 601 bp, Human
ttacctgggtgacagcaccacacccatcacactgtgttgtgtcaacggcagtgatcgttttacttctccccatctagaccctgagctccttgtaggcaaggcttgtcttactttacctttgtgacctctgtgtctgttacagtgcctggcactaagtcggtaatttactgaatgaacgatgggcccactttgttgtgttcacctgtgccgagctgaggttcattgactcccactgcatccaggggataaactctgacttagtcttggagtggcagatacaagcgacacacacccgtcagcyggaaggctcttgtcctctttgtgaatcagaaccctgtttaggcttctaatcccacatcaaagcccatctcctccatgaaatactcagtttttctagcctgcactgatctcttccttccctgaactttcaatgtatttaatgtacagcattgttcacgctaccactgtattcgtcattgattgtttcatatttgcaaaatgtttctctccccagttcagttgtaggctccttgtaatccggcagcccatgccttatatgggctctatgcgcttacgtgggcctctatgaaccctcaaaatg

SEQ ID NO: 75996 - DNA, 601 bp, Human
gccaagccagatggactgagccctgtttcttctccttggctgtggccttactatcttcctgcccctcgtaaacagctttgcccctgggagtttgaggctgcagtgagttatgatcgtgccactgccctgaggcctgggtgacagagcaagaccttgtctctaaaaaaattaaaataaaaaatttaaaaaaacaactttgccaccctacccatcacaccccacccgcctgacctgcttcacaggctcccgacggccactggcttccaccttccccatctttctcttcccgcctccatctttyaagctgcgaaccagcccctgttcctttcactgtccagctgtcaatgagcccagagtcccttagccacctagtgctttcttccccctcctgctgtctcttggggtcttctggtgtctgattctgtcagcggggcaggtggcagtacctgttctagcattcaggccacttggggctgatccacgcattgtttatgttctagcctgcaggacagccaggtggatggccctgcagcgtgggagccttgcccacggagtgttgaatttcttaattgaaatgaatacacttaaattaaaccaaagt

SEQ ID NO: 75997 - DNA, 601 bp, Human
ttctccttggctgtggccttactatcttcctgcccctcgtaaacagctttgcccctgggagtttgaggctgcagtgagttatgatcgtgccactgccctgaggcctgggtgacagagcaagaccttgtctctaaaaaaattaaaataaaaaatttaaaaaaacaactttgccaccctacccatcacaccccacccgcctgacctgcttcacaggctcccgacggccactggcttccaccttccccatctttctcttcccgcctccatcttttaagctgcgaaccagcccctgttcctttcrctgtccagctgtcaatgagcccagagtcccttagccacctagtgctttcttccccctcctgctgtctcttggggtcttctggtgtctgattctgtcagcggggcaggtggcagtacctgttctagcattcaggccacttggggctgatccacgcattgtttatgttctagcctgcaggacagccaggtggatggccctgcagcgtgggagccttgcccacggagtgttgaatttcttaattgaaatgaatacacttaaattaaaccaaagttttgtagaagaaatcctggccaggcacgg

SEQ ID NO: 75998 - DNA, 601 bp, Human
tggctgtggccttactatcttcctgcccctcgtaaacagctttgcccctgggagtttgaggctgcagtgagttatgatcgtgccactgccctgaggcctgggtgacagagcaagaccttgtctctaaaaaaattaaaataaaaaatttaaaaaaacaactttgccaccctacccatcacaccccacccgcctgacctgcttcacaggctcccgacggccactggcttccaccttccccatctttctcttcccgcctccatcttttaagctgcgaaccagcccctgttcctttcactgtccrgctgtcaatgagcccagagtcccttagccacctagtgctttcttccccctcctgctgtctcttggggtcttctggtgtctgattctgtcagcggggcaggtggcagtacctgttctagcattcaggccacttggggctgatccacgcattgtttatgttctagcctgcaggacagccaggtggatggccctgcagcgtgggagccttgcccacggagtgttgaatttcttaattgaaatgaatacacttaaattaaaccaaagttttgtagaagaaatcctggccaggcacggtggctca

SEQ ID NO: 75999 - DNA, 601 bp, Human
ctgggagtttgaggctgcagtgagttatgatcgtgccactgccctgaggcctgggtgacagagcaagaccttgtctctaaaaaaattaaaataaaaaatttaaaaaaacaactttgccaccctacccatcacaccccacccgcctgacctgcttcacaggctcccgacggccactggcttccaccttccccatctttctcttcccgcctccatcttttaagctgcgaaccagcccctgttcctttcactgtccagctgtcaatgagcccagagtcccttagccacctagtgctttcttccmcctcctgctgtctcttggggtcttctggtgtctgattctgtcagcggggcaggtggcagtacctgttctagcattcaggccacttggggctgatccacgcattgtttatgttctagcctgcaggacagccaggtggatggccctgcagcgtgggagccttgcccacggagtgttgaatttcttaattgaaatgaatacacttaaattaaaccaaagttttgtagaagaaatcctggccaggcacggtggctcacgcctgtaatcccaacactttgggaggccgaggcgggtggatcacct

SEQ ID NO: 76000 - DNA, 601 bp, Human
ccttccccatctttctcttcccgcctccatcttttaagctgcgaaccagcccctgttcctttcactgtccagctgtcaatgagcccagagtcccttagccacctagtgctttcttccccctcctgctgtctcttggggtcttctggtgtctgattctgtcagcggggcaggtggcagtacctgttctagcattcaggccacttggggctgatccacgcattgtttatgttctagcctgcaggacagccaggtggatggccctgcagcgtgggagccttgcccacggagtgttgaatttctyaattgaaatgaatacacttaaattaaaccaaagttttgtagaagaaatcctggccaggcacggtggctcacgcctgtaatcccaacactttgggaggccgaggcgggtggatcacctgatgtcaggagtttaagaccagcctggccaacgtggtgaaatcccgtctctactaaaaatacaaaaaattagccaggcattgtggtgggtgcttgtaatcccagctgcttgcggggctgaggcaggagaatcgcatgaacccgggaggcggaggttacaatgagctgagatcgttccattgca

SEQ ID NO: 76001 - DNA, 601 bp, Human
ggggctgatccacgcattgtttatgttctagcctgcaggacagccaggtggatggccctgcagcgtgggagccttgcccacggagtgttgaatttcttaattgaaatgaatacacttaaattaaaccaaagttttgtagaagaaatcctggccaggcacggtggctcacgcctgtaatcccaacactttgggaggccgaggcgggtggatcacctgatgtcaggagtttaagaccagcctggccaacgtggtgaaatcccgtctctactaaaaatacaaaaaattagccaggcattgtggygggtgcttgtaatcccagctgcttgcggggctgaggcaggagaatcgcatgaacccgggaggcggaggttacaatgagctgagatcgttccattgcactccagtctgggcaacaagagcgaaactccgtctcaaaaaaaaaaagaaatcctgttggctttctgtgcagttttttgatgccattgtgacacagagaaactttatttcaggaactgcttatatcaacatcagaacttaaggaaatgtctgagtactactttgatgggaaagggaaagcctttcgaccaattattgtggcgct

SEQ ID NO: 76002 - DNA, 601 bp, Human
gagatcgttccattgcactccagtctgggcaacaagagcgaaactccgtctcaaaaaaaaaaagaaatcctgttggctttctgtgcagttttttgatgccattgtgacacagagaaactttatttcaggaactgcttatatcaacatcagaacttaaggaaatgtctgagtactactttgatgggaaagggaaagcctttcgaccaattattgtggcgctaatggcccgagcatgcaatattcatcataacaactcccggtgagctctttttttcattcctttcttgtttttatatttggsaagtctttcttcccggggttacttactgtttcatttcccatttaagaattagcatataccggctgggcatggtggctcatgcctataatcccagcattctgggagcctgaggcgggtggatcgtgagatcaggagtttgagaccagcctggccaacatggtgagaccccgtctctactaaaaatacaaaaaaaattagccgggcgtggtggcaggtgcctgtaatcccagctacttgggaggctgaggcaggagaatcgtttgaatctgggaggcggaggttgcagtgagccgagatcac

SEQ ID NO: 76003 - DNA, 601 bp, Human
gtgggatgtctgtaaacaacttgacattgtatgcaaaattttgtgtatatttggattttttggggaaggatttctatggcttacagtttattctcaaagggaagtagggccctgaaaagctcaggaccccgtgtttgttttctctctgaatcttgctaaccatggtgtctgggtagagaaagtaggaatccacacaacagtagactcagacttgacatgtccagaacacagagttgtggtggatcctgagacttgcccccagatcccccgtcagtgcacgactctgccccagctgctgtaycaggtatggttggtacctgttggccttcatttcttagcctcttcaaggattgccttggctacaaagagtcctctcaccttaggctgtgccccttcgggaggcagcccacatccagggactgatagatgaagggccattctacctgcacaccctagagggtgtttcaggctgttgattccagctcagcttctcctgctacccagtcctgtatcctctccccctccctcaggtgtcagtaatcccaagggataatcccgaataaacatcctgtcctttaaacttcatctcagagtctgcctc

SEQ ID NO: 76004 - DNA, 601 bp, Human
ttggggaaggatttctatggcttacagtttattctcaaagggaagtagggccctgaaaagctcaggaccccgtgtttgttttctctctgaatcttgctaaccatggtgtctgggtagagaaagtaggaatccacacaacagtagactcagacttgacatgtccagaacacagagttgtggtggatcctgagacttgcccccagatcccccgtcagtgcacgactctgccccagctgctgtaccaggtatggttggtacctgttggccttcatttcttagcctcttcaaggattgccttggytacaaagagtcctctcaccttaggctgtgccccttcgggaggcagcccacatccagggactgatagatgaagggccattctacctgcacaccctagagggtgtttcaggctgttgattccagctcagcttctcctgctacccagtcctgtatcctctccccctccctcaggtgtcagtaatcccaagggataatcccgaataaacatcctgtcctttaaacttcatctcagagtctgcctcctgcagaacctaacttgcaacagagctcagcaaaacccaagctcattttattaaagaac

SEQ ID NO: 76005 - DNA, 601 bp, Human
ctgagacttgcccccagatcccccgtcagtgcacgactctgccccagctgctgtaccaggtatggttggtacctgttggccttcatttcttagcctcttcaaggattgccttggctacaaagagtcctctcaccttaggctgtgccccttcgggaggcagcccacatccagggactgatagatgaagggccattctacctgcacaccctagagggtgtttcaggctgttgattccagctcagcttctcctgctacccagtcctgtatcctctccccctccctcaggtgtcagtaatcccargggataatcccgaataaacatcctgtcctttaaacttcatctcagagtctgcctcctgcagaacctaacttgcaacagagctcagcaaaacccaagctcattttattaaagaacccagatcaaaaaagagctttatgggctgggcacagtggctcacgcctgtaatcccagcactttgggaggccaaggtgggtggatcacatgagttcaggagtttgaggctagcctggccaacatggtgaaaccccatctctacaaaaaatataaaaattagccagtcgtggtgacacacacctataa

SEQ ID NO: 76006 - DNA, 601 bp, Human
gtatggttggtacctgttggccttcatttcttagcctcttcaaggattgccttggctacaaagagtcctctcaccttaggctgtgccccttcgggaggcagcccacatccagggactgatagatgaagggccattctacctgcacaccctagagggtgtttcaggctgttgattccagctcagcttctcctgctacccagtcctgtatcctctccccctccctcaggtgtcagtaatcccaagggataatcccgaataaacatcctgtcctttaaacttcatctcagagtctgcctcctgsagaacctaacttgcaacagagctcagcaaaacccaagctcattttattaaagaacccagatcaaaaaagagctttatgggctgggcacagtggctcacgcctgtaatcccagcactttgggaggccaaggtgggtggatcacatgagttcaggagtttgaggctagcctggccaacatggtgaaaccccatctctacaaaaaatataaaaattagccagtcgtggtgacacacacctataaatcccagctactcaggaggctggggcaggagaatcgcttgaacccaggaggtggaggct

SEQ ID NO: 76007 - DNA, 601 bp, Human
aggctgttgattccagctcagcttctcctgctacccagtcctgtatcctctccccctccctcaggtgtcagtaatcccaagggataatcccgaataaacatcctgtcctttaaacttcatctcagagtctgcctcctgcagaacctaacttgcaacagagctcagcaaaacccaagctcattttattaaagaacccagatcaaaaaagagctttatgggctgggcacagtggctcacgcctgtaatcccagcactttgggaggccaaggtgggtggatcacatgagttcaggagtttgagrctagcctggccaacatggtgaaaccccatctctacaaaaaatataaaaattagccagtcgtggtgacacacacctataaatcccagctactcaggaggctggggcaggagaatcgcttgaacccaggaggtggaggctgcagtgagcagagattgcgccactgcactccagcctaggggagactctgtctcaaaaaaaaaaaaaaagaaaagaaaaagagctttatgatagatttctataaaattgcttcactcactgaatgcagcacagttatagtgtctgcatgtttctcagacaagc

SEQ ID NO: 76008 - DNA, 601 bp, Human
gctgttgattccagctcagcttctcctgctacccagtcctgtatcctctccccctccctcaggtgtcagtaatcccaagggataatcccgaataaacatcctgtcctttaaacttcatctcagagtctgcctcctgcagaacctaacttgcaacagagctcagcaaaacccaagctcattttattaaagaacccagatcaaaaaagagctttatgggctgggcacagtggctcacgcctgtaatcccagcactttgggaggccaaggtgggtggatcacatgagttcaggagtttgaggcyagcctggccaacatggtgaaaccccatctctacaaaaaatataaaaattagccagtcgtggtgacacacacctataaatcccagctactcaggaggctggggcaggagaatcgcttgaacccaggaggtggaggctgcagtgagcagagattgcgccactgcactccagcctaggggagactctgtctcaaaaaaaaaaaaaaagaaaagaaaaagagctttatgatagatttctataaaattgcttcactcactgaatgcagcacagttatagtgtctgcatgtttctcagacaagcca

SEQ ID NO: 76009 - DNA, 601 bp, Human
agagctttatgggctgggcacagtggctcacgcctgtaatcccagcactttgggaggccaaggtgggtggatcacatgagttcaggagtttgaggctagcctggccaacatggtgaaaccccatctctacaaaaaatataaaaattagccagtcgtggtgacacacacctataaatcccagctactcaggaggctggggcaggagaatcgcttgaacccaggaggtggaggctgcagtgagcagagattgcgccactgcactccagcctaggggagactctgtctcaaaaaaaaaaaaaaagaaaagaaaaagagctttatgatagatttctataaaattgcttcactcactgaatgcagcacagttatagtgtctgcatgtttctcagacaagccaaacctacctagcctgctcagctgcctcattgaagacactgttatcactggcacctggatcttggcaccatccattcctgtgtgaaactcttttagttctaagaagtgaatatcattgccagcaatcaggataacagactacccaaattgtgctgtacagagatctgttgatatcaattttgcaaatagccaatggcattggatt

SEQ ID NO: 76010 - DNA, 601 bp, Human
agttaaaaaaattcccactgaagagagacagactttattctgagccttacgtgtttctttaggtttagaaggtgaatgagcagtggctggggaggatggcctagaagttggagctcacaggcttcctccctgcactctgccattccttagattggaggcgcccttgatacagatccctccctacacactgggggtttacttgcaatttaagacttcacattttatattagtatgaacagggaaaatatattttgtaaaaccacatgtaaacctcgtaaaggattcactggtagggtcattrtattattctatctatttttaggtatgtttgaaactcttcattattaaaaaaatttttttggccgggtgcggtggctcacgtaatctcagcactctgggaggccaaggcaggtggatcatgtgaggtcatgagtttgagaccagccttgccaacatggcaaaaccccatctctactaaaaatacaaaaattatctgggcgtggtggcacacgcctgtagtctcagctacctgggaggctcaggcagaagaatcactaaaacaaggaggcgaaggttgcagtgagtcaagattgcgcccctg

SEQ ID NO: 76011 - DNA, 601 bp, Human
attcccactgaagagagacagactttattctgagccttacgtgtttctttaggtttagaaggtgaatgagcagtggctggggaggatggcctagaagttggagctcacaggcttcctccctgcactctgccattccttagattggaggcgcccttgatacagatccctccctacacactgggggtttacttgcaatttaagacttcacattttatattagtatgaacagggaaaatatattttgtaaaaccacatgtaaacctcgtaaaggattcactggtagggtcattgtattattctrtctatttttaggtatgtttgaaactcttcattattaaaaaaatttttttggccgggtgcggtggctcacgtaatctcagcactctgggaggccaaggcaggtggatcatgtgaggtcatgagtttgagaccagccttgccaacatggcaaaaccccatctctactaaaaatacaaaaattatctgggcgtggtggcacacgcctgtagtctcagctacctgggaggctcaggcagaagaatcactaaaacaaggaggcgaaggttgcagtgagtcaagattgcgcccctgcactctagcc

SEQ ID NO: 76012 - DNA, 601 bp, Human
atcctgatttcatcagtcaacaatttagccatgcaaaatgacattttttattctatttatttatttattcggagacagagtctcgctctaccccccaggctggagtacagtggtgcaagtctcagctcactgcaacctccacctcccaggttcaagcgattctcctgcctcagcctcccaagtagctgggattacaggcacccactaccatgcctggctagtttttgtatttttagtggagacgtggtttcgtcatgttggccaggctggtctcgaactcctgacctcaggtgatcctccygcctcggcgtcccaaagcgctgggattatgggcatgagccactgcgccaggcgcaaaatgacatttttagatggatatatagtctatgaaatttcaaaatattttaagaaatctttgttgtaataatagcttcagattaccaaaacaactctagtatcttggtgagtgctgccaatttcattgcaacttctcagcaggagccccgtctgctgatgtaatttatcataatggaagtggtgcccaacttctgaatgcatgagaaaggctagaccttacctgttgttttaaggtaaggtctac

SEQ ID NO: 76013 - DNA, 601 bp, Human
accttacctgttgttttaaggtaaggtctactgctaactagtaggaggtgtctaatttattagactgaaattcacttgcaaaaatattctaaaagccttatattaaaaaaaaactgtaaaagtttatatcttttcctgtgcattcaactcaaagaagatagggcctagtaaatttacctgaaaaatatttaagtattctaatataaaaactgaatctcactgagggattcaggtggcttaaaactcacctgaaccctgaacctctattttctcatttactgaagtttattggggtttttgktttttttgtgtttttttgaaatgaagtctctgtcacccaggctggagtgcagtggcataatctcggctcactgcaacctccacttcccggctcaagtgattctcctgcatcagcctctcaagtagctgggattacagatgcacaccaccatgcccgactaatctttgtattttaagtagagttggagtttcaccctgttgtccaggctggtctcgaactcctgacctcaagtgatccgcccgcctcagccttccagagtgctgggattacaggcaggaacctgtaactgtgcctagacta

SEQ ID NO: 76014 - DNA, 601 bp, Human
cctgttgttttaaggtaaggtctactgctaactagtaggaggtgtctaatttattagactgaaattcacttgcaaaaatattctaaaagccttatattaaaaaaaaactgtaaaagtttatatcttttcctgtgcattcaactcaaagaagatagggcctagtaaatttacctgaaaaatatttaagtattctaatataaaaactgaatctcactgagggattcaggtggcttaaaactcacctgaaccctgaacctctattttctcatttactgaagtttattggggtttttggtttttgtgtgtttttttgaaatgaagtctctgtcacccaggctggagtgcagtggcataatctcggctcactgcaacctccacttcccggctcaagtgattctcctgcatcagcctctcaagtagctgggattacagatgcacaccaccatgcccgactaatctttgtattttaagtagagttggagtttcaccctgttgtccaggctggtctcgaactcctgacctcaagtgatccgcccgcctcagccttccagagtgctgggattacaggcaggaacctgtaactgtgcctagactacagaag

SEQ ID NO: 76015 - DNA, 601 bp, Human
ttgttttaaggtaaggtctactgctaactagtaggaggtgtctaatttattagactgaaattcacttgcaaaaatattctaaaagccttatattaaaaaaaaactgtaaaagtttatatcttttcctgtgcattcaactcaaagaagatagggcctagtaaatttacctgaaaaatatttaagtattctaatataaaaactgaatctcactgagggattcaggtggcttaaaactcacctgaaccctgaacctctattttctcatttactgaagtttattggggtttttggtttttttgtktttttttgaaatgaagtctctgtcacccaggctggagtgcagtggcataatctcggctcactgcaacctccacttcccggctcaagtgattctcctgcatcagcctctcaagtagctgggattacagatgcacaccaccatgcccgactaatctttgtattttaagtagagttggagtttcaccctgttgtccaggctggtctcgaactcctgacctcaagtgatccgcccgcctcagccttccagagtgctgggattacaggcaggaacctgtaactgtgcctagactacagaagtggt

SEQ ID NO: 76016 - DNA, 601 bp, Human
ttgtcatactaaacgtttaatttaagacattactacgcggggtgcggtggcttacgcctgtaatccacactttgggaggccaaggcaggcggatcacttgaggtcaggagttcgagaccaacctagccaacatggtgaaaccccatctctactaaaaatataaaatttagctgggtgtggtggtgtatgcctgtagtcccagctactcatggaggctgaagtgggagaatcacttgaacctgggaggcgaaggttgtgagccaatattgcaccactgcactccagcctgggtgacagagcragaccctgtctcaaaaacaagaaagacagtattaaaagccttgaacattgagacagttgagtctttaaaatacttttaaaaaatgcttctcacctatcttccctatccaccccaaaatttaattgtaaacttataaacttaaacacctgaccaagaacactgttataaagatgattcttcagcccaataagatcagccagacttctgatcgtttactgtttttttggctaatggtacaatttctacttcttcaatggggaattcataaaatgtagttgtggcagggtttctcatacattt

SEQ ID NO: 76017 - DNA, 601 bp, Human
ttaagacattactacgcggggtgcggtggcttacgcctgtaatccacactttgggaggccaaggcaggcggatcacttgaggtcaggagttcgagaccaacctagccaacatggtgaaaccccatctctactaaaaatataaaatttagctgggtgtggtggtgtatgcctgtagtcccagctactcatggaggctgaagtgggagaatcacttgaacctgggaggcgaaggttgtgagccaatattgcaccactgcactccagcctgggtgacagagcgagaccctgtctcaaaaacaaraaagacagtattaaaagccttgaacattgagacagttgagtctttaaaatacttttaaaaaatgcttctcacctatcttccctatccaccccaaaatttaattgtaaacttataaacttaaacacctgaccaagaacactgttataaagatgattcttcagcccaataagatcagccagacttctgatcgtttactgtttttttggctaatggtacaatttctacttcttcaatggggaattcataaaatgtagttgtggcagggtttctcatacatttgtaaatgtatagaaatggctg

SEQ ID NO: 76018 - DNA, 601 bp, Human; identical to SEQ ID NO: 37398

SEQ ID NO: 76019 - DNA, 601 bp, Human; identical to SEQ ID NO: 37397

SEQ ID NO: 76020 - DNA, 601 bp, Human; identical to SEQ ID NO: 37396

SEQ ID NO: 76021 - DNA, 601 bp, Human; identical to SEQ ID NO: 37395

SEQ ID NO: 76022 - DNA, 601 bp, Human; identical to SEQ ID NO: 37394

SEQ ID NO: 76023 - DNA, 601 bp, Human; identical to SEQ ID NO: 37393

SEQ ID NO: 76024 - DNA, 601 bp, Human
ggctcacacctgtaatcccagcatttagggagactgaggcggaaggtttgcttgtgaccagaagttcaagaccaacctaggcaacatagcaagatccccatctctacttaaaaataatgtttaaaaaataaagtcttagaagcattagtagtagtgagactattggaattggaaacaccaagacttactgtctgcaccatgcagacatcctgcaggcacggggtggggcggcaccaaattggagctagcacagaaattcactcagtgatggaagcttacaaagggtccaaagaaatggacytgagtcatgatagagaggtttccttgtggtcactgttttctgtttaagaagccaaagataatgcacaggaattcttttataaagatatgcacctcattcttcaaagattagcagctgaacgaacagtgaacatgttaacgtggctggacccttattaaaaatgaaatgtttcatgctgcccactagggggcatgctggcatcgtcccagcactacctccttttcatgtggtttattcctaaactccacagctcttagaataataaagcaaaatgatagtgtgagctatttgaataaaagt

SEQ ID NO: 76025 - DNA, 601 bp, Human
gagactattggaattggaaacaccaagacttactgtctgcaccatgcagacatcctgcaggcacggggtggggcggcaccaaattggagctagcacagaaattcactcagtgatggaagcttacaaagggtccaaagaaatggacctgagtcatgatagagaggtttccttgtggtcactgttttctgtttaagaagccaaagataatgcacaggaattcttttataaagatatgcacctcattcttcaaagattagcagctgaacgaacagtgaacatgttaacgtggctggacccttawtaaaaatgaaatgtttcatgctgcccactagggggcatgctggcatcgtcccagcactacctccttttcatgtggtttattcctaaactccacagctcttagaataataaagcaaaatgatagtgtgagctatttgaataaaagtttctatatttaagtgcctatgggtggaaatattccagaggtgttatggattcaaaatggctatttttacgtactcttggtatttaaaatgcaaagccatgcgagctccaaataaatgcatgcaaagcaaattagacacaccaaaaagaggggagg

SEQ ID NO: 76026 - DNA, 601 bp, Human
tccattttaggccgggcacggtggctcacacctgtaatcctaacactttaggaggccgaggcgagtggatcactttagtccaggatttcaagaccagcctggccaacatggcaaaaccccgtctgtactaaaaatacaaaaattagccgggcgtggtggtgcacgcctgtaatgccagctacttgggaagctgaggcaggagaaccgcttgaacccgggaggtggaggttgcagtgagccaagatcactccactgcattccagcctgggcaatagagcgagagtctctcaaaaaaaaaaamacaaaccagaattcatgttattatcaaaagatgacttatttatttacatacttactcacttgcaaaatacattttgtactcatgcaaaatacattttgtagcttactaataaagacagtggcttgtttcccaggaaatctggtggaaatgagacctgagaggtcagagggcctgtccagttgttgttaagccagacagtagctgagttgagacttgaacccagagctgggtatggtaatcctgccttgtttctctctctctctctctcttttttttttttttctgaatttctattttctc

SEQ ID NO: 76027 - DNA, 601 bp, Human
gcattttgctgtcatgactctgtagtctcttgtcatctagaacagtctttctttgcctctcattaccttggtatttggaagagtgcaggccagttatgttgttgagcctctcagtcgggcttctctgatacttctcaagattcgatccaggttatgaatatttggcaggaataccacaagagcggtgctgtcctcagctcctcataccaggaggcgcgtgctgtcttgtctgtcccgttactggtgatgcatgcctggatcgcttgattaggatactgtcgggccgggcacagtggctcaygcctgtaatcccagcactttggaaggccgaggtgggcagattacctgaggtcaagagttcaagaccagcctggccaacatggtaaaaccccatctctactaaaattataaaaaattagctgggcatggtggcgggcacctgtaatctcagcactttgggaggccgaggcgggtagatcacctgaggtcaagagtttgacaagcgtggccaacatagtgaaaccatgtctctactaaaaatacaaaaattagccgggcgtagtggcaggcgcctataatcccagctactctggaggctgat

SEQ ID NO: 76028 - DNA, 601 bp, Human
agatgcttaagggccatttatttatttgtttatttatcggagtctcactctgtcacccaggctggagtgcagtggcacgatctcggctcactgcaacctccgcctcccaggttcaagcaattctcctgcctcagcctcccaagtagctgggattacaggcgtgagccactgcgcccagcccttcccagtctcgttgagacgtggcttgtaaggatgtgatgcaaggtgtgaaccttccccagaaagaagtgcatacgcacagcacagcctggctgcagcatctgcttcaaacaaaacagtyagccgagctccactttctttgacttaatcattcttcatgctccacccatttccggaaagatgtgaggcatccctctgatgctgagcgcaagtctgtgcacctctttgccttcttgtatgttgtgctatgttgcgtccaatttgtggcagttgttttctgttttcctgctacagatctaggcagtactgacctgggatggggaagcaggactctctggcatggtctttatgctaccccagggaaatctgggatagttgaaatctgagcagtaatgtcccttcgccatgtgtcaggcagaag

SEQ ID NO: 76029 - DNA, 601 bp, Human
atgtaatgcctggtaccgtctgtgtctcagtttctcgaacttcataagtgacttaagatgtgagaactctcagaacagtgcctagcacatagtggacgctcagaaattgttagcttttatcatcaccaaccacataatccatatttgtgggatattgtgaggtttaactcaaatcatacaaagtgttcatcatatgtgctccacacattttaatccattaaaatgttcactaacagatttttaggccgggcacggtggctcacgcctgtaatcccagcactttgggaggctgaggcaggcrgatcacctgaggtcaggagttcgagaccagcctgaaaccccgtctctactaaaaatacaaaaattagctgggcgtggtggcatacggaggttgaggcaggagaatcgcttgaacttgggaggtggagattacagtgagcccagatcgtgccgctgcactctagcctgggtgacagagagactccgtctccaaaaaaagaaatagatttttagaaaatctttcacttttcaggaagaaagcttatagtctctgtggctctgtgttgaggaaacagcattaatctcactacaggagactgct

SEQ ID NO: 76030 - DNA, 601 bp, Human
agcactacatagtcaacagacctcattaagttgtcaaaaagcattctcaggctgaggacgttaggcaacctggctttagttggcagaggtgcgtggacactgccaaggctcctatttctggttccagtggatgaggtggaggaggattatttgtaataatagcaaacagccaggtgcggtggctcacacctgataatctcaacgctttgggaggtggaggtgggaggatcacgagcccaggagtttgaggccagcctagacaacatggtgagactccatctctatgaaaaaattaaaaatyagctgggtgtggttgcgcgtgcctgtagtcccagctactcaggagactgaggcggaaggaacccttgagcccaggagttcaaggttacagtgagctatgatcgcaccactgtaccccagcctgggcaacagagtgagaccctatttctaaaaagagataataatagcaaacacacattgagttctaaccaggtgccaggcagtatactgagggcttaaatgcagcatcatgtctgtttctcacagcaaccctacaaggtaagtgcttgtgatttctacattgtacagatgagcaagagag

SEQ ID NO: 76031 - DNA, 601 bp, Human; identical to SEQ ID NO: 37392

SEQ ID NO: 76032 - DNA, 601 bp, Human; identical to SEQ ID NO: 37391

SEQ ID NO: 76033 - DNA, 601 bp, Human; identical to SEQ ID NO: 37390

SEQ ID NO: 76034 - DNA, 601 bp, Human; identical to SEQ ID NO: 37389

SEQ ID NO: 76035 - DNA, 601 bp, Human; identical to SEQ ID NO: 37388

SEQ ID NO: 76036 - DNA, 601 bp, Human; identical to SEQ ID NO: 37387

SEQ ID NO: 76037 - DNA, 601 bp, Human; identical to SEQ ID NO: 37386

SEQ ID NO: 76038 - DNA, 601 bp, Human; identical to SEQ ID NO: 37385

SEQ ID NO: 76039 - DNA, 601 bp, Human
ggtggttcctggggggcttttctgaagaggtgagcgtcgacttgcttgattgggagaagcaagtgtcctgccaagaccggggaaggaggcgtcccgggaggagggaacgtgtttggagagcagaaagtcagtttggctggaacgtaacgaggggaccttttaattttgttatttatttactttgtctcccaagcgggagtgcagtggtgcgatcacgactccctgcagcctcgaactcttggactcagtcaatcctcccgcctcagccacctgagtaactgggactacaggcctgcaccascacacttggctaattttttgtagaaacgaggtttcgccatgttgcccaggctggtcttgaagtcctgggttcaagcaatccacctgcctcggcctcccaaagtgctgggattacagacatgagccactgtacccagccaagacccttttaatttagaggtaaaggggcgatgtgacctgtgtactgtttatttatttatttgttggtttattttttgagacagtctgtgtctcccaggctggggtgtagtggtgcaatctctgctcacacaggctcaccgcaacctccgcctcccgggtt

SEQ ID NO: 76040 - DNA, 601 bp, Human
taattttgttatttatttactttgtctcccaagcgggagtgcagtggtgcgatcacgactccctgcagcctcgaactcttggactcagtcaatcctcccgcctcagccacctgagtaactgggactacaggcctgcaccagcacacttggctaattttttgtagaaacgaggtttcgccatgttgcccaggctggtcttgaagtcctgggttcaagcaatccacctgcctcggcctcccaaagtgctgggattacagacatgagccactgtacccagccaagacccttttaatttagaggyaaaggggcgatgtgacctgtgtactgtttatttatttatttgttggtttattttttgagacagtctgtgtctcccaggctggggtgtagtggtgcaatctctgctcacacaggctcaccgcaacctccgcctcccgggttcaagctatgctgcttcagcctcccaagccgctgggatttcaggcgcccaccaccacacctggctaatttttttttttttttggagatagagtcttggtccgtcacccaggctggagtgcagtggcgcgatctcggctcactgcaagctccgcctcccagg

SEQ ID NO: 76041 - DNA, 601 bp, Human
aggtttcgccatgttgcccaggctggtcttgaagtcctgggttcaagcaatccacctgcctcggcctcccaaagtgctgggattacagacatgagccactgtacccagccaagacccttttaatttagaggtaaaggggcgatgtgacctgtgtactgtttatttatttatttgttggtttattttttgagacagtctgtgtctcccaggctggggtgtagtggtgcaatctctgctcacacaggctcaccgcaacctccgcctcccgggttcaagctatgctgcttcagcctcccaagcmgctgggatttcaggcgcccaccaccacacctggctaatttttttttttttttggagatagagtcttggtccgtcacccaggctggagtgcagtggcgcgatctcggctcactgcaagctccgcctcccaggttcacgccattctcctgcctcagcctcctgagtagctgggactacaggcgcctgccaccacgcccagctaattttttttgtatttttagtagagacggtgctagccaggatgatctccatctcctgacctcgtgatccacccgcctcggcctcccaaagtgctgggatt

SEQ ID NO: 76042 - DNA, 601 bp, Human
aggcgtgagtcaccacgcccgtcacacctggctaatttttgtattattagtagagatggggtttcaccatcttggccagggtggtctcgaacttctgacctcaagtgatccgtctgcttcgacctccgaaagtgctgggattacaggcatgagccaccgtgcccggcctgggttttagaaggtcactcaggttgttgaagcaactccttgcctgatccttggcttttctcttgcccagccacactcccccagctctttgtccagcccattgcgatgagggtgataattgtaataatgatartcagggatattcaggccttgggaaggaaggaatgttgtctgccttgtttgctactggatccttggcacaatcagtaaatatttacaggatgaactgacgtccacaagtttttcaaatcctaactcctgcaggagaattttctgacagttccagttcccatccatctccatcctttctgagcccctgaagctcttctttaccccacggtttaatgtagatccacagtcccttttttgcagttctaaaatcctaaatactctgtaaactgaaaggtttgccttaagtttacagcaaagtcat

SEQ ID NO: 76043 - DNA, 601 bp, Human
cacggtttaatgtagatccacagtcccttttttgcagttctaaaatcctaaatactctgtaaactgaaaggtttgccttaagtttacagcaaagtcatttggccagaaaatgacctcaactgaccgactgagagcctttctttttcccacttagcgaatatcattgattctcagctggggtgattgtgctacctctggggacactggacggtgtctggggacatttgtggttgtcacagttggggggcgctcctggtatggaatggatggaggccggggacgctgctcagcaccctgcagkgcccaggacagctccaccccagaaaacgatccggccccaatggccacagtgcagacagagagacaccctggtgcgtattcctgcatctcactgcagaaagagtaatttgatttcggagtgctgcctcagcctccctagtgatttggaatacatggcacttggactctattaatactgttctacaatggggggaaattctgaatgttaaaatgtccccggccccaagactttttggacaggagagcatggtctgtaataacagctacctcttgaaaactttctggtggtattcaggataca

SEQ ID NO: 76044 - DNA, 601 bp, Human
gcgtgagccaccgtacctggccaggcctgcctatttttgtacacccctggaactgaagatgatttttggatgagacagaaaccatatgtggcccacaaagctgaaaatccttggccctttgcagaactgtttgttggccccctgggtcctctgcagaactgtttgctggtcccctgggtcctctgcagaactgtttgctggccccctggaccctctgcagaactgtttgctggccccctgggccctgcacggttaggtgtttccaggtggttttgccaccttctctgtgccgagccgcacygacttcacatagtcgcccttcccgcagctgctctcgctgccaggagcccccgcctgccattcttgttttcaggctccatttacccgtttctcagagaggccctggtgtgagtggccgggccacatatgactcgcccgtagcacctgtgggtctggcacgaccacacgccaggctgactttcttgttgagttcatgaatggaggcctgcttgttccccccactgggtgtggggtgtggaagaagcagacagaagaagggactcctcccgaaaaccccccgatacctcacctttcccctctg

SEQ ID NO: 76045 - DNA, 601 bp, Human
tccactctagggcagggggattttttttttttctctttgagatggagtctcgttctgtcgcccaggctggagtgcagtggcgcgatcttggctcactgcaacctccacctcccgggttcaagcaattctcctgcctcagcctcctgagtagctgggattacaggcatgcgtgccaccacgcccagctaatttttgtatttttggtacagatggggtttcaccatattgttcaggctggtctcaaactcctgacctcgtgatctgcctgtctcggcctcccaaagtgctgggattacaggcrtgagccaccaagcctggccgggcagggggatttttaacagcagtatcatctctattccgggctgatcgttctctgctggggccgtcctggtcactgcagggtactaagcaggatccctggcctccacccactccacgccaggagcatctgcaaccgcgacagccacatgtgtcctagatgtcacccagggttccctggatgggattgatggcagagtagcctcctgctctagaggactggtcagtctgtgcttccctacaagagccctggacctcactcttctggatgagaagcgggtga

SEQ ID NO: 76046 - DNA, 601 bp, Human
tgatcgttctctgctggggccgtcctggtcactgcagggtactaagcaggatccctggcctccacccactccacgccaggagcatctgcaaccgcgacagccacatgtgtcctagatgtcacccagggttccctggatgggattgatggcagagtagcctcctgctctagaggactggtcagtctgtgcttccctacaagagccctggacctcactcttctggatgagaagcgggtgatcccttcctttccctctgccctcctgactttgaccctaactgaaccgaaagcagacccgcccrgcactgggttttgtttctgcgtagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacaggtaagtcccaggcagggtctgtgcgtgggccgcaggtgccgagggaggtggcaccgcaggcgg

SEQ ID NO: 76047 - DNA, 601 bp, Human
tctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacaggtaagtcccaggcagggtctgtgcgtgggccgcaggtgccgagggaggtggcaccgcaggcgggagtagcccagcccgtggagccggttcagaacctggcttgaagtgtcaccagcaccctgcccytgagcacagggcagcgccacctgctcccaggctggtcgtggtggctaaatcagatggctgggcggaagcgtctggcaggtgctggtcactagaggtgtaggagagaggcagttcctcccgtgctccgctctgcttcacagcctcgtccattcaaaggactccctggttgtgtgatctgagagccggagatgagaaaatatgtctaaacagcacgcctctccagcctctcccagagccagcagccttgaaccctgaccccgtctggcctctttccctggcccgggaaggcgggtatttgtt

SEQ ID NO: 76048 - DNA, 601 bp, Human
ccggcgggggtgacctcatgtcctcgggcgtcctcctcaccctcagcccgatcctcctcctctccttggggtccctgtgctcacggtgaggagtgaggtgcctagtgacaggggttagggacactgcttcccgagctctgcctaaggctgacagtgtacctgcctgaccaagagacccagagagtctccgcagagagctctgagtgaggcaactccccacccttccatctagcggaaggcctttttgctgggaaccatcgagaatccttgagttcaagcccagggcttctctcgtgttcccaaggcatcccctgaaagggttggcctccgtggcccatgccatgaggcctccagagggtttgctgtctgggccaggggctggagggagggctgaagctccgcaagcaccccaagcctgcaggtcccgcagcccctgattggaatcctgaccctcttcccactccctctggcttccgacaagtggcttagagcccgtatgacctcggtttcccctccttggccacgtggtggccccttgtccctcccgtaggagtctcatgaggctcaggtgataccagttccctcttatggcgcccagcgg

SEQ ID NO: 76049 - DNA, 601 bp, Human
tccttggggtccctgtgctcacggtgaggagtgaggtgcctagtgacaggggttagggacactgcttcccgagctctgcctaaggctgacagtgtacctgcctgaccaagagacccagagagtctccgcagagagctctgagtgaggcaactccccacccttccatctagcggaaggcctttttgctgggaaccatcgagaatccttgagttcaagcccagggcttctctcgtgttcccaaggcatcccctgaaagggttggcctccgtggcccatgccatgaggcctccagagggtttgytgtctgggccaggggctggagggagggctgaagctccgcaagcaccccaagcctgcaggtcccgcagcccctgattggaatcctgaccctcttcccactccctctggcttccgacaagtggcttagagcccgtatgacctcggtttcccctccttggccacgtggtggccccttgtccctcccgtaggagtctcatgaggctcaggtgataccagttccctcttatggcgcccagcggtgccaggcatcatttcccccgcccgtgccccaccttcccctcctgcggcctttcctctcctc

SEQ ID NO: 76050 - DNA, 601 bp, Human
cacccttccatctagcggaaggcctttttgctgggaaccatcgagaatccttgagttcaagcccagggcttctctcgtgttcccaaggcatcccctgaaagggttggcctccgtggcccatgccatgaggcctccagagggtttgctgtctgggccaggggctggagggagggctgaagctccgcaagcaccccaagcctgcaggtcccgcagcccctgattggaatcctgaccctcttcccactccctctggcttccgacaagtggcttagagcccgtatgacctcggtttcccctcctyggccacgtggtggccccttgtccctcccgtaggagtctcatgaggctcaggtgataccagttccctcttatggcgcccagcggtgccaggcatcatttcccccgcccgtgccccaccttcccctcctgcggcctttcctctcctccttcacatggtggcgagactagcattaaaggaaactgaattcggccccagtgctcccctcggggcctttccgcttccctcagggtgacgcccagcatcctcggtgtggtcttcagcgccctgcaccgtctgtgcctggacacccagtctcctcgt

SEQ ID NO: 76051 - DNA, 601 bp, Human
gccccaccttcccctcctgcggcctttcctctcctccttcacatggtggcgagactagcattaaaggaaactgaattcggccccagtgctcccctcggggcctttccgcttccctcagggtgacgcccagcatcctcggtgtggtcttcagcgccctgcaccgtctgtgcctggacacccagtctcctcgtgcctggcaccctcccccagccagggcctctccagccggcccctcgcgcccctcgccctgtgctctgctgaatgcctggcttctctctgatcacagattaagtccacttcrcccaggagcccttcctcctcctcctgtccccatgccagctgcctggattagtccctgcacggtactgacactgtcgtccctgcggtcacttgtctaatcggtcgcccgtaaatcccgagaggacagagctgattttctttctgtcttcagccctagcgtcaggcctggcccagagcccccactacaggcttttttgttgtttttttgagacagggtcttgctctgtcacccaggctgctgtagtgcagtagtgtgatcatggctcactgcagcctccatctcccaggctcaagccatctt

SEQ ID NO: 76052 - DNA, 601 bp, Human
tcggggcctttccgcttccctcagggtgacgcccagcatcctcggtgtggtcttcagcgccctgcaccgtctgtgcctggacacccagtctcctcgtgcctggcaccctcccccagccagggcctctccagccggcccctcgcgcccctcgccctgtgctctgctgaatgcctggcttctctctgatcacagattaagtccacttcgcccaggagcccttcctcctcctcctgtccccatgccagctgcctggattagtccctgcacggtactgacactgtcgtccctgcggtcacttgtstaatcggtcgcccgtaaatcccgagaggacagagctgattttctttctgtcttcagccctagcgtcaggcctggcccagagcccccactacaggcttttttgttgtttttttgagacagggtcttgctctgtcacccaggctgctgtagtgcagtagtgtgatcatggctcactgcagcctccatctcccaggctcaagccatctttaatttttggtagagatgaggtcttgctatattgcccaggctggtctagaactcctgagctcaagcttcctgcctgccttggcctccaaaagtg

SEQ ID NO: 76053 - DNA, 601 bp, Human
cccttcctcctcctcctgtccccatgccagctgcctggattagtccctgcacggtactgacactgtcgtccctgcggtcacttgtctaatcggtcgcccgtaaatcccgagaggacagagctgattttctttctgtcttcagccctagcgtcaggcctggcccagagcccccactacaggcttttttgttgtttttttgagacagggtcttgctctgtcacccaggctgctgtagtgcagtagtgtgatcatggctcactgcagcctccatctcccaggctcaagccatctttaatttttrgtagagatgaggtcttgctatattgcccaggctggtctagaactcctgagctcaagcttcctgcctgccttggcctccaaaagtgtggggattacaggcatgagccaccgtgcccagcccaccccccctctaaacacacggagcctcctccagacgtgcggagcctcctccaaacataccgaggcctggggacatttctgttgacccagaactgaggtagtgaccagactgcaatttgaattcaggtctttctgctgcaaagtatatgctttttttaaaaaaaaattattattattaggg

SEQ ID NO: 76054 - DNA, 601 bp, Human
ggctgggtggcggctcacacctgtcatcccagcactttgggaggccgaggtgggcggatgacttgaggtcaggagttcgagaccagcctgaccaacatccagaaaccctgtctctactaaaaatacaaaattatccgggcgtggtggcgcatgcctgtaatttcaactactcgggagactgaggcaggagaatcacttgaacccgggaggcggaggtggcggtgagccgagatcacaccattgcactccagcctgggcaacagcagcgaaactctgtctcaaacaaacaaacaaaaaaaamcccacacacttcagtggtttttaataaatttgcagcattgctcagctgttaccattctttcattttagagcattttcataaccccagagagaaactttatacccttaagtggtcacgctccatctcccctgtccccagccctggcacccacgcgtcccctcctgtctctgtggatgggcctgtcctggatatttcgtagaaatggcaccacatggccgggtgcagtggctcatgcctgtaatccctgcacattgggaggccgaggcagatggatcatgaggtcaggagttcaagaccagc

SEQ ID NO: 76055 - DNA, 601 bp, Human
tcaagctattcccctacctcagcctcccaagtagttggaattacaggcacgcgccaccacgcctggctaatttttgtatttttagtagagatggggtttcaccttgttggccaggctggtctcggactcctgacctcaagtgatctgcctgcctcggcctcccaaagggctgggattacaggcttggccaccacacctggcctaaagcttatgcttttctagccactgacacttcctctactcaacctaaagcacagatgtgctcaggaaattgtaagtagtttatgcatttaaatgtgaycatcggcagctgcagctctctctggaatggaattccgtcagcctctgtttcgtcgtacccagctctgttgggtcctccttggcttggagggctttgagttgaatccttatttttcttcggtctgtaagatctccaaggacacaggcaacagcacctcctttctccatcccagggcccagcctggaggggacggtggcgtgtgcctctagtcccagctacttgggaggctgaggcaggagagagttcacggggggattcagcagacaggcctgggagaggggtccgggcaacacctgccag

SEQ ID NO: 76056 - DNA, 601 bp, Human
ccaaagtgctgggatcacaggcctgagccaccacgcccggccacacatgtgcactttcatttcctttcctggccatcctagtgtgacccaaacaccccatccccacatggcgtgagctggcagggcctggcggcatggctgcgtgggctcctgctcccccggatgctcctcgcagtatgcagtggggcctttgctgttgatgtcacatgatcaggagagacccagagaccctcctgctgctgttcatcctcttaggcgaggacccctgggaatgtgctgatgtgtcccacagtctcaggawcatgcagccctagtgctttggtaaatccagatcagggtgacccatgatagccgtggattgttatttctttttatttaaatacagacagggtctcacaacgttgcccacgcttgtctcgaactcctgggcccacgcaatcctcccacctccactttccagagtttctgttgagacaatgagaggttcccatgcaggtgcaggaaagaatcgaatgcctttgccaactttgcccaggtccccagtgatgacgttttgcaaaactatggtgtcatctacaccccgataccgacctggagacca

SEQ ID NO: 76057 - DNA, 601 bp, Human
gaatcgaatgcctttgccaactttgcccaggtccccagtgatgacgttttgcaaaactatggtgtcatctacaccccgataccgacctggagaccaccagcaatctaattcccattcagccatcgcactggtgaaggagctctggactgatgtcagtgtggggctcttccaaacaaagcgaacgtttgcacaggttttatgtagagacaggtcgtcatttctctgagataaatgcccaggagtgcagttgccaagtcacacgggggccggatgatcaggtttttaagaaactgccaaactrctctttggagcggctgcactggcccacgtcctacatgctttgatgtttttattccaggagaaagttcagaaggactcactgaggcccgaggctgcgcggtacctggagcggctaatcaagctgggccggagaaatgggcttcacctccccagagagactcaggaagtgagtgctgggtgtagggagtgctgggcgtgggcaatggtcgatcccggggagtgctgggcacagggagtgctcagtcccagggagtggtgggagcaagaagcgcagggcagggggagtgctgggctcggggag

SEQ ID NO: 76058 - DNA, 601 bp, Human
aaactactctttggagcggctgcactggcccacgtcctacatgctttgatgtttttattccaggagaaagttcagaaggactcactgaggcccgaggctgcgcggtacctggagcggctaatcaagctgggccggagaaatgggcttcacctccccagagagactcaggaagtgagtgctgggtgtagggagtgctgggcgtgggcaatggtcgatcccggggagtgctgggcacagggagtgctcagtcccagggagtggtgggagcaagaagcgcagggcagggggagtgctgggctcrgggagtgctcggctcagggagtgcttggggcatcaggagtgctgggttcagggagtgctgcgtcccggggagtgctggactcagggagtgcttgggcacagggagtgctgggtgccgggagtgctgggtgtgaggagtgctcggtcccagggagcactgggcatggggagtactgagctcagggagtgcttgggcttggggagtgctgggtggggggagtgctcggtcccagggagtactgggtgtggggagtgctcagtctggggagtactcggcatggggagtactgggcacggggag

SEQ ID NO: 76059 - DNA, 601 bp, Human
catgctttgatgtttttattccaggagaaagttcagaaggactcactgaggcccgaggctgcgcggtacctggagcggctaatcaagctgggccggagaaatgggcttcacctccccagagagactcaggaagtgagtgctgggtgtagggagtgctgggcgtgggcaatggtcgatcccggggagtgctgggcacagggagtgctcagtcccagggagtggtgggagcaagaagcgcagggcagggggagtgctgggctcggggagtgctcggctcagggagtgcttggggcatcaggartgctgggttcagggagtgctgcgtcccggggagtgctggactcagggagtgcttgggcacagggagtgctgggtgccgggagtgctgggtgtgaggagtgctcggtcccagggagcactgggcatggggagtactgagctcagggagtgcttgggcttggggagtgctgggtggggggagtgctcggtcccagggagtactgggtgtggggagtgctcagtctggggagtactcggcatggggagtactgggcacggggagtgctcagtcctggggagtgctcagttgcggggagtgctg

SEQ ID NO: 76060 - DNA, 601 bp, Human
gggcatcaggagtgctgggttcagggagtgctgcgtcccggggagtgctggactcagggagtgcttgggcacagggagtgctgggtgccgggagtgctgggtgtgaggagtgctcggtcccagggagcactgggcatggggagtactgagctcagggagtgcttgggcttggggagtgctgggtggggggagtgctcggtcccagggagtactgggtgtggggagtgctcagtctggggagtactcggcatggggagtactgggcacggggagtgctcagtcctggggagtgctcagttgyggggagtgctgggctcagggagtactgggtgcggggagtgctgggcgtggccagtggagcttctgtggccccctgcccctgcctcctcgggagcgtccccccttcagggctgacccccggcctgatgtccatctttcttctgcctgaggacctgaactctggcaaggcaggtccacacagacatggggcgcagaggctcggtaacgaggggagcccctccacccactgcccggtgtgcctgatgtgggcgtctcaggggtgacatgagttagttggtgcagagctgggagcgcagcgctg

SEQ ID NO: 76061 - DNA, 601 bp, Human
tagaagccacaaactctcccacaagggccagcaagcaaggagggagcagaggcagccccgcctggaggacagaagcgcggaaaaggtgcgaggtccggatgctggcgagcagagttccagcgcgtccccgcggcccttagggccagcgctgtgtgctcattgagtctccagagccttccctggcatggctgggtttgttatgtgagatggcaagagggggagacattgggaattgcccagcatggggcctgttcccaggagaggcccagcaaaccctcagctggttctgaaccagggcctkcctgacaagatacaggctccctgcaaagtcctgggcacagtttccccctgctgccgccctctgtcctgcggatgagcatttctgctctggccccatggagctgggctccagacccgcctggcggagcttccagcaggagaatctgagtcaaagtacagccctgctgccagcctgtcatgtgtcatgtggcctcaagccaggtccttgtcacatagtggtcacctcccagccttcaaggccaccagagggaccactcaagattcagttcctttgttgatatcccatatcaccagggtcgag

SEQ ID NO: 76062 - DNA, 601 bp, Human
tcaaggccaccagagggaccactcaagattcagttcctttgttgatatcccatatcaccagggtcgagttttagctgtttctaaaaccagctttaccagataaggggtaaaatgttcaaaagctgccagacacggtgactcatgcctgtaatcccagcactttgggaggctgaggtgggaggattgcttgagcccaggagttcgaaaccagcctgagcaacatggtgaaaccccgtctgtaccaaacatacaaaaattagctgggtgtagtggcgtgtacctgtagtcctagctactcagraggctaaggcaggaggatcaattgagttgggaggttgaggctgcagtgagtcgagatcatgccactgcattccagcctgggcaacagagcgagtccctgtctcagaagaatgttgaaaagcttaggctgcaggctctgaaggtgattccttaatggataggagggtctggagcactcttggccagggccacacctgacagaccggagcacatccctgaggttgcccgaggtcacccagctttggatgccgcagctggtgttgaaatccacactgcgcagcctcgtggcctccgtgtctgt

SEQ ID NO: 76063 - DNA, 601 bp, Human
ctgaagggcggcgggaggccgaagtacgtggacctgaccgccctgggctgaggactttcctcaccggaagcgctccagggccgtttacagccaaaagctctgagccctccttggggagggccatggtctgtcccaccaagattccaccctgatagaaaatgtccctggcagtggcggaagcccaggccggacggggtggccaagggtgccagtctcagccatggccctgagggaaccacaattttcccttgagaccccacttcctgcctgcctttatttatttaatttaattaattaattwatttattttgagatggagtcttgctctgttgcccaggctggagtgcagtggtgcgacctccactcactgcaacctccgtcccccgggttcaagtgattctcctgtctcagcctcctgagtagctgggactacagacgtatgccatcacacctggcaaatttttttatttttagtagagacggtttcgccgtgttggccagggtggtctcagactcctgggctcaggatctgcctgcctcaacctcccaaagttctgggattacaggcatgagccaccgtgcccaggcaggccggaatatt

SEQ ID NO: 76064 - DNA, 601 bp, Human
ttcagctgcctgtttcttttcacgtttgccatcctgcaaactcgaatgtttgtggattttggtgtctaactctttggggtgccgttccatttgtcgggcctgaggggtctcccgtgcaggtggcttgagtcccatgtggccaggtgacaccgtcatgcgggtggctagcgtgttgggtgacagtctccagggctgtccgctgctgctgccccgggacctgtttccctttgtggtccgtcatttctcaggagacgccttgcgatggtcttagttccttttcttctgcttacaacagaaaacytaaggccatgtagtttataagaaaaggaattaacttgtcacagctctggaggctgagaagtcccaggtcgaggggccatatctggccagggccttcttcctggtggggactctggagccctgaggcggccagggtgtcacatggcaaggggagggggctaagcgagccggttccacccaggtctctcctcctcacaaagccccaggccctctgccacattaacccatctgtcccttcatccatgaatccatgaatggattcatccattcctgaaggcagaggccacatgacccagctgcc

SEQ ID NO: 76065 - DNA, 601 bp, Human
acaatccctgtgtccttgtaatgcacctgctgtcctctgaacctgctcttactgtggggcacatggtaccgcaggctcggcctctgagcccgcgcttactgtggggcgcgcggtaccgcaggctcggcctctgagcccactcttactgttggacatgtgatgtcgcaggctcgtcccatgctctccctgccccagccctcagatgctccatttcttggaggagacctggcgcctttgagtggagggtgacttaggcaccggatgtgttcaccactgccagggagcagcattcctgggcacygttaacagttaggaagcagacacgcatctctgcaccacacatggacacacacactcttctattctgtgtctgtatatcaaatccacaagtgcagcggggcatgccggcacacacctgaggtcccagccactcgggaggctgaggcagggggattgcttgagtctgggagttcagggccacagtgaacgtgaactatgcattcgtgaactatccattgcagcctgggcaacagagcaagaccctttttctaaaaaaataaaaacttccaggagtccactttgcagcttctcttccagtcca

SEQ ID NO: 76066 - DNA, 601 bp, Human
ggggcatgccggcacacacctgaggtcccagccactcgggaggctgaggcagggggattgcttgagtctgggagttcagggccacagtgaacgtgaactatgcattcgtgaactatccattgcagcctgggcaacagagcaagaccctttttctaaaaaaataaaaacttccaggagtccactttgcagcttctcttccagtccagcgctgctgggccccccagctgtctcccttgctgtcctttaactcccgtctccgaccgccagccgtcactcctgggtgacacactgtcgagatggrgagctgctgtttgaaggcccgtggtccttggaaaggacgatgtgcaggtcccgggaggcctccccctcatgctgcagtcactcggcagacaattgccaggcccacgctggtgctggggtacaaacgggaaggcgggggctctgccggccacaggactctcagctccctcatcaccacccacacccacgggctggcctcccaaaatttcccccatctgcctctggccccccaaccggatcattctttccacccttgcctccctggggtccccgtgagctcccgatcattctttccacccct

SEQ ID NO: 76067 - DNA, 601 bp, Human
gagggcgcacacgggtgggctgagttccaggtcccgggggatgtgccgcctcagagaccttgctgctggcggtcggcctggcccctatttggctggctgctctgcacgcacctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcrgagcccgtgagactgggaaccaaggcctggacatggaggtgtccccacatgcagcagtgatgccctcggaggctcctcggacagcccctggtccccataccacgttccgtgtgaggccttagagtcatctgcaccccttctggttccaaaaaggccttgggattatgataacgctggtggcatgaccagaggagttgtgtagtaacacaggccgagaggggcagggaccggaggtcagacggagctggatatgagcctttggccctgggacagggcgtgctggccctggaggtggaggga

SEQ ID NO: 76068 - DNA, 601 bp, Human
acctgctggttacagctgggtttcctgtggacccagctggtgggcacatctgtcctgaacaggcctctgtttctcctcgtaaacgcctcacgtggctttcatgcgtcctcccccacccccactggcttggttggcagtgccagtcctcagaagtgaggctgtgtgcatgtcatttgctggtggcgataggcggagcccgtgagactgggaaccaaggcctggacatggaggtgtccccacatgcagcagtgatgccctcggaggctcctcggacagcccctggtccccataccacgttccgtgtgaggccttagagtcatctgcaccccttctggttccaaaaaggccttgggattatgataacgctggtggcatgaccagaggagttgtgtagtaacacaggccgagaggggcagggaccggaggtcagacggagctggatatgagcctttggccctgggacagggcgtgctggccctggaggtggagggagtggcgcccctgggtgacagtgtggtggtgtcggttgcaggagaactgcgctatcctcaaggagctggtgacgctgcgggcccagaagtcccgcctgctggggttccac

SEQ ID NO: 76069 - DNA, 601 bp, Human
ggggtccctgtggggaaggttctcagggtcaccccaggggacagtcggtgctacccctagagccttgtcctttccctccatgaagagggacttctgacgcctgccctggctccctcactccccccgagggacccttacagaacagggaagcgcccgggccctggggtcagtcccatgcttgcacccggccccgccgccccctcaccctgagcgtgaggatgctcggcccctcgaggggttgccgggaactgcgggtcctcccttccaaatggggagcctgacgaagtcgcggccgcgggcrggcgagcccagagccatggaggagcccgcgaggcgagaggcccacctttctgccctccccgcagatgagctggcgcagaagctgaagcccctgggggagcaggagcgtgcggtgattctggagctgaagcgtgcggagtgcgagcgccggggcctgcccttcgacggccgcatccgtgcctgggacatgcgctactacatgaaccaggtggaggagacgcgctactgcgtggaccagaacctgctcaaggagtacttccccgtgcaggtggtcacgcacgggctgctgggcatctaccag

SEQ ID NO: 76070 - DNA, 601 bp, Human
acaaaatcaccaagagcagaaagatgcaaacaccgtgcccccactagactgagaaaaggacgcttgctcataaaatgagccgaagtgagaagacagagtgcggcccttctgaggaccgtctgctcaggggcgccgcagtgctggcctctggggtttttgtggatcttagtaggcgagtttgaaaacacggagtccaggaatgaggatcgaccgtgtgtccacctttcctggcttccctgccacactgtttgcacagcactcgtagccagcacacgcgtgtgcacatccacacaggtgctcrcacaggtgcccacgcacgtgcctgcaggcctgctttgcatgctgctttctgcgtgtccctggcgcctggcacggcgagtcccttggtgcattccgtcgggacaaggagtgtggctgcgtggtccttggaacagaaaagcctcggtgttgcagagaggaccttgaggatcacccaggagttccctcgccgttggctgcctgccatggttccagcgggactcagtcaagggctgtgcttttagggaaggttccacacacacacgagcagggagatgcagcatgcctcacagcgtccccaccc

SEQ ID NO: 76071 - DNA, 601 bp, Human
agcatgcctcacagcgtccccacccggacctggccgtccccaggtcccaacccctcggggtgcggagctttcagggagcagcagctctgtggctagaggagaagcgtgggtggcctccagggacggggtcatgtggccggcatcttcaggtgtgtcctgctgccaccggcagccagcagcagcccaggggcctccgggtcccggtcgttttccagttttggggtgggagggccgggcccagcgcatcacctgtgcactcgccctgtttgcactgtggcagctgacacgggccaggccggcrggaacgggctaggcaggacctgggcactctgaggctctgccccatccctgcaggcggagttcgccatgttcagcgggacccacgtggagcgggactttgtggaggcgccgtcgcagatgctggagaactgggtgtgggagcaggagccgctgctgcggatgtcgcggcactaccgcacaggcagcgccgtgccccgggagctcctggagaagctcattgagtcccggcaggccaacacaggtgcacccgccccgtccggggaagggtgctaacctcggggggcggcacacagctggggcc

SEQ ID NO: 76072 - DNA, 601 bp, Human
tccctggagcctctgctttgaatgaagctggcgttttcctgattgaaatgtatgacacatgctttgtaaaaagcctggagaagtacaggaaggcctaggaatttccgatcctaatgatgagaagtgggccctgtttccatgctcacctgttgtcctgtgtgcatgtgtgttcacacacgcttgcgaggatccagaatttggaaatacagcatgattttaacatgggtggtgttttgctggcttaacactccatagacttcaaaaatctttccaaaagcgttttcagcagcgtggcctgtgmtgttgcgtgggcgtgccttgctttattgacgcagtctcaaaatggggactttgctctgtggcagctgacagccccgttaaatgagctcctgtccttccaggagagggggcggagacttgtggccctcgctttgtggctgactctggttctagaagtatccagctggtctcggccctcaccgtgatcctccagcttctccctgttccgggcaggggtctcaggagtctggctggttgtcttctcctggaggaggagcatggggtgggggctacagcgtgaaccctgccatgtgtccgcccc

SEQ ID NO: 76073 - DNA, 601 bp, Human
tctccctgttccgggcaggggtctcaggagtctggctggttgtcttctcctggaggaggagcatggggtgggggctacagcgtgaaccctgccatgtgtccgccccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggtacgcggggactggggacagggagggcgtcctgaacggcaaggtacgcggggacyggggacagggagggcgtcctgaatggcaaggtacgcggggaccggggacagggagggcgtcctgaatggcaaggtacgcggggaccggggacagggagggcgtcctgaatggcaaggtacgcggggaccggggacagggagggcgtcctgaacggcaaggtacgcggggactggggacagggagggcgtcctgaatggcaaggtacgcggggactggggacagggagggcgtcctgaacggcaaggtacgcgggggaccggggacagggagggcgtcctgaatggcaaggtacgcgggga

SEQ ID NO: 76074 - DNA, 601 bp, Human
cttctcctggaggaggagcatggggtgggggctacagcgtgaaccctgccatgtgtccgccccaggaaccaacatgcctgcaaccttcggccatctggcaggtggctacgacgcccagtactacgggtacctgtggagcgaggtgtattccatggacatgttccacacgcgcttcaagcaggagggtgtcctgaacagcaaggtacgcggggactggggacagggagggcgtcctgaacggcaaggtacgcggggaccggggacagggagggcgtcctgaatggcaaggtacgcggggacyggggacagggagggcgtcctgaatggcaaggtacgcggggaccggggacagggagggcgtcctgaatggcaaggtacgcggggaccggggacagggagggcgtcctgaacggcaaggtacgcggggactggggacagggagggcgtcctgaatggcaaggtacgcggggactggggacagggagggcgtcctgaacggcaaggtacgcgggggaccggggacagggagggcgtcctgaatggcaaggtacgcggggaccggggacagggagggtgttctcaacagcagggtggggccgag

SEQ ID NO: 76075 - DNA, 601 bp, Human
aacggcaaggtacgcggggactggggacagggagggtgtcctcaacagcagggtggggccgagaaaagcacacctttggcctgggcctgggtgtgccgggtgagccatcccggccgaggcacctgctggtcttggtgcggtgctgcccacagctcctccctgggccctgcaggaagctccacactggcccctcaggcctcgggctgtgagtgctgggagctccgtgtcttcccatacgagtccttccgggatctgcgtgatcggcctcagagccatgggctgagacagacccttctctggrgaaggcttggcgtttgccattcatttgctcctccaacctccagtttcctcactatgaagtgcggccgttacgccatgtgagcctgtgcctcccgctgacttggtgtgacccaggctcgggacagccgccagagtccctcacaaggaacaggtggctaccagctttgagggccggccctgccctgcctgggtgcaacattgcactgggcagcctgcaggtacctcggagccaccaagcaggcactcagctgctccctttatagaggtgcagaggccaggacctgggggagcaatggtccga

SEQ ID NO: 76076 - DNA, 601 bp, Human
tctcatctgcctcacctgcccgtagtcccgcagtcacagggctgggctcaaacctgggcctttagggcggcccagagcgcgagcggcttccacattgtccagccggaggctcagccacttctgttcatgggctcagcctgggatttcagtgggggctgatggcgggagccacctcgggagtttggggagttcggggctctgctggcccctcagtgcacacccccgctctgagattctgatgaaaggcacctgcgctctcccacctgtgctgatgcaggcggcccccgggcctccctgggarcctggaaggggttgctccgaggcccccctgggcgagggtgtgcagactcctggggtcctctgccttcctccctgggtccccacccggccacagtgccctgtctcctcggcaggttggcatggattacagaagctgcatcctgagacccggcggttccgaggatgccagcgccatgctgaggcgcttcctgggccgtgaccccaagcaggacgccttcctcctgagcaaggggctgcaggtcgggggctgcgagcccgagccgcaggtctgctgaggcctggcactgcgactgcccagtct

SEQ ID NO: 76077 - DNA, 601 bp, Human
tagtcatatatattgcagtccagttatttaaaagctcaagagttttaacttgcatattaatagttaatcctgaaaatcgcaatattccaaatacgcccttgaagatatctttaccaaaagaagtgagtagtatttttgcacttaaaagatctcacggggtgcggtggctcacacctgtaatcccaacaatttgggaggccgaggtgggcggatcacctgaagtcgggagtttgagaccagcctggccaacatggcgaaaccccgtcttcactaaaaatacaaaaacaaaaaaaaattggcyaagtgtggtggcgcattgctgtagtcccacctactcgggaggcggaagttgcctgaccaacatggtgaaactccgtctcaactaaaaataaaaaaattaggtgtggcgcacacctgtaatcccagctactcaggaggctgaggcaggagaatcaattgaacccgggaggcagaggttgcagtgagccgagatcgcgctgctgtactccagcctggcgacagagtgagactccgtctcaaaaaaaaaaaaaaaaaatctcaaaactgaattgctgtctgcatcatatcctaaccctcaaca

SEQ ID NO: 76078 - DNA, 601 bp, Human
caacatggcgaaaccccgtcttcactaaaaatacaaaaacaaaaaaaaattggccaagtgtggtggcgcattgctgtagtcccacctactcgggaggcggaagttgcctgaccaacatggtgaaactccgtctcaactaaaaataaaaaaattaggtgtggcgcacacctgtaatcccagctactcaggaggctgaggcaggagaatcaattgaacccgggaggcagaggttgcagtgagccgagatcgcgctgctgtactccagcctggcgacagagtgagactccgtctcaaaaaaaaraaaaaaaaatctcaaaactgaattgctgtctgcatcatatcctaaccctcaacaaattttattctctttccttctagtctttaccagcttgacagttgtgtattttacttcctctttaacatatcagaagtattagaattttatttagaataattagaaaaagaatttaatttcattaccctttatttcaaatgacagaagttgcacatcttagaaaaaactttgaaagagagactttgggtagagatctttctctttcagttctttctaaaagacaagcttttttcctcagtatttttt

SEQ ID NO: 76079 - DNA, 601 bp, Human
cctgaatgttaacccaatgccatattgtcatggaataactggttaaagtgcagtaatttattactcaacctattacttttttgcatatgctatactaggctttttaaaaatgccatttgattgcttccaattttagtgttttgattgtatttaaaaatatcttttttttttttttttttttttgagacaagctcttgctctgccgcccagtcagtggcttactgcagcctcgacctcctgggttcagcctcccaagtagctgggactgcaggcacacaccactatgctgggctaatttttwaaatttttgtagatatgggggtctagctgtattgacgaagctggtcttgaacttctgggctcaagtgatcctcctgcttcagcttcccaaagtgctaggattacaggtgtgagccactgtgttctgctactttttttaaaattatgaaatatttcttgcatccagaaaataatagaggatagcacgtagtttttcacatatttttaatggttaggaatttaaatatttaaggaatggtgtcaaaacactgtttatcattatggtgttaattgtgaaattttataaaatgaacttggttta

SEQ ID NO: 76080 - DNA, 601 bp, Human
tcagcttcccaaagtgctaggattacaggtgtgagccactgtgttctgctactttttttaaaattatgaaatatttcttgcatccagaaaataatagaggatagcacgtagtttttcacatatttttaatggttaggaatttaaatatttaaggaatggtgtcaaaacactgtttatcattatggtgttaattgtgaaattttataaaatgaacttggtttataccattttaattggtggcaattttagttctatcaaaattttatttaactttgggatttgattttttttttttttttttgaggcagaatctcactctgtcgcccaggctggagtgcagtggcaagatctcggctcactgcaacttctgcctcctgggttcaagcgattctgctgcctcagcctcccgcatagctgggactacaagtgcatgccaccacgtctggcaaatttgttctgtttttgtagagatggggtttcaccgtgttagtcaggatggtctcgatctcctgaccttgtgatcctcctgcttcggcctcccaaactgctgggattacacgcgtgagccaccgcgcctggcgatttgatcttttaatgtcag

SEQ ID NO: 76081 - DNA, 601 bp, Human
ctttcagtcactgcctgacctgtaataccataatgtaccttacatggtttttgcttactatgtgagtggagttatacgtacgttttgtgtattccttttgtgtctggcctctttcactcaacattatgtgtatgagattcattcttgtgtgtagttgtatctcctctaattctattgctgtttggtgttcccatttgtatgaatatatactaaattgcatatatccattctcttgttgattgatacttggattgtttctatttggggctattatgaataacacttgtgaacattttttttytggagacaaattcttgctctgttgcccgggctagagcgcagtggtgcgatcttggctcactgcaacctctgccttctgggtccaggtgattctcctgcctcagcctcccgagtagctgggactgcaggcatgcaccaccatgcccgactaatttttgtattaaagacggggcttcaccatgttggccaggcttgtcccgaactgctgacctcaagtgatctgcctgccttggtctctgaaagtgctgggattacaagtgtgagccagcgcgcccagccagatatgttttttaaagatcat

SEQ ID NO: 76082 - DNA, 601 bp, Human
tattgctgtttggtgttcccatttgtatgaatatatactaaattgcatatatccattctcttgttgattgatacttggattgtttctatttggggctattatgaataacacttgtgaacattttttttctggagacaaattcttgctctgttgcccgggctagagcgcagtggtgcgatcttggctcactgcaacctctgccttctgggtccaggtgattctcctgcctcagcctcccgagtagctgggactgcaggcatgcaccaccatgcccgactaatttttgtattaaagacggggyttcaccatgttggccaggcttgtcccgaactgctgacctcaagtgatctgcctgccttggtctctgaaagtgctgggattacaagtgtgagccagcgcgcccagccagatatgttttttaaagatcattcagagccaggtgcagtggctcacgcccataatcccaacactttgggaggccgaggcaggaggattgcttgagcccaggagtttgagaccagcctgggcaacagagtgagaccctgtctctacaaaaatttttttaaaaaagatcattctgggccgggcgcggtggctcatg

SEQ ID NO: 76083 - DNA, 601 bp, Human
agcttgtagtgagccaagattgcaccactgcccttcagcctgggcaacagagcaagactctgtctcaaaaaaaaaatcattctggttgttatgtaggacagaatatgaagggatgtaggatgacatgataggagactgttctctgtgtaaacttaaaaagattagaagactaaatttcattgtggctaaaataatccataactatatccagtatcaaaattgctaatggattctgtattattaccaactgatgtgttttggcattgataagcaattgattttgtcccttatatttgtcatmttcaggatttatagaacaaggcttgtagattttctttggaaaaattcacagaaattttattttccttcattatagccagttttactacaagggctttcacagtgtaacatatcctgttcagaccaaatatagcagtagattttacagtaagtagtgcattatagtagtacatttggatttgtgtgagtactttgaattgtgtaaattctgctataataaaagaacctcataaataaaagtataaataaaggtaatttttcaagcctagctgttaagaattaacttcttagatttctgaca

SEQ ID NO: 76084 - DNA, 601 bp, Human
agtataaataaaggtaatttttcaagcctagctgttaagaattaacttcttagatttctgacatatgttaatatttgattatagtggttttgtatggaaatgattgaaattatagcatgctgaaatttgtttagggttttttttttggtctttttggtggttaaaaacacataacatgaaatctaccctcttaacattgtacttaagttgttcagttttgatgtagtttttttttttttttctttctttcttttttgagacggagttttgctcttgttgcctaggctggagtgcaatggcrcgatcttggctcactgcaacttctgcctcctggattcaagtgattcccctgtctcagcctcccgagtagctggtatcacaggcgcatgccaccacgcccggctaatttttgtgtttttagtagagacagggtttcatcatattggtcaggctggtcttgaactcctgacctcaggtgatccgcccacctcagcctcccaaagtgctgggtttacaggcgtgagacaccatgcccggcctttgatgtagcatttgatatatgtttttatcatttccttatgaactcacagatttgcagtct

SEQ ID NO: 76085 - DNA, 601 bp, Human
gcaacccacccacgtaggcctacaaaagtgctgggattacaggtttgagccaccacacctgactgattattcttatattttagggagtatgatcaatacttattagtggtcagtgatagtggagaatggtaatatcatagacaaaagcaaaccacaaaacatttgaaataatttaaaaatagaaaatactaggatttttctcccctgcttgttcagttaatatattcatgtggtagacagttttggaaatatatataatctcttcatatagaaataattcactgttaaaatttggatgtgyttcctctaatctccgcattaattgatatttatgtatatgtaatatattcagcatactttttcctctattgtttgatatttaagcagtttctgtttttcagatggctttcttcatatctttggtaatatggacatcggtatacgtaaatttttctctaaatttctgtaggacgagattatttccttagaatagattgctgaaagtgagctgctaggccaaaattcgtgaaatatctgaaggatcttaatacacattaatctggaaaatgtatttgcattaaattacatgtccacctgtggg

SEQ ID NO: 76086 - DNA, 601 bp, Human
tgttgattatataataggctttcactaaatatttatttggtttatttactgtttttaagtcttgtagagaatatcttcagtctagtttaaagtaatcttatgtcacctggaccagttgaagttcatggctgatgtttatgggataaaggaaaaggggggtgtttaaagtaaaagtaaagctactccagtgtgttctttaaaaagaatagttggtgttcaaattacattttgatcctgggtgtggtggctcatgcctgtaatcccagctctttgggaggctgaggagggaggattgtttgakcccaagagttcaagaccagattgggcaatgtagcaagatcctgtctctaacactaagtaaataatttttttaaaaattacattttggaattgctggaaaccatacgtagacctgatcaactatggatagcattttttaaaatgataagatctcttataggtaagtattttcagttcaaaagttactatatcttgaatctgattgtttattggtttgagatttttttcatttttaatgtttttattgaaaaaacacgtgtagaaaaccatatacaacaaaaataaattattataaggcata

SEQ ID NO: 76087 - DNA, 601 bp, Human
gcaatatctgttgaagaacacttggtcatttgaattgtagagttctctgtgtttgtgtattcctggtacagttattgcctatcagttggcagctaggtccagaggcttgaatcaaactcaagtttgattcttctggcaagaatataggtggtggtgtgtttttccattgcaggtgcaaaatgtctggttttctttctctgtcatttttcttttcttttctttttttttttttgagacagagtcttgctctgtcccccaggctggagtgcagtggcgtgatcttggctcctgcaacttcccrcttcctgggtccaagtgattctcctgcctcagcctcctgagtagctgggattacaggcacgcgccacgacatccggctaattttcgtatttttatttttaacagagacgggatttcaccatgttgggtcaggctggtctcgaacttctgacctcgtgatccgcccagctcagcctcccaaagtgctggattacaggcgtgagctaccatggctggccttttttcttttttgcaactgttgatactcagtacctagattgatttaactcattgggagttgcagaatggtgatactttaaat

SEQ ID NO: 76088 - DNA, 601 bp, Human
ctggtacagttattgcctatcagttggcagctaggtccagaggcttgaatcaaactcaagtttgattcttctggcaagaatataggtggtggtgtgtttttccattgcaggtgcaaaatgtctggttttctttctctgtcatttttcttttcttttctttttttttttttgagacagagtcttgctctgtcccccaggctggagtgcagtggcgtgatcttggctcctgcaacttcccgcttcctgggtccaagtgattctcctgcctcagcctcctgagtagctgggattacaggcacgygccacgacatccggctaattttcgtatttttatttttaacagagacgggatttcaccatgttgggtcaggctggtctcgaacttctgacctcgtgatccgcccagctcagcctcccaaagtgctggattacaggcgtgagctaccatggctggccttttttcttttttgcaactgttgatactcagtacctagattgatttaactcattgggagttgcagaatggtgatactttaaattctgttattttgtttttacttatgaaatggaatacatttacaaagagacgttatctatatct

SEQ ID NO: 76089 - DNA, 601 bp, Human
tgggtccaagtgattctcctgcctcagcctcctgagtagctgggattacaggcacgcgccacgacatccggctaattttcgtatttttatttttaacagagacgggatttcaccatgttgggtcaggctggtctcgaacttctgacctcgtgatccgcccagctcagcctcccaaagtgctggattacaggcgtgagctaccatggctggccttttttcttttttgcaactgttgatactcagtacctagattgatttaactcattgggagttgcagaatggtgatactttaaattctgtyattttgtttttacttatgaaatggaatacatttacaaagagacgttatctatatcttgtgacctagtggtacagctcatatagaaaaaagaatgcttgacctttttccttttttggcctgttttgttatttatttatttatttatttattttgagatggagtctcgctctgttgcccaggctggagtgcgatggcgtgatctcggctcactgcagcctccacctcccggattcaagtgattctcctgcctcagcctcccgagtagctgggattacaggcacgtgccaccatgcccagcta

SEQ ID NO: 76090 - DNA, 601 bp, Human
cgggatttcaccatgttgggtcaggctggtctcgaacttctgacctcgtgatccgcccagctcagcctcccaaagtgctggattacaggcgtgagctaccatggctggccttttttcttttttgcaactgttgatactcagtacctagattgatttaactcattgggagttgcagaatggtgatactttaaattctgttattttgtttttacttatgaaatggaatacatttacaaagagacgttatctatatcttgtgacctagtggtacagctcatatagaaaaaagaatgcttgaccyttttccttttttggcctgttttgttatttatttatttatttatttattttgagatggagtctcgctctgttgcccaggctggagtgcgatggcgtgatctcggctcactgcagcctccacctcccggattcaagtgattctcctgcctcagcctcccgagtagctgggattacaggcacgtgccaccatgcccagctaatttttgtatttttagtagagatggcgtttcaccatgttggtcaggctggtctcgaactcctaaccttgtgatccgcccgcctcagcctcccaaagtgctgg

SEQ ID NO: 76091 - DNA, 601 bp, Human
gttttgttatttatttatttatttatttattttgagatggagtctcgctctgttgcccaggctggagtgcgatggcgtgatctcggctcactgcagcctccacctcccggattcaagtgattctcctgcctcagcctcccgagtagctgggattacaggcacgtgccaccatgcccagctaatttttgtatttttagtagagatggcgtttcaccatgttggtcaggctggtctcgaactcctaaccttgtgatccgcccgcctcagcctcccaaagtgctgggattacaggcgtgagccrccgtgcctggcctttggcgtgttttaaaaaataataacttggttccttatcttccaaaggtgtaaactactagttttatttctcaataacttatataaactcatgatttaaacatacttgatgtttataaatattgccctattgaagctctagttgtataatcctctgtaacaaattaccacaaacttagcaacctaaaataacaaatttatgtcttaggatttttgtgatttagaagtccaggtggaggttagctgggtcctatgctcagggacttaccaggttaaaatcaatccaagg

SEQ ID NO: 76092 - DNA, 601 bp, Human
tgcagcctccacctcccggattcaagtgattctcctgcctcagcctcccgagtagctgggattacaggcacgtgccaccatgcccagctaatttttgtatttttagtagagatggcgtttcaccatgttggtcaggctggtctcgaactcctaaccttgtgatccgcccgcctcagcctcccaaagtgctgggattacaggcgtgagccaccgtgcctggcctttggcgtgttttaaaaaataataacttggttccttatcttccaaaggtgtaaactactagttttatttctcaataacwtatataaactcatgatttaaacatacttgatgtttataaatattgccctattgaagctctagttgtataatcctctgtaacaaattaccacaaacttagcaacctaaaataacaaatttatgtcttaggatttttgtgatttagaagtccaggtggaggttagctgggtcctatgctcagggacttaccaggttaaaatcaatccaaggttgcagtctcgtctgaagttcaggattttcttccaggctcactggtttttggcagaaatttccttgttgtgctatgactgatacccttgtt

SEQ ID NO: 76093 - DNA, 601 bp, Human
gcctccacctcccggattcaagtgattctcctgcctcagcctcccgagtagctgggattacaggcacgtgccaccatgcccagctaatttttgtatttttagtagagatggcgtttcaccatgttggtcaggctggtctcgaactcctaaccttgtgatccgcccgcctcagcctcccaaagtgctgggattacaggcgtgagccaccgtgcctggcctttggcgtgttttaaaaaataataacttggttccttatcttccaaaggtgtaaactactagttttatttctcaataacttatrtaaactcatgatttaaacatacttgatgtttataaatattgccctattgaagctctagttgtataatcctctgtaacaaattaccacaaacttagcaacctaaaataacaaatttatgtcttaggatttttgtgatttagaagtccaggtggaggttagctgggtcctatgctcagggacttaccaggttaaaatcaatccaaggttgcagtctcgtctgaagttcaggattttcttccaggctcactggtttttggcagaaatttccttgttgtgctatgactgatacccttgtttctt

SEQ ID NO: 76094 - DNA, 601 bp, Human
tgctaactggtatgacaagatgtttaagggtcttttgtgtttctgcttcatacctgcactcagccgtatctttcaaggccatagttgcatgcaaagattgctcattgctacagtgttggacattatttctaggctgctcagtggatagatggggagagtttttaaatatagatttaataaatttatttttatttgtgtatattgtttaagataaaatacttcaggaatcatattgtcatttccaattcaatttgaaaattagaagtttttacttaacctcttatgttacatgtatatctcstttcttctgcatcaagaatactgattttcagagtcaaaggaagatgtaattagcatatcccataatttactcaatatctttaccccacattatatacataatagtctcagaataacaatactaacattaccactatcaatatgattatgaagttagttaaaaaaaatttagcatttgctatttgttttactcacatttcttaaatgtaccatagtaagtacattgtcagagtgtatagtaattatatactttatgtgcttcctttcgccctcacttagtcttggttttataaataactgt

SEQ ID NO: 76095 - DNA, 601 bp, Human
ataaataactgttcatatagtgtgcaccaccagtccttatatctttgtctctttatttgtttcattgtctgaagcttattctctagttactagagtctaatagattcctcaggaaatgctcatgggaacaataaggcctaagtttttgcatattggtaatggcttttttgtgtcctttacacttaaaagttagtttttctgaataatcttggcttacatttttttgagttattttatttattttctatttatttattatttttgagatggagtcttgctctgtcacccaggctggagtgcrgtggcataatctcggctcactgcaacctctgcctcctaggttcaagcgattctcctgcctcagcctcccaagtagctgggactacaggtgcccaccaccatgtctggctagtttttaaatttttagtagagatggggtttcaccatattggccaggctggtctcaaactcctgaccttgtgatccgcctgccttggcctcccaaagtgctgggattacagatatgatccatcgtgcccggccttcttgagtgttttaaatctattattactgcattgtcttctggcatagggtattgtta

SEQ ID NO: 76096 - DNA, 601 bp, Human
attgttaacagttttttcatttgaggaaagttttcttgaattacagccattattaattagtatttattccattcctttgctttggttttcttcttgatatcagtatttttgagtcttgtttgagtgtggttttttgctcttgtattccttctgcttatcctttatttctaaaatgatttttacttctatttctaattcttttctgatttttctcaccctagcttaagattttctttcatgtattgtatcattttcttaatatcgtatagcctgttttgaaataaattacagttttgatctrtcttgtctgtagaaatgccattctgttccttctctttttttcttaaaataactttgtatgggatttgaccttgatatatttatgttgctaatttttatgtgaaattagttttccccaatgttttttttttttgagataagatcttgctctgttgcccaggctggaatgcagtggcatgactatggctcactgcagccttgacctccaaggcccaagcgatcctcctacctcagccttccgagtagctgggaccacaggcatgtgccactgtgcctagctaattaaaaaatatatattttt

SEQ ID NO: 76097 - DNA, 601 bp, Human
gttttgatctatcttgtctgtagaaatgccattctgttccttctctttttttcttaaaataactttgtatgggatttgaccttgatatatttatgttgctaatttttatgtgaaattagttttccccaatgttttttttttttgagataagatcttgctctgttgcccaggctggaatgcagtggcatgactatggctcactgcagccttgacctccaaggcccaagcgatcctcctacctcagccttccgagtagctgggaccacaggcatgtgccactgtgcctagctaattaaaaaayatatattttttgtagagacagggtcttgctatgttgctcaggctggtctcaaactcctgagctcaagtgatcctcccatcctggcctcccaaagtgctgagatgtgagccactgcacccgaccttctcctgaactttttgtcttttcgtgatagagtctcactctgtcacccatgttggagtgcagtggcacgatttcagctcactgcaacctccgtctcccaggctaaagcgatcttcccatctctgcctcctgagcagctaggaccacagggcacactaccacgcccaattattatta

SEQ ID NO: 76098 - DNA, 601 bp, Human
ccattaaaatgccccatcctagaagtaacaaagagcatttctgatcaaatttattgtctctagaaacagtcttgttcgtacctcacccagccacaagagggtagggaatacaatcataccatgcactcagaatgtatgcagctggaaatatttgagcagtgcctgtattgattaatattattttgatccacagattcttctgatcagattttatcctaaaataatcaactttgttcatttcactgtttataatattcaaaaattgaaagccacttaaatgtccagacattaaaaaacctamttatggtaataaccattaagtgcttagggccattattaatgtgattatattgatctgtattcattcacatgaaaagaggtttgctataataacaatatttactgagtactcaccatgacccaggtattccttctgaagttcttcataatgatacaatgattcctcttttttttttgagatgcagtcttgctctgttgccagcctggagtgccgtggcgcgatcttggctcactgcaacctctgcctcccgggttcaagtgattctcctgcctcagcctcccgagtagctgggattacagg

SEQ ID NO: 76099 - DNA, 601 bp, Human
agcagtgcctgtattgattaatattattttgatccacagattcttctgatcagattttatcctaaaataatcaactttgttcatttcactgtttataatattcaaaaattgaaagccacttaaatgtccagacattaaaaaacctaattatggtaataaccattaagtgcttagggccattattaatgtgattatattgatctgtattcattcacatgaaaagaggtttgctataataacaatatttactgagtactcaccatgacccaggtattccttctgaagttcttcataatgatayaatgattcctcttttttttttgagatgcagtcttgctctgttgccagcctggagtgccgtggcgcgatcttggctcactgcaacctctgcctcccgggttcaagtgattctcctgcctcagcctcccgagtagctgggattacaggcgcatgccaccacgcccggctaattttttgtatttttagtagagacggggtttcaccatgttggccaggatggtctcaatctcttgacctcatgatctgcctgcctcagcctcccaaagtgctgggattataggcgtgagccaccataccaggc

SEQ ID NO: 76100 - DNA, 601 bp, Human
aaaacctaattatggtaataaccattaagtgcttagggccattattaatgtgattatattgatctgtattcattcacatgaaaagaggtttgctataataacaatatttactgagtactcaccatgacccaggtattccttctgaagttcttcataatgatacaatgattcctcttttttttttgagatgcagtcttgctctgttgccagcctggagtgccgtggcgcgatcttggctcactgcaacctctgcctcccgggttcaagtgattctcctgcctcagcctcccgagtagctggrattacaggcgcatgccaccacgcccggctaattttttgtatttttagtagagacggggtttcaccatgttggccaggatggtctcaatctcttgacctcatgatctgcctgcctcagcctcccaaagtgctgggattataggcgtgagccaccataccaggcctttttttttttttttttttttgaggtggggtctcactgtgttgcccaggctgagtgtagtgtcatgattacggctcactgcagcctcatccccctgggggcccaagtaatcctcctacctcagcctcccaagtagct

SEQ ID NO: 76101 - DNA, 601 bp, Human
gagatgcagtcttgctctgttgccagcctggagtgccgtggcgcgatcttggctcactgcaacctctgcctcccgggttcaagtgattctcctgcctcagcctcccgagtagctgggattacaggcgcatgccaccacgcccggctaattttttgtatttttagtagagacggggtttcaccatgttggccaggatggtctcaatctcttgacctcatgatctgcctgcctcagcctcccaaagtgctgggattataggcgtgagccaccataccaggcctttttttttttttttttttttgaggtggggtctcactgtgttgcccaggctgagtgtagtgtcatgattacggctcactgcagcctcatccccctgggggcccaagtaatcctcctacctcagcctcccaagtagctgggaccgcagacatatgaaccaccctgcctggctaattaaaaaaattttttttttttatagatagggtcttgttgtgttgcccagtctggtctcaaactcctggactcaagtgattccccaaccttgacctcccaaagtgctgggattataggcatgagccactgtgcctggccaaggattatt

SEQ ID NO: 76102 - DNA, 601 bp, Human
agtagagacggggtttcaccatgttggccaggatggtctcaatctcttgacctcatgatctgcctgcctcagcctcccaaagtgctgggattataggcgtgagccaccataccaggcctttttttttttttttttttttgaggtggggtctcactgtgttgcccaggctgagtgtagtgtcatgattacggctcactgcagcctcatccccctgggggcccaagtaatcctcctacctcagcctcccaagtagctgggaccgcagacatatgaaccaccctgcctggctaattaaaaaaawtttttttttttatagatagggtcttgttgtgttgcccagtctggtctcaaactcctggactcaagtgattccccaaccttgacctcccaaagtgctgggattataggcatgagccactgtgcctggccaaggattatttgaaagattatcttgtgttcagtaaaattaggataactaaagaaaatgaaaaaagtggtatagatttgtaataacctcagaaagactatcttgacaacgagcttgaggcttttaaagctaagaaagacattttaaacctcatatttagaataagatgaataa

SEQ ID NO: 76103 - DNA, 601 bp, Human
ggaaaatgagagaggttctagaatataagaaaagcccttatttataaaatggggtagaaagtttgtttcaggtaaacttaatattggttcctgacatatctttagattattaaataggtgatcagtgaacatgctgaaaagaaagcttaaaggaaaaagaggaggaaacaacgggttgtttacgaccaagcatgtgtcactaagaacaaatcttgccacaccaatctagggtttgtgaaatgtcctggtgtaataaaaagatcactgggctagcactggaagatctagccttaactttacygctgtcttggtaggtaactctggacagtcatttaatttcctggatctcacctataagtttaggaggttagactgcctcattggtttccaaacttggctttgcactgtaggatgctctgcatgaaaatctttcatatattagatattatgttggatcttggaggtctgacatctcgcccacagcaagaataaattcctttttaatattcctgacgtgagtttctgtatgcctacttttcagagtgtggggattctgctgttctgttaacagtatccactctgctttttagagatacgcaaa

SEQ ID NO: 76104 - DNA, 601 bp, Human
gtagaaagtttgtttcaggtaaacttaatattggttcctgacatatctttagattattaaataggtgatcagtgaacatgctgaaaagaaagcttaaaggaaaaagaggaggaaacaacgggttgtttacgaccaagcatgtgtcactaagaacaaatcttgccacaccaatctagggtttgtgaaatgtcctggtgtaataaaaagatcactgggctagcactggaagatctagccttaactttactgctgtcttggtaggtaactctggacagtcatttaatttcctggatctcacctrtaagtttaggaggttagactgcctcattggtttccaaacttggctttgcactgtaggatgctctgcatgaaaatctttcatatattagatattatgttggatcttggaggtctgacatctcgcccacagcaagaataaattcctttttaatattcctgacgtgagtttctgtatgcctacttttcagagtgtggggattctgctgttctgttaacagtatccactctgctttttagagatacgcaaaataaatctaatccttttctaagtaagagttctctctaagcattttccacatca

SEQ ID NO: 76105 - DNA, 601 bp, Human
ctcattgtagccttgacctctcaagctcaggcgatcctctcacctcagcctcccaagtagctcagacaacaggcacacaccaccatgctcagctaatattttactatttttgtagagttggggtctccccatgtttcccaggctaatctcaaacttctgggctcaagtgatcctcctgcctctgccttccaaagtgctggaatgacaggtgtgaggcactgtgtccagcctcagattcttacataactatatagaaaactggtttgcattatctgtatccagcagttccactcctagatasatactcaagagctcttttaagagcaattctagattttcagaaaaattgagcagaaagtagagttctgtgtactcccttcttcctcaccccagccccacatggattcactgttactaatcttgcattagagtgatacatttgttaaaattgttgaaccattattaccacattattattaactaaagtccatagtttacattagggtttactctgttgtacattttctgggttttgataaatgcataatgtcatgtatccatcattgtgatatcatatagaatagtttaaccaccctaaaaa

SEQ ID NO: 76106 - DNA, 601 bp, Human
tgtgtccagcctcagattcttacataactatatagaaaactggtttgcattatctgtatccagcagttccactcctagatacatactcaagagctcttttaagagcaattctagattttcagaaaaattgagcagaaagtagagttctgtgtactcccttcttcctcaccccagccccacatggattcactgttactaatcttgcattagagtgatacatttgttaaaattgttgaaccattattaccacattattattaactaaagtccatagtttacattagggtttactctgttgtayattttctgggttttgataaatgcataatgtcatgtatccatcattgtgatatcatatagaatagtttaaccaccctaaaaattccctgtgtttcattcacctagtcatgccgctctggcacctgcgctaccaccaccatccacacagtcttcggcaactactcatctttttactgtctataattttgtcttttctagaatgtcatgtagttggaatcatatagaatgtagcctttttagattggtttatttcatttagcaatattcttttaaggtttctccatatatctttgtgacttga

SEQ ID NO: 76107 - DNA, 601 bp, Human
tatccatcattgtgatatcatatagaatagtttaaccaccctaaaaattccctgtgtttcattcacctagtcatgccgctctggcacctgcgctaccaccaccatccacacagtcttcggcaactactcatctttttactgtctataattttgtcttttctagaatgtcatgtagttggaatcatatagaatgtagcctttttagattggtttatttcatttagcaatattcttttaaggtttctccatatatctttgtgacttgattgctcatttatttttagtgccaaatcatattccrttgtatggatgtaccaatgtttgtttatccgtttacctactatcttggttggttccaagttttgctcatttttctatctagttgactctttttctcttattgatgtgtaggattttttgtatgttcttgataaaggtgttttatatatctagatatggagtcctttgtctatgtatgtatcataaatatcttctcctaatttctggcttgactttgtagtctcttaatggtgtcttatgataaacagttcttaattttaatacactagatacataatgtttcctttttgtttatgctttt

SEQ ID NO: 76108 - DNA, 601 bp, Human
ttttgtcttttctagaatgtcatgtagttggaatcatatagaatgtagcctttttagattggtttatttcatttagcaatattcttttaaggtttctccatatatctttgtgacttgattgctcatttatttttagtgccaaatcatattccattgtatggatgtaccaatgtttgtttatccgtttacctactatcttggttggttccaagttttgctcatttttctatctagttgactctttttctcttattgatgtgtaggattttttgtatgttcttgataaaggtgttttatatawctagatatggagtcctttgtctatgtatgtatcataaatatcttctcctaatttctggcttgactttgtagtctcttaatggtgtcttatgataaacagttcttaattttaatacactagatacataatgtttcctttttgtttatgcttttcatatctagtttaaaaaatctttgcctaccccttgggcacaaagatattctcctgttttttttcctcctataaatgttatttaatttaattaattaattaatttatttttgagacagagtttcgctcttgttgcccaggctggagtgc

SEQ ID NO: 76109 - DNA, 601 bp, Human
gaccattatgaataatactgctgtgaacattcatgtacaggtttttgtgtgaacatatgttttaacttctgttggatcttagcagtagaattgctgggtcatatgttaacttcctgtttaatttttagaagaaccgccaaatttttccaaagcagctgcaccctttcagattgcctccagcaatatataagggttttggtttttccatgttcttggcaacacttactaatatgtctattttttattataggtattttagtgggtataaagtggtatctcattttgattttcagttccccartgagtaataatattgaacatcttttcatgtgcttattgccatatgtctgtgtttcttggagaaaactctattcaaaatttgactatttttttaattgggttatttttctttttatggttgagttgtaagagttctttatatattctggttacaagtccagatatgtgttttgcaaatattttctcccattctgagttctctttccactttcttggtgtcttttgcagtgcaaaagttttacattttgatgaggtccaatttatcaatttttttttcttttgttgcttgtgcttttggcat

SEQ ID NO: 76110 - DNA, 601 bp, Human
gtatccagttgtttcagcactatttgctgaaaagaatattccttccccattgaattgttttggcacctctgtggcattttattttttattttttatttttattttttgacagagtcctgctctgtcgccaggctggagtgcagtggcacaatctcggctcactgcaacctccaccttctgggctcaagtgatcctcccacctcaccttcctgagtagcttggaccacaggcatgtgccaccatgcccacctaatttttatatttttttgtagagacaggatttcgccattgtgccccagcygatctcgaactactggactcgagattagcatgcctcggcctcccacagtgctgggattacaggcatgagccaccgtgcccagcccctgtattgtgttttcatatgaaaactttgtcaaactctttaggtattgctgagaattttttttttataaatatgaaatagctactgtcacaacaggcagagaataaaagaacctcttattgtatctatttaaggtaaagagatatttagtaattaagatagttggtaattatttcaaagtgagatattattttagaagtcaattttcactgttct

SEQ ID NO: 76111 - DNA, 601 bp, Human
taaaatgagtgtataaatggtgtgtggtacattgatagtatatgtttgtcttaaacagtgtagaataatgtaactccttaaataaattctgaagatagcattattcgagacatctctagaatattgtatactgaggcatgagctttgagactcatttgttggagcagagagtatttttttttttttttttttgagacggagtctcactctgttgcctacgctggagtgcagtggcacgatctcagctcactgcaagctctgcctcccaggttcactccattctcctgcctcagcctcccgrgtagctgggactacaggtgcccgccaccacgcccagctaattgttttgtatttttagtagagatggggtttcaccgtgttagccaggatggtctccatctcctgacctcttgatctgcctgcctcagcctcccaaagtgctgggattaccagtgtgagccaccgcgcccagccaagagtatgttttgtatgtagatctgtttttttttacgttcattttaaacctatgtagtctcaagtatctgcacacaaattattcattaatagcaaaggggagaataataactttaaattagagaaa

SEQ ID NO: 76112 - DNA, 601 bp, Human
attgatagtatatgtttgtcttaaacagtgtagaataatgtaactccttaaataaattctgaagatagcattattcgagacatctctagaatattgtatactgaggcatgagctttgagactcatttgttggagcagagagtatttttttttttttttttttgagacggagtctcactctgttgcctacgctggagtgcagtggcacgatctcagctcactgcaagctctgcctcccaggttcactccattctcctgcctcagcctcccgagtagctgggactacaggtgcccgccaccaygcccagctaattgttttgtatttttagtagagatggggtttcaccgtgttagccaggatggtctccatctcctgacctcttgatctgcctgcctcagcctcccaaagtgctgggattaccagtgtgagccaccgcgcccagccaagagtatgttttgtatgtagatctgtttttttttacgttcattttaaacctatgtagtctcaagtatctgcacacaaattattcattaatagcaaaggggagaataataactttaaattagagaaacttggtagattaaccaagtgaccaaaatta

SEQ ID NO: 76113 - DNA, 601 bp, Human
tggtattaagactcttgacataggttgggcgtggtggcacacacctgtaatcccagcactttgggaggccgaggcaggcagatcaagaggtcaggagatggagaccattctggctaacatggtgaaaccccgtctctactaaaaatacaaaaaattatccgggcatggtggtgggcacttgtagtcccagctactcgggaggctgagtcaggagaacggtgtgaacccaggaggcagagcttgcagtgagctgagatcaggccactgcactccagcctgggcaacagagtgagactccatstcaaaaaaaaaaaaaaaaaaaaaaacacacacacacacaattagccgggtgtgtggtggcagttgcctgtaatcccagctactcaggaggctgaggcaggagaatcacttgaactggggaggcagaggttgcagtgagccgagaccacaccaatgcattccagcctgggctacagggcgagactccgtctcaaaaaaaaaaaaaaaaaaaaaaattcttgacccagctcaccagcatagttagtttacttttctgtgcttccttgcagaatagcttttaaaccaaaatgcttaattatgc

SEQ ID NO: 76114 - DNA, 601 bp, Human
gacataggttgggcgtggtggcacacacctgtaatcccagcactttgggaggccgaggcaggcagatcaagaggtcaggagatggagaccattctggctaacatggtgaaaccccgtctctactaaaaatacaaaaaattatccgggcatggtggtgggcacttgtagtcccagctactcgggaggctgagtcaggagaacggtgtgaacccaggaggcagagcttgcagtgagctgagatcaggccactgcactccagcctgggcaacagagtgagactccatgtcaaaaaaaaaaaaamaaaaaaaaacacacacacacacaattagccgggtgtgtggtggcagttgcctgtaatcccagctactcaggaggctgaggcaggagaatcacttgaactggggaggcagaggttgcagtgagccgagaccacaccaatgcattccagcctgggctacagggcgagactccgtctcaaaaaaaaaaaaaaaaaaaaaaattcttgacccagctcaccagcatagttagtttacttttctgtgcttccttgcagaatagcttttaaaccaaaatgcttaattatgccttcaaattctgggat

SEQ ID NO: 76115 - DNA, 601 bp, Human
taggttgggcgtggtggcacacacctgtaatcccagcactttgggaggccgaggcaggcagatcaagaggtcaggagatggagaccattctggctaacatggtgaaaccccgtctctactaaaaatacaaaaaattatccgggcatggtggtgggcacttgtagtcccagctactcgggaggctgagtcaggagaacggtgtgaacccaggaggcagagcttgcagtgagctgagatcaggccactgcactccagcctgggcaacagagtgagactccatgtcaaaaaaaaaaaaaaaaacaaaaacacacacacacacaattagccgggtgtgtggtggcagttgcctgtaatcccagctactcaggaggctgaggcaggagaatcacttgaactggggaggcagaggttgcagtgagccgagaccacaccaatgcattccagcctgggctacagggcgagactccgtctcaaaaaaaaaaaaaaaaaaaaaaattcttgacccagctcaccagcatagttagtttacttttctgtgcttccttgcagaatagcttttaaaccaaaatgcttaattatgccttcaaattctgggattctt

SEQ ID NO: 76116 - DNA, 601 bp, Human
tgggcgtggtggcacacacctgtaatcccagcactttgggaggccgaggcaggcagatcaagaggtcaggagatggagaccattctggctaacatggtgaaaccccgtctctactaaaaatacaaaaaattatccgggcatggtggtgggcacttgtagtcccagctactcgggaggctgagtcaggagaacggtgtgaacccaggaggcagagcttgcagtgagctgagatcaggccactgcactccagcctgggcaacagagtgagactccatgtcaaaaaaaaaaaaaaaaaaaaaaacacacacacacacaattagccgggtgtgtggtggcagttgcctgtaatcccagctactcaggaggctgaggcaggagaatcacttgaactggggaggcagaggttgcagtgagccgagaccacaccaatgcattccagcctgggctacagggcgagactccgtctcaaaaaaaaaaaaaaaaaaaaaaattcttgacccagctcaccagcatagttagtttacttttctgtgcttccttgcagaatagcttttaaaccaaaatgcttaattatgccttcaaattctgggattcttcatat

SEQ ID NO: 76117 - DNA, 601 bp, Human
cacacctgtaatcccagcactttgggaggccgaggcaggcagatcaagaggtcaggagatggagaccattctggctaacatggtgaaaccccgtctctactaaaaatacaaaaaattatccgggcatggtggtgggcacttgtagtcccagctactcgggaggctgagtcaggagaacggtgtgaacccaggaggcagagcttgcagtgagctgagatcaggccactgcactccagcctgggcaacagagtgagactccatgtcaaaaaaaaaaaaaaaaaaaaaaacacacacacacaccattagccgggtgtgtggtggcagttgcctgtaatcccagctactcaggaggctgaggcaggagaatcacttgaactggggaggcagaggttgcagtgagccgagaccacaccaatgcattccagcctgggctacagggcgagactccgtctcaaaaaaaaaaaaaaaaaaaaaaattcttgacccagctcaccagcatagttagtttacttttctgtgcttccttgcagaatagcttttaaaccaaaatgcttaattatgccttcaaattctgggattcttcatattgcagaagagccta

SEQ ID NO: 76118 - DNA, 601 bp, Human
acacctgtaatcccagcactttgggaggccgaggcaggcagatcaagaggtcaggagatggagaccattctggctaacatggtgaaaccccgtctctactaaaaatacaaaaaattatccgggcatggtggtgggcacttgtagtcccagctactcgggaggctgagtcaggagaacggtgtgaacccaggaggcagagcttgcagtgagctgagatcaggccactgcactccagcctgggcaacagagtgagactccatgtcaaaaaaaaaaaaaaaaaaaaaaacacacacacacacaattagccgggtgtgtggtggcagttgcctgtaatcccagctactcaggaggctgaggcaggagaatcacttgaactggggaggcagaggttgcagtgagccgagaccacaccaatgcattccagcctgggctacagggcgagactccgtctcaaaaaaaaaaaaaaaaaaaaaaattcttgacccagctcaccagcatagttagtttacttttctgtgcttccttgcagaatagcttttaaaccaaaatgcttaattatgccttcaaattctgggattcttcatattgcagaagagcctac

SEQ ID NO: 76119 - DNA, 601 bp, Human
acaaaacaaaaacttaaaaaccagagaaggaaacaattacccataatcaataatcattcatttcagaagtaactgctgttaagagtattctctttctgtagtttcaaaaaatataatcggcatatacttgtatacaatttaaccatgctttattcacgtaacacatcatgcatatctacccacatcattaaaaattctttatcattattgtttttaaacttttaataatattccatcatatggtgtatcacaatttacttttttctgagttattttgaaggcaagtaactaacttatattsgttataagatagggaagatacagaagatgaatattttaatctatgcagtttacaaacagaagtaattggacctctttttcttgttccttgatttctgttatcttttgagaaacattatttgtaagaaaagcttttaaaagttacattaccagcatttgttatagtaaaaaacggcggggcacagtggctcatgcctgtaatcccagcactttgggaggccgaggcgggtggatcacgaggtcaggagatcaagaccatcctggctaacatggtgaaaccccgtctgtactaaaaatacaa

SEQ ID NO: 76120 - DNA, 601 bp, Human
tgaatattttaatctatgcagtttacaaacagaagtaattggacctctttttcttgttccttgatttctgttatcttttgagaaacattatttgtaagaaaagcttttaaaagttacattaccagcatttgttatagtaaaaaacggcggggcacagtggctcatgcctgtaatcccagcactttgggaggccgaggcgggtggatcacgaggtcaggagatcaagaccatcctggctaacatggtgaaaccccgtctgtactaaaaatacaaaaaaattagccgggcatggtggcgggcrcctgtagtcccagccacccaggaggctgaggcaggagaatggcatgaacctggaaggcagagcttgcagtgagccaagatcgtgccactgcactccagcctgggcgacagagcgaggctctgtctcaaaaaaaaaaaagaaacctggaagtatgcttttttgtatgaaaaaggatcctacctaattcttaaatgttaagttgtttttttttttttcggttggcgggtacagggggagatagagtcttgctctgttgcccaggctggagtgcagtggttcactgcaacctccgccccccgg

SEQ ID NO: 76121 - DNA, 601 bp, Human
tagtagagacgaggtttcaccatgttggccaggctggtctggaactcctcatctcaagtaatccactgtcctcggcctcccaaagtgctaagattacaggcatgagccactgtgccctgccttttttttgtttgagacaaggtcttgccctgttgtccaggctggagtgcagtggtgtaatcttagctcattgcaccttcgacctcctagggtcaaaggctcctcctgccacagtctccctagtagctgggactacaggcacacacgccccaatacccagctaatttttttttttttttttagtagagacggagccttgctatattgtccaagctcgtcttgaactcctgaccttaattaagcagccttcctgcctctgcctcccaaagtgctgaaattataggcatgagccaccacgcctagcttggaattttatttctaacatacatagttcacagatatctttctcaaattaaaaagttataaatttggctgggtatggtcacttgaggcaggaggattgcttgaggccaggtgttcgagaccagcctgggcaatatattgagactccacctgattctctgctttctctttccttttt

SEQ ID NO: 76122 - DNA, 601 bp, Human
ctgtcctcggcctcccaaagtgctaagattacaggcatgagccactgtgccctgccttttttttgtttgagacaaggtcttgccctgttgtccaggctggagtgcagtggtgtaatcttagctcattgcaccttcgacctcctagggtcaaaggctcctcctgccacagtctccctagtagctgggactacaggcacacacgccccaatacccagctaatttttttttttttttttagtagagacggagccttgctatattgtccaagctcgtcttgaactcctgaccttaattaagcagscttcctgcctctgcctcccaaagtgctgaaattataggcatgagccaccacgcctagcttggaattttatttctaacatacatagttcacagatatctttctcaaattaaaaagttataaatttggctgggtatggtcacttgaggcaggaggattgcttgaggccaggtgttcgagaccagcctgggcaatatattgagactccacctgattctctgctttctctttcctttttctgatttctctgttctttgagggtaagatgatattctcagactacatacatctttcaatagtagc

SEQ ID NO: 76123 - DNA, 601 bp, Human
agctgggactacaggcacacacgccccaatacccagctaatttttttttttttttttagtagagacggagccttgctatattgtccaagctcgtcttgaactcctgaccttaattaagcagccttcctgcctctgcctcccaaagtgctgaaattataggcatgagccaccacgcctagcttggaattttatttctaacatacatagttcacagatatctttctcaaattaaaaagttataaatttggctgggtatggtcacttgaggcaggaggattgcttgaggccaggtgttcgagaycagcctgggcaatatattgagactccacctgattctctgctttctctttcctttttctgatttctctgttctttgagggtaagatgatattctcagactacatacatctttcaatagtagccagcacagggctgggtacattcagtgaacaagtgaataaatgaatatacaaaatacaatcagaatcttagagaaggggaacccggtaggattgtaaacacatgcagagaaacacccatcataggagcaggctggcttcaagtctagaccctggtcatctcacagtgaactaatggtact

SEQ ID NO: 76124 - DNA, 601 bp, Human
cttgggaggctgaggcaggagaattgcttgaacttgggagatggaggttgaagtgagccaagatcttgccactgcactctagcctgggcaacaagagcgaaactccgtctaaaacaaaaaaaaggaattctatatagatcttaaagatgagtttgtggccagtacagtggctcatgcctgtaagcccagcactttgggagtccaatgtggcagaactgcttgaggccaggagtttgagaccagcttgggcaatatagtgagacctcatctctacaaaaaaaatttttttaattagcttggygtagttatgcatccctatagtcccagctatttggaggctgaggcaggaggatcacttaaccctaggggttcaaagctgtagtgagcaataatcatgcactgtactccagcctgggtgacagagtgagactctgtctcttaaaatatgtgtgtgtgtgcgcgcacgcgcacgtgcgtgcacatatatatatattttttttaagatttccacttggcagatatatgagtttagggattttgagattatatattttactccaaaagtatgtaagataatggccaggtgcagtagctcatgcct

SEQ ID NO: 76125 - DNA, 601 bp, Human
gtacagtggctcatgcctgtaagcccagcactttgggagtccaatgtggcagaactgcttgaggccaggagtttgagaccagcttgggcaatatagtgagacctcatctctacaaaaaaaatttttttaattagcttggtgtagttatgcatccctatagtcccagctatttggaggctgaggcaggaggatcacttaaccctaggggttcaaagctgtagtgagcaataatcatgcactgtactccagcctgggtgacagagtgagactctgtctcttaaaatatgtgtgtgtgtgcgcrcacgcgcacgtgcgtgcacatatatatatattttttttaagatttccacttggcagatatatgagtttagggattttgagattatatattttactccaaaagtatgtaagataatggccaggtgcagtagctcatgcctgtacttctagcactttgggaggctgagggaggaggatcatttgagcccaagaggttgaggctgcagtaagctatgattgtgccactgcactccagcctaagcaacagagtcctttctggaaaaaaaaaaaagtatgtaagataaatcatacttgaatttaa

SEQ ID NO: 76126 - DNA, 601 bp, Human; identical to SEQ ID NO: 31384

SEQ ID NO: 76127 - DNA, 601 bp, Human; identical to SEQ ID NO: 31383

SEQ ID NO: 76128 - DNA, 601 bp, Human; identical to SEQ ID NO: 31382

SEQ ID NO: 76129 - DNA, 601 bp, Human; identical to SEQ ID NO: 31381

SEQ ID NO: 76130 - DNA, 601 bp, Human; identical to SEQ ID NO: 31380

SEQ ID NO: 76131 - DNA, 601 bp, Human; identical to SEQ ID NO: 31379

SEQ ID NO: 76132 - DNA, 601 bp, Human; identical to SEQ ID NO: 31378

SEQ ID NO: 76133 - DNA, 601 bp, Human; identical to SEQ ID NO: 31377

SEQ ID NO: 76134 - DNA, 601 bp, Human; identical to SEQ ID NO: 31376

SEQ ID NO: 76135 - DNA, 601 bp, Human; identical to SEQ ID NO: 31375

SEQ ID NO: 76136 - DNA, 601 bp, Human; identical to SEQ ID NO: 31374

SEQ ID NO: 76137 - DNA, 601 bp, Human; identical to SEQ ID NO: 31373

SEQ ID NO: 76138 - DNA, 601 bp, Human; identical to SEQ ID NO: 31372

SEQ ID NO: 76139 - DNA, 601 bp, Human; identical to SEQ ID NO: 31371

SEQ ID NO: 76140 - DNA, 601 bp, Human; identical to SEQ ID NO: 31370

SEQ ID NO: 76141 - DNA, 601 bp, Human; identical to SEQ ID NO: 31369

SEQ ID NO: 76142 - DNA, 601 bp, Human; identical to SEQ ID NO: 31368

SEQ ID NO: 76143 - DNA, 601 bp, Human; identical to SEQ ID NO: 31367

SEQ ID NO: 76144 - DNA, 601 bp, Human; identical to SEQ ID NO: 31366

SEQ ID NO: 76145 - DNA, 601 bp, Human; identical to SEQ ID NO: 34683

SEQ ID NO: 76146 - DNA, 601 bp, Human; identical to SEQ ID NO: 34684

SEQ ID NO: 76147 - DNA, 601 bp, Human; identical to SEQ ID NO: 34685

SEQ ID NO: 76148 - DNA, 601 bp, Human; identical to SEQ ID NO: 34686

SEQ ID NO: 76149 - DNA, 601 bp, Human
ctgtggcagattgccacgaacatcatcaatgtccaaaccactctctttggatgcttgttcaatcactgggtccactttctcccctatgtgtatacatctaaaccccgatcctttgtatggcttttcaggataccagtgcccttcatatttcttcttaagaagtctttcaagttcttcaccaaaaatgttgacacgtctcctgggaagcttattgtacaaatacgaaataataaaatttagtgctacttggatttcaagctgcatagctgctacgccacaaaattaggtttcaactcccccmccaaaaaaaaaaaaaaaaaaaaaaaaaaaaagatgttcagtttgtggcagagaaacaaattttcattcaaagtgctggtattagtagattatccttcaccttgagtgatcttgttccttaaaacaaaagcaaacatatccaaataagataaatgtaatataagtcccatgaccttcccccctccaaagtaatttcacctttcaaaatgtctaagatcctgtgttagtctgctaaggataaaaagaaaaagaaaatgtctactaggacagaaagcctgaaaactgttactagcacaaaata

SEQ ID NO: 76150 - DNA, 601 bp, Human
ggccatatctgagagtatactttaaaatatacagtcagtataaaataactttgtgcttggttggcaaatgaaaaatgatgcatgttttattattatttttttaaccaagcttgaatgtatccttactataagcttaaaaaaaaaaattctcaaggaggtgaaaaaaaaaatcccccttgggcccgtgcattttaacttgtacgatacattttcttttttttagttagccataacaggctggaattgctggttagaatactgcatgttatttaagctaaaattcaagccatctacaaaagayttctcattgaggcctccataggctgcaaacacatcaaaggcattactgtactggagaggactgaggttaagggggctgtcacctgggaacattccattggtactactaccttgaccctgcatattaggaaaaataaattccttggcattaggagaaagagcagaggttttctgctgttgttgctgctgtggtggtggtggtggcggtggcggctgggctggctgctgctgttgctgtggctgctgctggctacccaagccaagcccatacagagagtgcattgaggaagagatggctttc

SEQ ID NO: 76151 - DNA, 601 bp, Human
cagagagacaacaattttgaaaaggccagtgaaaattcaattgctgtgagattaatcatgagggttagatccatattcactcgctgttgtgaaagggttggatccatattgactcactgttatgaatccatgttgatggttcattcctcctgtattattttatgtacttttaatttattaaataaacatctttttgttgcaaaaggaaacatgcatattatgtaatgtgggagaactgtgaaatatatatattaaaaattcatacgtattttccatcaccttaaaaacacaaaatatgttktatttcctttcaaattttatttatatacattctatatagtttgcttttcataactgaaataataatgtacataatatatccagcttttttcactaacataaccatgtcccttttaatataacttctgcataatcattttaaatgaatgcacaaaaatgatatctattcagttatagtttagtcatttgtttattgctgaacatttatgttgtatacagttttttttgtttgtttttttttgagacagagtctctctttgttgccaggcaggagtgcagtggcgcaatcttggctcactgc

SEQ ID NO: 76152 - DNA, 601 bp, Human
agctgatgatgatggggaactcagaaagcatgggaagaccaaagacggtgaatatgacattcctctattttcaggactaattaattctaaatttagaacagatatggtaacatttcctccatcgcattttgtagttcagacttcccctttgggtttaatacaggagctcctacatcaacagttgagaacttttacaatttcacagaagagatgcaaagacaaagtatttaaaaacctcacaggtattaaaagtcaaaacaaaacaaaatttcacatgaaggaagagaatcagatgatagtattttttatatttagataggtaaaataaaaaataaaataaatttgaacacacacaaaagaataattatttctagttaagtaaaactacgtatgaaaacaaaaacccaagtattttcttttttcctacctatatgcctgtagtcactgcatcatccataatgttctggtatcataattcctgctgtgtttctgcatttacataaaatctgtattaatggaatcaaatggtgaaaacaagtctttggtctatcattaatttaaataatgattcacaatttagtttactcatcttcattttttt

SEQ ID NO: 76153 - DNA, 601 bp, Human
tttttatatttagataggtaaaataaaaaataaaataaatttgaacacacacaaaagaataattatttctagttaagtaaaactacgtatgaaaacaaaaacccaagtattttcttttttcctacctatatgcctgtagtcactgcatcatccataatgttctggtatcataattcctgctgtgtttctgcatttacataaaatctgtattaatggaatcaaatggtgaaaacaagtctttggtctatcattaatttaaataatgattcacaatttagtttactcatcttcattttttttwaaaaaaaggagtctcattgtctttactcagttttatcttctcttgagcctcatcaccttttgaggacaatgaaatcctttcttttagagactaggtgggactaacgtgtaaattatcttttaaactcagatgggtcaaagacaatgtttctccatttaatttaggtaatattatgaattgggcagtgtttttaaggaaagtcaatccaggaaagattgtcaattaaagatcatagttccaagaaataaatgtccccaagttgctagtgaataagagaaatcattattcggcactttccca

SEQ ID NO: 76154 - DNA, 601 bp, Human
tcataatttactctcttctgtcctccacctcactctcatatttatactttcttcaattaaattaagtaaagtattgattgaggggaatcatgatgtgctaggaagaggtagccttaatgtaacacagatgaagatatgaaatccagttttacaattgtcttagtgagattcagtgatttgcacacaaccagccacacaactggtgactactctcattcccttttccacagtttgaaaataggtatccaaagctaatattactattttctctttccccatcacagcccactccccaacacayaccatttacttctcaaataaccccctgttcataatagacacataaggtcagtggatttcagatttgcattaaaaacagcatggtattttacttgaaagcctggaactgatttgcgagccccctcctgtgctaatatccatgattcaaatgtcttttattgtgggatgatgggtagtggttgggattgtgcatgtagtgatcatgtgtcacgttcaaaaaatcatcaagaatgtgccttatttagcaccaaccaccaccatggtaagaaaaactcattttataagtagactcatggggatc

SEQ ID NO: 76155 - DNA, 601 bp, Human
ccacacaactggtgactactctcattcccttttccacagtttgaaaataggtatccaaagctaatattactattttctctttccccatcacagcccactccccaacacacaccatttacttctcaaataaccccctgttcataatagacacataaggtcagtggatttcagatttgcattaaaaacagcatggtattttacttgaaagcctggaactgatttgcgagccccctcctgtgctaatatccatgattcaaatgtcttttattgtgggatgatgggtagtggttgggattgtgcrtgtagtgatcatgtgtcacgttcaaaaaatcatcaagaatgtgccttatttagcaccaaccaccaccatggtaagaaaaactcattttataagtagactcatggggatcataatactgctattgagatttctgggtgcctaaaataaatatacacattcatggaatgcaaaaagacgttcattgctctgacagagtttacaagccaaggaaagccattaagagaagctatatgctgtaatatactataaactcatacacttgtctcagttaaagatagcctgaagtaaaaacaattaagg

SEQ ID NO: 76156 - DNA, 601 bp, Human
agtaaaaacaattaaggcattatatttattgctttttctattgctaattgtttaagtaaaggcttctgtgtaaatcaaatctgccagcagaaagacattatatttgcttagctgggtttccttccagagcacatgcaattgtgaatttcaaagacagtgcctgccaattactgttggctttaagggagtcagaggttttataattaaacccaccactattagcccctggtagttggaagctggagagaaacttaaatcatgattttcctagctgccattcctctctgataatttctcgagkccttcggctttttaacagtgtaaatagctgaattcaaattgtgtgggagtttttttaaattgatcaaagctatataaatgaaagtaattacaattaatgaatattgatactaaaggttacacttgttgggtaaaaaattttaagcactttgtgcatccagtattctaagaggcactgtctgtactaagtagatacccacaggaatatggagatatttatactgcatatttagaattactgggtaaggggaggtataaagtatgtgtgtatgtgtgtgtgtgtgtgtgtgtgtgtgtgtgt

SEQ ID NO: 76157 - DNA, 601 bp, Human
acagtgcctgccaattactgttggctttaagggagtcagaggttttataattaaacccaccactattagcccctggtagttggaagctggagagaaacttaaatcatgattttcctagctgccattcctctctgataatttctcgaggccttcggctttttaacagtgtaaatagctgaattcaaattgtgtgggagtttttttaaattgatcaaagctatataaatgaaagtaattacaattaatgaatattgatactaaaggttacacttgttgggtaaaaaattttaagcactttgtrcatccagtattctaagaggcactgtctgtactaagtagatacccacaggaatatggagatatttatactgcatatttagaattactgggtaaggggaggtataaagtatgtgtgtatgtgtgtgtgtgtgtgtgtgtgtgtgtgtgtgtgtgtacgtttatacagacctgaattcaagttgaaaatttccatcattatctacttaatatctacccttctcatgtgtgtgcattgtttttcaaaatgggggtatttattgttggcaagcaaaaaattgtgaaagatattaagaatgtcata

SEQ ID NO: 76158 - DNA, 601 bp, Human
tattgttggcaagcaaaaaattgtgaaagatattaagaatgtcataaaatacaaagcctccaaataaaaatcttcctgtttaaaatttatgtattatttttaaaaacttggaaaacagaagtgtcaggaattacggaccctaaaagcagaggaaaccagagaccatgtgaaactgcatcacacatacctaaactactccccaatattagaacttagattgtgttttaaaaggcctccaagtggttatgtggggcaaatttactctaacagtaaacgacaaaacacaaccctaaagaaatgyacagtgtgacccaaattcttgccttagtgtttctgacatatttcatgaaaattattaggactttcccaaaaacttttagtgtagcatataggcttgtgatattgattaggttgtttctttgtagctgagagtcaaattgtcttcttatagcaattaatggactaacacaactatttcaattctctctttaattggaaaggagaaagcaaaacttctatttgaaatataattttgtccaaatgattggatgatttatagctagattcagtgtaatttaaaaaataagattagggctttctg

SEQ ID NO: 76159 - DNA, 601 bp, Human
tactatgcttttatcattaccttagagtatacttcttctacttataaaaaaagttaactgtaaaatagcctcaggtaggtccttcaggagttattccaggaggcattgttacaggagatgacctctccatgtgtgtcattgcccttgaagaccttctactgggacaagatgtgggggtggaagatggtaatactgattatcctgaccctgtgtaggcctaggggaaagagaagtgtaattaactttccactttacattcatggggctctacatagtatgagaaaagctccctgtggccaakcttaacaaaactgggctccagaattattgttttatcccaacacatcgtattctatactactgagatcaatggaagagaacaggccattttctgtaaataaggaaagcgtgtatgattacagtctgaggattaaagaaaggtgaaaagtatagcaaactagaattcttggtaatttgaatgttgttgatttttgaacaaaagttttttatcagtcaccacttgtcaccttttaatagctacacaaaaaagtcgtttatttcataaacactcagaatgtgagaaacttgaatccttttgccc

SEQ ID NO: 76160 - DNA, 601 bp, Human
atgaataaatgcaacagctttaactgtggcaatagccagaccaaaacaaatgggtaagcagctgttatattatgtgtatgtttattttaatttccaggaatctctgggtgcccctttttcctctggggacttctagcattgttgggcttggctttggttatatcactgatcttcaatatttcccactatgtggaaaagcaacgacaaggtaagacattttgacaaatttcacatggtacctgcttgaatggagactatggagtcactggaaaacctatggaagcagacaattttatgaaakgtcattcaacaggatatttttatctatagaaaatctatttgctaatttttctcgcccaaagggttctcttatttaagaatgcaatcatattagaaatgtgaaatagttatccaatttaggaactcttctttagggtgtagagtgggaagggattatcctggtaaatacgtttttcctcctccagttgaaaaacctatgaaattgtagtctatgctggggcagccatcaaggttctctctgatacataataaacaaagggaagtctagctctttaagattccattcaagccaacttaatct

SEQ ID NO: 76161 - DNA, 601 bp, Human
acatataagtggtaataaaagaaaagaaaagataaatgcatttccttttaacagaggaaatgaaataaaactaagttaacaaaattaacttagacacatgtgtccaagaaaaatgtcatagagctaatttagaacaatggtcagattgcagcaaatgtccttgcttcacttagaaatatcttaagcaccgataatactaatataaaatatgaagaagggattattgtcatgcaggtttgaaaataagatgagaggtactcgaaaatggagtggtctagctgaagccacacatctattcaayagcaaaatcaatgataagtgtccagtttttctaattctctgtcccaaaaggtttctaccagtacatccttccttgacattgttgaccagttgtcctcagccagaaacccaacactctttttggatctctattatatcaattctatggctaaggtgaaatttatgacaagcaatctttttcattagcaatgctttcagtaatcttttaaaaatccaatatattttcaaataaacataaactatataagtcagatgtataaatgacccatcatcaaacatcttctacagtttccctccttta

SEQ ID NO: 76162 - DNA, 601 bp, Human
aaatgtccttgcttcacttagaaatatcttaagcaccgataatactaatataaaatatgaagaagggattattgtcatgcaggtttgaaaataagatgagaggtactcgaaaatggagtggtctagctgaagccacacatctattcaatagcaaaatcaatgataagtgtccagtttttctaattctctgtcccaaaaggtttctaccagtacatccttccttgacattgttgaccagttgtcctcagccagaaacccaacactctttttggatctctattatatcaattctatggctaasgtgaaatttatgacaagcaatctttttcattagcaatgctttcagtaatcttttaaaaatccaatatattttcaaataaacataaactatataagtcagatgtataaatgacccatcatcaaacatcttctacagtttccctcctttatagataaaaatgagctcagagtagcactttgctttatatatcgaattggctattttaacttctttattaagatatcttataaatccagataatatatagccagaattacaaaaaaaatgtgaattgagatctacagagagtaaataatttaa

SEQ ID NO: 76163 - DNA, 601 bp, Human
caatctttttcattagcaatgctttcagtaatcttttaaaaatccaatatattttcaaataaacataaactatataagtcagatgtataaatgacccatcatcaaacatcttctacagtttccctcctttatagataaaaatgagctcagagtagcactttgctttatatatcgaattggctattttaacttctttattaagatatcttataaatccagataatatatagccagaattacaaaaaaaatgtgaattgagatctacagagagtaaataatttaaggtgacaaccaagacaasaccagtaacctgaattagtacctcactctttcattgattccactgataatccttttaagattgctgaggggccaggtaacaggtagacattgacatgcttaccttgagctcaattgtctaacttaaaatttatctagcaaatgtgacctatttactttcaaccttaatagtcaattttttcagtcctatgattgcatgaattatggatgttaagaactgctttttatcaacatcatcaagatcaggactggtataatttcactaatgtagtacttctgccccagaagtattcagctgtac

SEQ ID NO: 76164 - DNA, 601 bp, Human
ggggtttcaccattttggccaggatagtcccgatctcccgacctcgtgatctgcccaccttggcctcccaaagtgctgggattacaggcatgagccaccgtgcccggccagagttagtttttatgtgttacactagtattctttctaggcaccagcgttcatacttcaagcacctccatctgaaaaatccacattatcttttaaaaacattagcctgtttggggaattatttttactccatacctactttttcttattcttattaagcaatgacactcttcacttttgttttcaatgtttytgctgatttttttccttttctttcaaattaatgctcagctggtgactatccttttgtcaagagtgagattttagtaatttcatttcaaatcaagcattacttatatatcttttaacttcaaaatatcataccatcttaataataccagtgtgttttcaactaactcgttcattgaaacttcctgactcaaatgagtgcaattaatttctggcttgttatataatatgtatttagaatgtatgtataatattaataacaaactttgtcattaaaaaatgtttttacagaaaatatttcatt

SEQ ID NO: 76165 - DNA, 601 bp, Human
ccaaatggaatacattcatcacttttggtcccatagcagcttagtgcatatgctccgcaaaatcttccctcatttagtccttcacagaattcttccaaacacattgacatgtgacatgtctgtttcatcctccagtatgattactttcataaattgttccactaatgtgtctttaacagttaataacctctctggagaataactcaactttgttacacataaatttaactaaaataagttttgtagttgtttggtgacttactgaattatttgaaaatgttattgctagttccttactaayatagagtgttttcacatgttcaagttgaaagataatcatttggtcactattttctcgtgattattgtcagagagttagataatagtggtctttatttttacattaataacttttttgcaaggttttggcttttatttaatgccaggttgaaaaataagccattcaaatataataaacattgtgctgtatgtgtgcatctagttcaacagtaaagaaaatttactgatgaatggataatacagaattttctataacattgatgttaagactgtaccctgattatcccttactttttttcaa

SEQ ID NO: 76166 - DNA, 601 bp, Human
gtatgattactttcataaattgttccactaatgtgtctttaacagttaataacctctctggagaataactcaactttgttacacataaatttaactaaaataagttttgtagttgtttggtgacttactgaattatttgaaaatgttattgctagttccttactaacatagagtgttttcacatgttcaagttgaaagataatcatttggtcactattttctcgtgattattgtcagagagttagataatagtggtctttatttttacattaataacttttttgcaaggttttggcttttrtttaatgccaggttgaaaaataagccattcaaatataataaacattgtgctgtatgtgtgcatctagttcaacagtaaagaaaatttactgatgaatggataatacagaattttctataacattgatgttaagactgtaccctgattatcccttactttttttcaataattcatcatgaatctattgccttcaattaaagaaaattcttaaaactacatttgttaaatagcttttgaattcttatatttgacctagaagtaaaaatacttttatttggctttgaactgcctcattcaagg

SEQ ID NO: 76167 - DNA, 601 bp, Human
gcagaccaaaaataacttttcttttcttagaagctgttctactgtttcggttaattttagagcctgtgttccaactttttccaggtctcttcttcctagcacactcatttctccttcccactcctttgtacaatgtggatgaaatgaagtcatgatcacagcagctttcttaatatcatttttatgttgttactcatgccaagaaatgttaaaagtagatagatagatagatagatgatagatatagatagatgatagatagatagatagatagatagatagatagatagatagatagatagagattgataaaagaaaagtctcctattgatttttttcgtttttggtaacaaagaaaagcctattcaaaccacatgggcaaagataaaaacttataagaatgcagaggtgtttcatggaacccaaaggcagaaagtacagtcatgccctgcagtggactggagccacaagggaggcaggaaggaaggttccagctctctctgcttagtgtttctgtgcataaaaccgcaatgcatccaggctgtacatcgtctccaagctgcactgtttccaccccaaattaccaagaaagttgctctgg

SEQ ID NO: 76168 - DNA, 601 bp, Human
aaataacttttcttttcttagaagctgttctactgtttcggttaattttagagcctgtgttccaactttttccaggtctcttcttcctagcacactcatttctccttcccactcctttgtacaatgtggatgaaatgaagtcatgatcacagcagctttcttaatatcatttttatgttgttactcatgccaagaaatgttaaaagtagatagatagatagatagatgatagatatagatagatgatagatagatagatagatagatagatagatagatagatagatagatagagattgataaaagaaaagtctcctattgatttttttcgtttttggtaacaaagaaaagcctattcaaaccacatgggcaaagataaaaacttataagaatgcagaggtgtttcatggaacccaaaggcagaaagtacagtcatgccctgcagtggactggagccacaagggaggcaggaaggaaggttccagctctctctgcttagtgtttctgtgcataaaaccgcaatgcatccaggctgtacatcgtctccaagctgcactgtttccaccccaaattaccaagaaagttgctctggtttctcttc

SEQ ID NO: 76169 - DNA, 601 bp, Human
aacttttcttttcttagaagctgttctactgtttcggttaattttagagcctgtgttccaactttttccaggtctcttcttcctagcacactcatttctccttcccactcctttgtacaatgtggatgaaatgaagtcatgatcacagcagctttcttaatatcatttttatgttgttactcatgccaagaaatgttaaaagtagatagatagatagatagatgatagatatagatagatgatagatagatagatagatagatagatagatagatagatagatagatagagattgataaaagaaaagtctcctattgatttttttcgtttttggtaacaaagaaaagcctattcaaaccacatgggcaaagataaaaacttataagaatgcagaggtgtttcatggaacccaaaggcagaaagtacagtcatgccctgcagtggactggagccacaagggaggcaggaaggaaggttccagctctctctgcttagtgtttctgtgcataaaaccgcaatgcatccaggctgtacatcgtctccaagctgcactgtttccaccccaaattaccaagaaagttgctctggtttctcttcaagt

SEQ ID NO: 76170 - DNA, 601 bp, Human
cttttcttttcttagaagctgttctactgtttcggttaattttagagcctgtgttccaactttttccaggtctcttcttcctagcacactcatttctccttcccactcctttgtacaatgtggatgaaatgaagtcatgatcacagcagctttcttaatatcatttttatgttgttactcatgccaagaaatgttaaaagtagatagatagatagatagatgatagatatagatagatgatagatagatagatagatagatagatagatagatagatagatagatagagattgataaaagraaagtctcctattgatttttttcgtttttggtaacaaagaaaagcctattcaaaccacatgggcaaagataaaaacttataagaatgcagaggtgtttcatggaacccaaaggcagaaagtacagtcatgccctgcagtggactggagccacaagggaggcaggaaggaaggttccagctctctctgcttagtgtttctgtgcataaaaccgcaatgcatccaggctgtacatcgtctccaagctgcactgtttccaccccaaattaccaagaaagttgctctggtttctcttcaagtca

SEQ ID NO: 76171 - DNA, 601 bp, Human
tactgtttcggttaattttagagcctgtgttccaactttttccaggtctcttcttcctagcacactcatttctccttcccactcctttgtacaatgtggatgaaatgaagtcatgatcacagcagctttcttaatatcatttttatgttgttactcatgccaagaaatgttaaaagtagatagatagatagatagatgatagatatagatagatgatagatagatagatagatagatagatagatagatagatagatagatagagattgataaaagaaaagtctcctattgatttttttcrtttttggtaacaaagaaaagcctattcaaaccacatgggcaaagataaaaacttataagaatgcagaggtgtttcatggaacccaaaggcagaaagtacagtcatgccctgcagtggactggagccacaagggaggcaggaaggaaggttccagctctctctgcttagtgtttctgtgcataaaaccgcaatgcatccaggctgtacatcgtctccaagctgcactgtttccaccccaaattaccaagaaagttgctctggtttctcttcaagtcatataaatctttctttcttggtaat

SEQ ID NO: 76172 - DNA, 601 bp, Human
agtttatatcaagaatgatttgcttactgctcttttggtttctttttacaacacataatgatgaaaatcctatataatcacacagtaagagctaatctctttaatgatctatttaatacttgtaatttgaagggcaattaagatgcaatgtgatagaaagtcttgtgatttgactatttagctaaattaggttgatggtttagggattaggatgggagcaatgagagggaaaattggtaaaatacctgcctcaaagcaatcaggcttttagctgtagggcaaatgtaaaaaaaaaaaaaaagcttttataacatttattcattcaataaatattcactcaacaaacaggcactgtgctagacaatagcaaaataagtttgctgattaccaatcccaagggaggatataggatagcaaagatcattactatgccaaccaccaggaataggagtctgagcgcttcagcccactgtgtcttgggatgcacatttactactttcctgagtctggtgagacaaaacacacaaacaatgagttacataaagtgagcttattacttactcagcaaaggacaaccaaagtctaagattcattcagagat

SEQ ID NO: 76173 - DNA, 601 bp, Human
agggaaaattggtaaaatacctgcctcaaagcaatcaggcttttagctgtagggcaaatgtaaaaaaaaaaaaaaagcttttataacatttattcattcaataaatattcactcaacaaacaggcactgtgctagacaatagcaaaataagtttgctgattaccaatcccaagggaggatataggatagcaaagatcattactatgccaaccaccaggaataggagtctgagcgcttcagcccactgtgtcttgggatgcacatttactactttcctgagtctggtgagacaaaacacacraacaatgagttacataaagtgagcttattacttactcagcaaaggacaaccaaagtctaagattcattcagagatagttccccaagcctcagaaaagctgtccaaggtggatggaaactcatcttcctgttccccacctgcactgcagctgaaggactccagaaagcagcctacctttgggtttacccctaaggggcaacatgatatgctgggctaaagcactgaaggatatcctgtttctgtgagagactagaataaaacctaggctgttccagctgattcttctttatccctgaaggt

SEQ ID NO: 76174 - DNA, 601 bp, Human
ctgagtccctctgcagcatttgacaccctgacactctctacttgaaacacttgattctctgggctctgagccacctccctctttggttttcttcttctcttaccagcagccccttctcctttgctggtttctgaatcttaaacatcacagttcccagggcctcattccataaataatgtcatcctctctcatggctttaaacatttacacacttacggagcccaagcttacatctttgcctattcagagtaacaactatgaagcaaatcaggttagcaattaccaaaaccaacttctgatrgatcccaaagcttgtcctttcccatctctggcaacttctcaggcccttaaaatagatttatttcgttttgtaaaaaagtctttcaattttatttggatgttggaatcctgcatttgtattctagaacttgggaactgaaaagaacaatagaaatcaactagtttaatctcattttttaagtaagacaatctaaacttagagaatttaagtccaaggtgatcaggtagaagtagtgattttttttttttttttgagacggagtctcgctctgactcccaggttggagtgcagtggtgcaat

SEQ ID NO: 76175 - DNA, 601 bp, Human
gactctgtctcaaaaaaaaaaaaaaaaaaaaaaaaaagaaatacgtgtatatatatatgaaagcacaaagtctggaccatagtaatagatataattaatatatttttcttaattttggagtgtcagtaaatgtacttactggttagagaattatttcaggcatgttcagaacaatggagagtctggtctggctgaaaactcagaggtacactagcctctcagatatgagttcaattattaatttatttttaaaagtaattaatcatccacataaaatactgccaaacatttgctcctgagstttattacacatttacaacaggctggagctatttggcattgccaagaatatatttttaaatttgtttgttaggcaattgctcctgaataatagtttatttgagatgattaatcatttgagatgggcctgtagacacaggacactgcattataaatcacatcttattttcattcatagggaataaaacaatactcattttttggacatgatttatcatttgcaagttggatctgccatctatgtgggctaggaaaatggatggattgtcttattaaaaattcttcagtttttgctattata

SEQ ID NO: 76176 - DNA, 601 bp, Human
atttcatacaggtatcatttgaactgttatttttttaatacctacgtactatttacatatactgtgtcttttttcagtggcatagagagtaatacaggtgttatgccttgagataagagtcctttttttttttcttttgatgaaattccctccagctctcagtgacatgtaatctcaaagttaaagcagtcggtactattttatgaaatgcgactctcaccacctgataagttcctcagttcccagactgccattgtgaaatctggtcactagggccatcatcaatggtaggatgacattrgtagaatgacagtctagtgacaatggtaggatgtatactgtaatcctaatagcattactcacgtgaggctggaaggaactttaatcagctagcaagagcaaatagctgtgtattcttgtcagttctcttgacctgagggtcggggagacataaaactgtggtccctgtatagtctctagactgtttccccacagcctttgaattgtatcacccactgaataacttcctcatgatgtggactgagcacggggctttacaactaaacttgctgtacaatcctagcactgccagttactgact

SEQ ID NO: 76177 - DNA, 601 bp, Human
acataataggtgatcaatcattttattgcatctgctaacctcagtctgtaatactcagaaaacatggttttaagagactgtttggactgatattctgggtgagtaaagaggcagtacattgtacaataaagagcatggattacctgggttctaattctaactctgctatttgttagtcgtaatcttgagcaagtcatatgacctctctgtgcctcagatttcttatctgcataaggaggatgatatagtacctatgttggaattgagagaattaaatgaacaaacataggaaatatactckatgtagcacctaatatacagttactattgaataagtatttgctatcatgattccctgtaagaagatccaaaaaccaactttttaaattcacacggaacacagatacacatacacacatgcatgcacgtgttcactcacttgcacaagaacacacctaccgtggttggctgggggtaaccaagaacaggcaatagttcacttaatattgaatttagctgagaagtcagttatgaattatgtgaaaagtggaatctaataaggtaaattatttttccttgttatagggttgatgagtattat

SEQ ID NO: 76178 - DNA, 601 bp, Human
cttcagttcccagcatcccttatcacttgtgtcatcccagacatctaaaaatgaaacatccctaaatttctccaaacagataaccttggtctgattctagagttctgatgatagaagctaccaccctttccctgcaagtactcattcaatacatcagaggagacttgggggttaaatgctgttgaactccaagttttgaacacagagacatccagtaatgtaggaaatttatctaaaaatctatatattaaaacagtatggaatcatcttaaagttagaaatgtgggaattttcttttgcrtgattcaagaatttatttttatctttcctttcattgtagagtgtcctctagtgctctaaggaatcaaaaattattttttggaaatatattattcaaaataatttgtccccatttcactttggagaatcatgttagtcacctataatactcaactactcaaattcttatgtattctgatggctccaaacccattatacctgctacttccatacttaagtgagcccaggtgccgcttgcacacattctgatttagcaggtccaggctaaggcttagagatctgctacttaacatcccaggtg

SEQ ID NO: 76179 - DNA, 601 bp, Human
tttcactttggagaatcatgttagtcacctataatactcaactactcaaattcttatgtattctgatggctccaaacccattatacctgctacttccatacttaagtgagcccaggtgccgcttgcacacattctgatttagcaggtccaggctaaggcttagagatctgctacttaacatcccaggtgattctgatgcagattttccatggaccatgatttgagaaacaccactctacataccctttctctgtgttgcttttcagaaagagctcaatgattattaagtcgcttttcttayagtaaatatatctttctctctctgagggtcaaactggtacaatccacacttctgtcaggttactggccatcctatgagtcactacttcactttcttcttccttttaaatggacatatctgggggaagaaaggtatggatgattcaaaaggcatgtccccataggatgaaatgagtacagatctgctggctgctggacactgtacaaaagccccaaatactaaggaccagcattgtgcagccccagacccttaggcagtctggctgagatgtccgtcactgattgatgggacaaaagtcat

SEQ ID NO: 76180 - DNA, 601 bp, Human
cactgtgctttgtggcaccatgcaccatttgcagtctatcttaaataaagaatactggcaatcccttaacttgtgagatctctataacatccaaatggtagcttaagactgtcatgtcctgcagtggtacaagaaaattcatatgatctagttcttattccaaggatttatttttatcttactaaccctttagctcaagagacttcaccgcctgatctgcaggtaacagtttgggcttccttacctctttctatctccaccaaaaagactagttaagtaattcttgggcagtttatatttrcagccaaatgttgtttggatcatgtatttttaatcatactagtatttttaaattttctattgtgaatcacaatctttttaattcccaagaaccaatggatgaaaattgctatgaacaaatgaaagcccgaccagagaaatctgtaaataagatgcaggaagccaccccatctgcacaggtgagttttgttttctgtttccacatttgcacatttcaagagcataagagtagtacattatgatacacatctgaaatagcctgttagaaattttgcaatcaatcagatgtcaagttctggga

SEQ ID NO: 76181 - DNA, 601 bp, Human
tgaaaattgctatgaacaaatgaaagcccgaccagagaaatctgtaaataagatgcaggaagccaccccatctgcacaggtgagttttgttttctgtttccacatttgcacatttcaagagcataagagtagtacattatgatacacatctgaaatagcctgttagaaattttgcaatcaatcagatgtcaagttctgggacctgagctctaactcagggtcatgtaaacagaactcaaaccatattcaaagagtcaaaattgtacacaatcacaaaggcaatagattttaagggaataaaggaattattcctaagtaatctattaagctttttctttctgattgaaaattttgtgtatatcacagagataatataatatagaaggtgacacatggataatgctcacaagacctaaatgtcaggaattcaaaatacagagctggggtagggagagggagacctttagttataagataaattagctagatacaaaacatcatatccctattttaaaaggcagatgactttcaattttaatacaagtcctgtggctgtggtcttatggcaagagattgcaaaatatacacacagtttatgtgg

SEQ ID NO: 76182 - DNA, 601 bp, Human
aattgctatgaacaaatgaaagcccgaccagagaaatctgtaaataagatgcaggaagccaccccatctgcacaggtgagttttgttttctgtttccacatttgcacatttcaagagcataagagtagtacattatgatacacatctgaaatagcctgttagaaattttgcaatcaatcagatgtcaagttctgggacctgagctctaactcagggtcatgtaaacagaactcaaaccatattcaaagagtcaaaattgtacacaatcacaaaggcaatagattttaagggaataatggaattattcctaagtaatctattaagctttttctttctgattgaaaattttgtgtatatcacagagataatataatatagaaggtgacacatggataatgctcacaagacctaaatgtcaggaattcaaaatacagagctggggtagggagagggagacctttagttataagataaattagctagatacaaaacatcatatccctattttaaaaggcagatgactttcaattttaatacaagtcctgtggctgtggtcttatggcaagagattgcaaaatatacacacagtttatgtggaggt

SEQ ID NO: 76183 - DNA, 601 bp, Human
ctgtttccacatttgcacatttcaagagcataagagtagtacattatgatacacatctgaaatagcctgttagaaattttgcaatcaatcagatgtcaagttctgggacctgagctctaactcagggtcatgtaaacagaactcaaaccatattcaaagagtcaaaattgtacacaatcacaaaggcaatagattttaagggaataatggaattattcctaagtaatctattaagctttttctttctgattgaaaattttgtgtatatcacagagataatataatatagaaggtgacacayggataatgctcacaagacctaaatgtcaggaattcaaaatacagagctggggtagggagagggagacctttagttataagataaattagctagatacaaaacatcatatccctattttaaaaggcagatgactttcaattttaatacaagtcctgtggctgtggtcttatggcaagagattgcaaaatatacacacagtttatgtggaggtaggcaggacaaaaacctaaggagaaacataaaaatacaggaagaaatggatagtttctctttttcctaccacaatctgttcaacctctt

SEQ ID NO: 76184 - DNA, 601 bp, Human
gaattattcctaagtaatctattaagctttttctttctgattgaaaattttgtgtatatcacagagataatataatatagaaggtgacacatggataatgctcacaagacctaaatgtcaggaattcaaaatacagagctggggtagggagagggagacctttagttataagataaattagctagatacaaaacatcatatccctattttaaaaggcagatgactttcaattttaatacaagtcctgtggctgtggtcttatggcaagagattgcaaaatatacacacagtttatgtggasgtaggcaggacaaaaacctaaggagaaacataaaaatacaggaagaaatggatagtttctctttttcctaccacaatctgttcaacctcttcagttttagttctaactttattaaaagccattagaaatttttagcctacatgctcctgaaatgctatacatttcaattaaaatagtttttcttctcctctcagatcctgtcttgttactgcctagaaatggtaatagagccagcatttcctaagcaatttttacgtgttggtcttgtactatgtgctttatgttcattatctccttaga

SEQ ID NO: 76185 - DNA, 601 bp, Human
tgtggtcttatggcaagagattgcaaaatatacacacagtttatgtggaggtaggcaggacaaaaacctaaggagaaacataaaaatacaggaagaaatggatagtttctctttttcctaccacaatctgttcaacctcttcagttttagttctaactttattaaaagccattagaaatttttagcctacatgctcctgaaatgctatacatttcaattaaaatagtttttcttctcctctcagatcctgtcttgttactgcctagaaatggtaatagagccagcatttcctaagcaattkttacgtgttggtcttgtactatgtgctttatgttcattatctccttagattcctatgagggaggcagcattatcattcccattttacaaatgctcacaaaggatgaaaacttgcccagaacacttaggtactaagtaagtagacagaatccaaacttagtcctctcttacagaacattctcttccctaaaatggctcacatcttgaaaatttcccagtgaggtagaattttactctttttctttagataaatcccctaagaaatcaaacttttaaacttttttttttttttgagacagag

SEQ ID NO: 76186 - DNA, 601 bp, Human
cacagtttatgtggaggtaggcaggacaaaaacctaaggagaaacataaaaatacaggaagaaatggatagtttctctttttcctaccacaatctgttcaacctcttcagttttagttctaactttattaaaagccattagaaatttttagcctacatgctcctgaaatgctatacatttcaattaaaatagtttttcttctcctctcagatcctgtcttgttactgcctagaaatggtaatagagccagcatttcctaagcaatttttacgtgttggtcttgtactatgtgctttatgtkcattatctccttagattcctatgagggaggcagcattatcattcccattttacaaatgctcacaaaggatgaaaacttgcccagaacacttaggtactaagtaagtagacagaatccaaacttagtcctctcttacagaacattctcttccctaaaatggctcacatcttgaaaatttcccagtgaggtagaattttactctttttctttagataaatcccctaagaaatcaaacttttaaacttttttttttttttgagacagagttttgctctttgtcgcccaggctggagtgcaatg

SEQ ID NO: 76187 - DNA, 601 bp, Human
ttagaaatttttagcctacatgctcctgaaatgctatacatttcaattaaaatagtttttcttctcctctcagatcctgtcttgttactgcctagaaatggtaatagagccagcatttcctaagcaatttttacgtgttggtcttgtactatgtgctttatgttcattatctccttagattcctatgagggaggcagcattatcattcccattttacaaatgctcacaaaggatgaaaacttgcccagaacacttaggtactaagtaagtagacagaatccaaacttagtcctctcttacrgaacattctcttccctaaaatggctcacatcttgaaaatttcccagtgaggtagaattttactctttttctttagataaatcccctaagaaatcaaacttttaaacttttttttttttttgagacagagttttgctctttgtcgcccaggctggagtgcaatggcacaatctccactcactgcaacttctgcctcccgggttcaagcgattctcctgcctcagcctcccaagtagctgggattacaggtgcctgccaccatgcccagctaatttttgtatttttagtagagacggggttt

SEQ ID NO: 76188 - DNA, 601 bp, Human
taagcaatttttacgtgttggtcttgtactatgtgctttatgttcattatctccttagattcctatgagggaggcagcattatcattcccattttacaaatgctcacaaaggatgaaaacttgcccagaacacttaggtactaagtaagtagacagaatccaaacttagtcctctcttacagaacattctcttccctaaaatggctcacatcttgaaaatttcccagtgaggtagaattttactctttttctttagataaatcccctaagaaatcaaacttttaaacttttttttttttttgagacagagttttgctctttgtcgcccaggctggagtgcaatggcacaatctccactcactgcaacttctgcctcccgggttcaagcgattctcctgcctcagcctcccaagtagctgggattacaggtgcctgccaccatgcccagctaatttttgtatttttagtagagacggggtttcaccgtgttggttaggctggtcgcaaactcccgaccgcagtgatccacccacctcggcctcccaaagtgctgggattacaggcatgagccatcgtgcccagctgaatattttttaactaa

SEQ ID NO: 76189 - DNA, 601 bp, Human
agggaggcagcattatcattcccattttacaaatgctcacaaaggatgaaaacttgcccagaacacttaggtactaagtaagtagacagaatccaaacttagtcctctcttacagaacattctcttccctaaaatggctcacatcttgaaaatttcccagtgaggtagaattttactctttttctttagataaatcccctaagaaatcaaacttttaaacttttttttttttttgagacagagttttgctctttgtcgcccaggctggagtgcaatggcacaatctccactcactgcaacytctgcctcccgggttcaagcgattctcctgcctcagcctcccaagtagctgggattacaggtgcctgccaccatgcccagctaatttttgtatttttagtagagacggggtttcaccgtgttggttaggctggtcgcaaactcccgaccgcagtgatccacccacctcggcctcccaaagtgctgggattacaggcatgagccatcgtgcccagctgaatattttttaactaagaaaccaagatgtagtaggagttgggaaaaatatgctcaccaaatctgccatataatgtttagttaa

SEQ ID NO: 76190 - DNA, 601 bp, Human
attctcttccctaaaatggctcacatcttgaaaatttcccagtgaggtagaattttactctttttctttagataaatcccctaagaaatcaaacttttaaacttttttttttttttgagacagagttttgctctttgtcgcccaggctggagtgcaatggcacaatctccactcactgcaacttctgcctcccgggttcaagcgattctcctgcctcagcctcccaagtagctgggattacaggtgcctgccaccatgcccagctaatttttgtatttttagtagagacggggtttcaccrtgttggttaggctggtcgcaaactcccgaccgcagtgatccacccacctcggcctcccaaagtgctgggattacaggcatgagccatcgtgcccagctgaatattttttaactaagaaaccaagatgtagtaggagttgggaaaaatatgctcaccaaatctgccatataatgtttagttaattataaaatatattttagataaacatatggaaaacctgcatgatataatatgatttgctaaatccatgataataaaaagaaaacctctcaaggaaggttaaaatacattatctgaagt

SEQ ID NO: 76191 - DNA, 601 bp, Human
agtaataaagtgagttcacaagagtccccaaatcccaaaacatttgaaaaatacaagtgtgagcttgctcctcttctcttcatatccaaatctctaatcaatcttttcctcctatgtcagaagcatcctctctcctttccaaagccaatgctcttattcatgatcttgaccctttctcctaattatttcaggatcttgtactttcaattattgaacttttctcaagtttccatttttttaatgaatcattactatttgcctaccaatatgtgaaagtccctccaatattaaaaaaaaaaaacaccttacttgaactgtttttccttctaatttctaaactgattcttagcttcttcctctattgttttgatttctttggatagatacacattcatttaccctggctatgtgttttccacccatgcacttaactaacactgcagtgtggaagtctccagtgactattaaacatacaatttgtggtcctttcttaggactcacattctttaactctgcagcacttgataaagttgaccaagtgttgaccacacatgcattatttggaatgctttcagttataaatgaagaaaacaggttgaga

SEQ ID NO: 76192 - DNA, 601 bp, Human
gctttcagttataaatgaagaaaacaggttgagattaaattagaaataacttgacaacagtatatggcagtgggaagaaactagagcatggatccagttaggcagctattacaatttttccagaaatgaggattttaagactaagaagctagacacaacaacaacaacaacaacaacaacaaaaccacacagccaggtgtggtggctcacgcctataatcccagcactttgggaggccgaggcgggcggatcacctgagatcaagtgttcaagaccagcctggccaacatggcgaaactcygtctctactaaaaatacaaaaattagccaggcgtggtggtgggcacctataatcccagctacttgggaggctgaggcaggagaatcacttgaacctgggaggcagaggttgcagtgagctgagatcgcaccactgcactccagcctgggtgacaagagcgaaagtccatctcaaaaaacacacgcatgcacacacacacacacacacacacagcagagggtataaatagaaccatcttttctatctggcagagaatataaaatgtttcactattaacatgaaaacaagtgccaacgggga

SEQ ID NO: 76193 - DNA, 601 bp, Human
caggtccctccagggactcggacagcacgcgatttttccaggatttccgactaccaaatgtgacaagacagtctcgccgccgagagtttcgccagggctcgctaaaatccggcacgcgccgccatcagatagtcgaaaatccgggctgaacaaaaggtgatcattctccgctgcccggatttgcaggcgctagaggaccggttccgcccggcgtcccccagatacccagtccttcagcctcccgctcccagagcctggatctagcccgggacggggattggccaccttccaagctgagctyggagttgggcagcgggaacgcagatacagatcgctctacacagtgtgtgcaacccaatctccctttctgcatttgccagggtcttgttttcagtgaaactggcaaggccaattgtacctcggcgcccacccctcttcaccttttctccacctctgggattctcccggtccggctcagtgtagggccccagcacgccaaaccaacaggcctatcttgtccccacgcgccccgtggtacttggaaactgttcccgggactcaagatggaccgcgcagaggagtcgcttcatcctcgaggcta

SEQ ID NO: 76194 - DNA, 601 bp, Human
ggcggtcccctcgggatttcttccaggaaggaaagcaaaacacaacaaaacaaatccagactccacgtggggctggaacccagtcccagccctgctgtgttctagctggtcccgggtttggacgccagcgaaggaaggcgcgcccgcgctctccatcggggggactcgagggcagcgccgtgcggggaacatcccggccagccccggccattcgaggggacttgcgtcccagaggaattgccctcatctctcccaccagcgccgacaagctcaaacaatggcgcggacgcccaccctggtrgcctaaccaggacctggccccgctcagccgccaggccttccgggacaagccccttcctggcactttctcttggagcgctttggggagaagggagggggactgggctcatttggaggagcaaaagacagccctcgcggaaaaagaaagaaaaatcagcaaaatcgccttagcagttcaaccaaaggtcaacagcagcgtttccccagcagctgacaggtcaaatgggcaggaaacaactgcggggaacaaagccccccgctgtccggcaggggcgaacccggctcctccgcactgaacagt

SEQ ID NO: 76195 - DNA, 601 bp, Human
gaaaaaacagaaaaatgtcaccagagtttccagagctgttaattgtgttcctctccccccacattcatcagtggccttagtgactgttttctacagaaagggtaatatcatgggctgtatggtcaggccctgggctattggatgctatccggtactatagggtgagtggaaggagaaactggaatatctagatgatcttccccatttctccaacagctccaggacagcttttaaattagaactgacaaaggctgagggaagttttaggtaggtggaaaggaaggtaatgtttttatacctrcaatctttttgcataacagattattttgttatttggggttaataaaggcaaagaatagggtaagaaaaagctctttttgtctttctctaatgaccaggggagtctcaaactctaatccaaggatttacgaatgagagagaaagggatttcaagaagtgtattgtgataaaatctgaaaaactaaaatttccaaactgactctaaaaatgccttacaagattttaaattaaatgagttttaaaaaaattaccccactggaaatcctttactagcaaagatagaaaacattagatttttcgt

SEQ ID NO: 76196 - DNA, 601 bp, Human
tttctgagcagtccatttttgtgggtggagcccacctctcctataagcacccaggataagcccaaggaagttgtgacggtctaaagggtcaaatttcactctcaatttacacctacatctgtctttagttacttttgttagttggagacatccaatgtaaatggtgtctaacatagtgagtttgcttcattgtaaaaaatcacctgtaagacctagcaacttatgcttccagtccttggctgtcatgggcattgtattacatttgtaagcagaaactaccatatttgcaagcagaaaggctattttatttgcaagcagaaaagcgagtcattttccctttaggtagaaaaggtatgcaatattgacatcccccagagctgtgctgtttgatgccattgccctcctggggaactgaagacagagagagcaatggtggggctagagagagaaaaaacagaaaaatgtcaccagagtttccagagctgttaattgtgttcctctccccccacattcatcagtggccttagtgactgttttctacagaaagggtaatatcatgggctgtatggtcaggccctgggctattggatgctatccggta

SEQ ID NO: 76197 - DNA, 601 bp, Human
ctccctcatttttctgagcagtccatttttgtgggtggagcccacctctcctataagcacccaggataagcccaaggaagttgtgacggtctaaagggtcaaatttcactctcaatttacacctacatctgtctttagttacttttgttagttggagacatccaatgtaaatggtgtctaacatagtgagtttgcttcattgtaaaaaatcacctgtaagacctagcaacttatgcttccagtccttggctgtcatgggcattgtattacatttgtaagcagaaactaccatatttgcaagcagaaaggctattttatttgcaagcagaaaagcgagtcattttccctttaggtagaaaaggtatgcaatattgacatcccccagagctgtgctgtttgatgccattgccctcctggggaactgaagacagagagagcaatggtggggctagagagagaaaaaacagaaaaatgtcaccagagtttccagagctgttaattgtgttcctctccccccacattcatcagtggccttagtgactgttttctacagaaagggtaatatcatgggctgtatggtcaggccctgggctattggatg

SEQ ID NO: 76198 - DNA, 601 bp, Human
caccctttctctctccctcatttttctgagcagtccatttttgtgggtggagcccacctctcctataagcacccaggataagcccaaggaagttgtgacggtctaaagggtcaaatttcactctcaatttacacctacatctgtctttagttacttttgttagttggagacatccaatgtaaatggtgtctaacatagtgagtttgcttcattgtaaaaaatcacctgtaagacctagcaacttatgcttccagtccttggctgtcatgggcattgtattacatttgtaagcagaaactaccatatttgcaagcagaaaggctattttatttgcaagcagaaaagcgagtcattttccctttaggtagaaaaggtatgcaatattgacatcccccagagctgtgctgtttgatgccattgccctcctggggaactgaagacagagagagcaatggtggggctagagagagaaaaaacagaaaaatgtcaccagagtttccagagctgttaattgtgttcctctccccccacattcatcagtggccttagtgactgttttctacagaaagggtaatatcatgggctgtatggtcaggccctg

SEQ ID NO: 76199 - DNA, 601 bp, Human
agtggccaccctttctctctccctcatttttctgagcagtccatttttgtgggtggagcccacctctcctataagcacccaggataagcccaaggaagttgtgacggtctaaagggtcaaatttcactctcaatttacacctacatctgtctttagttacttttgttagttggagacatccaatgtaaatggtgtctaacatagtgagtttgcttcattgtaaaaaatcacctgtaagacctagcaacttatgcttccagtccttggctgtcatgggcattgtattacatttgtaagcagaaactaccatatttgcaagcagaaaggctattttatttgcaagcagaaaagcgagtcattttccctttaggtagaaaaggtatgcaatattgacatcccccagagctgtgctgtttgatgccattgccctcctggggaactgaagacagagagagcaatggtggggctagagagagaaaaaacagaaaaatgtcaccagagtttccagagctgttaattgtgttcctctccccccacattcatcagtggccttagtgactgttttctacagaaagggtaatatcatgggctgtatggtcag

SEQ ID NO: 76200 - DNA, 601 bp, Human
agactctgaacacagacacctggaccttcctgccagctggctgacacctaacgccatgctgggggctcgaactggtttgcagtctctcccagtcctcctgggcgatctgctatgttcagcaaactggcttccgttggagtgaacttttcttcccatcgtgcttcctcttcgttagccaggaactgcctcccggtaaggaaatcggctctctggtttcagatgttctgattttttttcaaggaatttcttggctcgggaaagtggccaccctttctctctccctcatttttctgagcagtcyatttttgtgggtggagcccacctctcctataagcacccaggataagcccaaggaagttgtgacggtctaaagggtcaaatttcactctcaatttacacctacatctgtctttagttacttttgttagttggagacatccaatgtaaatggtgtctaacatagtgagtttgcttcattgtaaaaaatcacctgtaagacctagcaacttatgcttccagtccttggctgtcatgggcattgtattacatttgtaagcagaaactaccatatttgcaagcagaaaggctattttatttgcaa

SEQ ID NO: 76201 - DNA, 601 bp, Human
tatgtaaatgctgagctgtatttaaaatccaactaagtgaacttctcaccttgagactctgaacacagacacctggaccttcctgccagctggctgacacctaacgccatgctgggggctcgaactggtttgcagtctctcccagtcctcctgggcgatctgctatgttcagcaaactggcttccgttggagtgaacttttcttcccatcgtgcttcctcttcgttagccaggaactgcctcccggtaaggaaatcggctctctggtttcagatgttctgattttttttcaaggaatttcttggctcgggaaagtggccaccctttctctctccctcatttttctgagcagtccatttttgtgggtggagcccacctctcctataagcacccaggataagcccaaggaagttgtgacggtctaaagggtcaaatttcactctcaatttacacctacatctgtctttagttacttttgttagttggagacatccaatgtaaatggtgtctaacatagtgagtttgcttcattgtaaaaaatcacctgtaagacctagcaacttatgcttccagtccttggctgtcatgggcattgtattaca

SEQ ID NO: 76202 - DNA, 601 bp, Human
attttcatcagacttacttaagaataactccatctacagttcaactccactgtgcctcctccttctcacatcctcatacagggaggcaattttccaagtttagtggaaatgaggacccctcattagaagccctccaccacactcccccgtcccttgcagaagtaggagataatgtatgtaaaagtactttacaaagggcagattgataatatcaccataataggactgttactgggatttgtgatggggaagactgtcctttggtggtgactatggtcatggatctttttttttttttttyccccagacagggtctgtcactgtcactctctcacccaggctgcagtgcagtggcacgattatggctcactgtagccttgacttccctgggctcaagcaatctccttgcttcagcctcctgagtagctgagattacaggcacatgccatctcgcccggctaatttttgcattttttgtagagaccaagtttgccatgttgtcctggcctcaagtgatctgcctgcctcagtctctcaaagtgctaggattgcaggtgtgagccaccacacccggccttggtcatgaatcttaatgtggctg

SEQ ID NO: 76203 - DNA, 601 bp, Human
tgaggttgcaccccaccctgagcatgtatcacctgtgcagcccgggcctcctgaacctctcggagcctcctcctcgtctgtaagtgatgaaagtcccctgcacaaaggcctatgaggactggttctgacagccaggctctgtgcctggcatcagggagacagatcatgaagttttcccttctcggtgcctacatggaggggtgccctcggatgccctcagcagagatcctcaaaggccaaagaggaaccggggacagggtaatgctggtaaggtactgggcatttgacagcctgctctccyggaaacctgtctcttggtttccggagacctccagacctccatcttctctcccaggcatggccatggctgccactcagcagaacccttgtcagggacctggcaccggctgctggccatggagtggtgtggggggcaaggagggcccaagtgacccatttggtggggaacaggctagatgtggcctgagagggccattcgtcatctcccccaggctcatcgcaactgtctggaaaaggcaccattagaaggcagcagaaaaatgattacagaaaagtcagttccctctgagggagttttaaa

SEQ ID NO: 76204 - DNA, 601 bp, Human
atagaaacagggtgtacattttttcctctctgaccggaggcttctctattcccctcctctccctccctcaggatataaatggatctctctctggtcacaggcccttgttcctgctgagtcacagtgaccagcctccctggatggaaaacctgctggtggggctggtaccgtcagcctcggtcatgctggtggcctcggcagccacttcatcacagaagcaccccctccctcccatcataaacccctttccttattcggctgccaccactgctgcccaaaatgcagtaattagaggatgagrgaagaggaaggaaatatctgtctgcagctgaagtccttcaggggcttctgtgatgggaaacttcagtccatgctccctttcggagaaagtggaagggaaactcattcattaacagtggttgatcacttgtatcccaagccatcacttgttactctatatacttctctaggatttgaaaaaattctaagtacatgatccttttgtctattacataatttgagctattaaaacacattttaaaacaacatgttagacacaggtggtgtcctgcaaaaactcaccaccaagacagacaagcta

SEQ ID NO: 76205 - DNA, 601 bp, Human
ttcaactgactccaatgacaatttggccaacagtcctggatgtcgctacctttgcggtcttcatgacagtgacataggacctctgtgccctagggccattgatagaaattttccaatgtgcagacatgtgacggtgagtcagtcacttgcgccaaatcccaaccctaaagactgcttcctactgagaggaaggaaacggttctctaccacatcatgaggcttatagaaacagggtgtacattttttcctctctgaccggaggcttctctattcccctcctctccctccctcaggatataartggatctctctctggtcacaggcccttgttcctgctgagtcacagtgaccagcctccctggatggaaaacctgctggtggggctggtaccgtcagcctcggtcatgctggtggcctcggcagccacttcatcacagaagcaccccctccctcccatcataaacccctttccttattcggctgccaccactgctgcccaaaatgcagtaattagaggatgagggaagaggaaggaaatatctgtctgcagctgaagtccttcaggggcttctgtgatgggaaacttcagtccatgctccct

SEQ ID NO: 76206 - DNA, 601 bp, Human
ccttttaaaattagccaggcatggtagtgccacctgtagtcccagctaccagggaggatcccttgagcccaggagttcgaggctgcagtaagctatgatcacaccactgcactcctgggtgacagagcaagactgtctcaaaagcaaagacaaaaaacaccgtcagaactctgaaaagaaggcatccactggcccctacgctgttcctgccccccacttccaagccctgccccccgagtctacctggtcgtgtagtggggtcccacaggagctgcagcccaggtccaagggctctgtggcrctggggggaaccgggggtgggatggctgccagggccttggttttagaacagaattctgggtactcggaggaaaacctctcatagccgcctgtaaaggagaaagaagctcaggttaatggggtcactaagccagcaggaagtcagaaagaactcgactcctacagactcaggcggactgctaggaaggcaggggctggcgtgctccatattggccactaggtggcgctgtggacctagagaatggccatggagtggtttccagagatgcagaggacacactcgtcaggactgcagcaaagc

SEQ ID NO: 76207 - DNA, 601 bp, Human
aaatctcaggattggatgcagtggctcacgcctgtgatcccaacactttgggaggccaaagcaggaggatcacttgaggccaggagttcaagaccagcctgggcaacatagcaagacccccccccccccatctctaccaaaaaccttttaaaattagccaggcatggtagtgccacctgtagtcccagctaccagggaggatcccttgagcccaggagttcgaggctgcagtaagctatgatcacaccactgcactcctgggtgacagagcaagactgtctcaaaagcaaagacaaaaaayaccgtcagaactctgaaaagaaggcatccactggcccctacgctgttcctgccccccacttccaagccctgccccccgagtctacctggtcgtgtagtggggtcccacaggagctgcagcccaggtccaagggctctgtggcgctggggggaaccgggggtgggatggctgccagggccttggttttagaacagaattctgggtactcggaggaaaacctctcatagccgcctgtaaaggagaaagaagctcaggttaatggggtcactaagccagcaggaagtcagaaagaactcgact

SEQ ID NO: 76208 - DNA, 601 bp, Human
agctatgattgcgccacaggactcaagcctgggtaacagagtgagactctgtctctaaaaataaacaaataaataagctgatgccctcatggccacacagacaagagagaggatcttggcaaaatgaggcaacagtggcttaaatttagcacatgagatgtgggcagcagagtccatctaactgaaagggctggagggtgggcttataagaaacacagtggctcaagcaggttttcttggagggagggtgggtgaccatctatgttcattcggctgatacgtgggagcagcctgcctgtcrgggactgagatgtatttcatggcctgctacttcagaggagaatgacctcagcttcccagagagcaggtcccccagggcttctggaggcctcctcacttgtccggacacgacgttagaggccaagccagggagtcatgtctttagacttttttcttaggaggatatttagagagggaaggggaagatttccaagaagtaaataggtcctacctaacatcccaccccaatactccgggttcaccgcattctccccaaattgaggcataacattcaaagacttaaaaaaatctcaggattgga

SEQ ID NO: 76209 - DNA, 601 bp, Human
ctgtgtggtttagatacttatttgttttgatatgtattcactgggcatatcaaaaacaggtgtgcagtggctcacacctgtaatctcagcactttaggaggctgaggtggcaggatcatgtgagccaggagttccaagaccagcatgggcaacacagtgagacctcatctctcaaacaatgaagctggcatgatggtgcacacctgtagtctcagttgcttgggaggctgaaatgggaggatcatttgagcccaggactttgaagctgcagtgagctatgattgcgccacaggactcaagyctgggtaacagagtgagactctgtctctaaaaataaacaaataaataagctgatgccctcatggccacacagacaagagagaggatcttggcaaaatgaggcaacagtggcttaaatttagcacatgagatgtgggcagcagagtccatctaactgaaagggctggagggtgggcttataagaaacacagtggctcaagcaggttttcttggagggagggtgggtgaccatctatgttcattcggctgatacgtgggagcagcctgcctgtcggggactgagatgtatttcatggcctgc

SEQ ID NO: 76210 - DNA, 601 bp, Human
atcatcaagccatttgctgtgtggtttagatacttatttgttttgatatgtattcactgggcatatcaaaaacaggtgtgcagtggctcacacctgtaatctcagcactttaggaggctgaggtggcaggatcatgtgagccaggagttccaagaccagcatgggcaacacagtgagacctcatctctcaaacaatgaagctggcatgatggtgcacacctgtagtctcagttgcttgggaggctgaaatgggaggatcatttgagcccaggactttgaagctgcagtgagctatgattgsgccacaggactcaagcctgggtaacagagtgagactctgtctctaaaaataaacaaataaataagctgatgccctcatggccacacagacaagagagaggatcttggcaaaatgaggcaacagtggcttaaatttagcacatgagatgtgggcagcagagtccatctaactgaaagggctggagggtgggcttataagaaacacagtggctcaagcaggttttcttggagggagggtgggtgaccatctatgttcattcggctgatacgtgggagcagcctgcctgtcggggactgagat

SEQ ID NO: 76211 - DNA, 601 bp, Human
tattatctgttcaaggatttccctttgcagaaacaaaacagtggggtccagggtggtggctcactcctgtaatcccagcgctttgggaggccaaggagggtggataacttgagctcaggagttcaagactagcctgggcaatatgatgaaactgtctctacaaaaatacaaaaattagctgggcgtggtggtgcacttgtagtcccagctactccagaggctgaggcaggagaatcacttgcaccccagaagcggaggttgcagtgagctgagatggcgccactgcactccagcctgggcracagagcaaggctctgtctcaaaataaataaataaatagaaataaaataaaaactatgactcaatgctccttgtgtcttcctccccgtccaaaaactcttaccatctaggcactgaagccatgcaaggggaaggggactggctctgcaagctaagcctgtgtgtaggtccatcttccctcctccctcccaacccaacatccaatgtataagccttcccaatgaggaagagggggaatggggacccttggattcagtgcctccaatgtccaccttcaacccaggcttacaggggttcctta

SEQ ID NO: 76212 - DNA, 601 bp, Human; identical to SEQ ID NO: 22712

SEQ ID NO: 76213 - DNA, 601 bp, Human
ggacgaatggacccaccttgaaaagcccccagagcctctgccccagaagaaaagtttcttcagggtaattaaactataaagcaattgagaagtgcaaaagttgagcgcccccactcccaccaccctctcttcactaccccccataaaacagtaaaaggggaaaaaaaggaggagaagaagaagaaaagtaaggcagggtgaggggtttatagattcaggaaatgtttctaagcgacccccttcaagggaaagaaaaaagaaagaagaaagaaagataagaaagaaaggggaaaagcggcargcgatcggaacggagccggcaagtcttccagaagctggaggaaatgcgccccggcctgccaggccccctgcccggccttgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgtagccgtagaa

SEQ ID NO: 76214 - DNA, 601 bp, Human
aaaatctatttttaaagcctgtcttgtattcgaaaggtatttgtaggtctacgcagcatttgaactttccgggctcaagtgttcttattgaatagttttatgttggtgggaaggcaaggggggaaaacgaagaggtggactagccgggagttaaatgtattgattcattgcaggatattattcaaagttaaatgcagtcttctgccaaacagtccctctaccctaaagttttcgtcatcaataattgttttgtgagtgtgtagaaaagcctttaatcctttttaaacaatttagaggcctcctttgttagccgccgtccagcgattgcatatgtactgtttgctttcaaattaccttaagataattgctagagtgaagcagtatgtacttatatttggaaaatcatcaaagaatattgtaatgggggaggggtaattcctttttctcaaagtatgtgtcggtatctcaaacccaagttctgtgagtacctgttctgtaactaaatactgtgtatttgctccagatgtgaaagccatccagcagtcttaagactgaataggaagcaaaagttttaccaggaactcttatttaccttttcctt

SEQ ID NO: 76215 - DNA, 601 bp, Human
gattgcatatgtactgtttgctttcaaattaccttaagataattgctagagtgaagcagtatgtacttatatttggaaaatcatcaaagaatattgtaatgggggaggggtaattcctttttctcaaagtatgtgtcggtatctcaaacccaagttctgtgagtacctgttctgtaactaaatactgtgtatttgctccagatgtgaaagccatccagcagtcttaagactgaataggaagcaaaagttttaccaggaactcttatttaccttttcctttactatcaagttattcctgggrggccccctggtgcctgcagtcagtgttcactacctaagactttgtttcagatgtgaacatcttgctgggtctttgagaaatttgctttgaaaataattgtattttgtaactgttttatgagggaaatacagttaatttaaaaatgtgtatgtcttgtttacatttgggaagtagaggcctactcctttttattttttttttatttttattttttgagacggagtctcactctgtcgcccaggctggagtgcaatggcacggtctcagctcactgcaacctccgcctcccgggttcgagcg

SEQ ID NO: 76216 - DNA, 601 bp, Human
ttgctccagatgtgaaagccatccagcagtcttaagactgaataggaagcaaaagttttaccaggaactcttatttaccttttcctttactatcaagttattcctggggggccccctggtgcctgcagtcagtgttcactacctaagactttgtttcagatgtgaacatcttgctgggtctttgagaaatttgctttgaaaataattgtattttgtaactgttttatgagggaaatacagttaatttaaaaatgtgtatgtcttgtttacatttgggaagtagaggcctactcctttttattttttttttatttttattttttgagacggagtctcactctgtcgcccaggctggagtgcaatggcacggtctcagctcactgcaacctccgcctcccgggttcgagcgattcttccgcctcagcctcctgagtagctgggattacaggcaccccgccatcatgcccggctaattttttttgtatttttgtagagacggaggtttcaccatcttggcctggctggtcttgaactcctgacctcgtgatccacccgcttcagcctcccaaagggctgggattacaggcgtgagccatcgcgc

SEQ ID NO: 76217 - DNA, 601 bp, Human
ttatattttatttcattttccatatattttgtaggcataaaacagatttatgttttaaaatgtttgtatccttttaaattagacgcacctttatatgattacaggtacttaaacttcacgagtgggttgtgcaaggttactagaaaagacactgggggaaaaataagtgattccatttgtttttgtgaattcaaattaaatatttggtttgtacaatctgttttccttttttgggggggcggggggggcgggtaagaattgtagtccagacacgtttctctcttaatttagcaagcgttarcaagttgacctcctccttgccaggcaccagcaatcctaagataagacacagtctcttcactcaaggagctcccagtctaaacaagtgtctttcaggctttttcagcctcctctctgtcctatgttcagcacacattctatcagtacttcttcatcctacagaagcatatttagtttgacagtgcccccaagggattcttaaatattctaggtttttcagctccttcccagatccagacctgttgaaagacttgtccagagcagacttgaattttctagtaaataattatttttaatcttc

SEQ ID NO: 76218 - DNA, 601 bp, Human
ctgcctagcaagaataactatggttagtgtttttagtgtcaaatgaacgtgtaagtaaaaatttggcaagaatttctctgcattaggggaaaacattcagcaggacctgatctcattttaaaatgctgattgtagccccacaacatattcctgattgttttttcttttttactgtattaaatcgcagatcagctatacacacttctggtgactacattttatgagttgctttttgtttttcttttttaggtgggcgtattattgataagttttttttgttttttgtttttttgagacggarttttgcgcttgtcacccaggctggagtgcggtggggtgatgttggctcactgcaacctctgcccctgcaggtccaagcgattattctgcctcagcttcccaagtagctgggactacagcatgccaccacgccctggctaattttgtatttttagtagtttcaccatgttggcctggctggtctcgaactttccatcctcaagtgatccacccgcctcggcctcccaaagtgctgggattacaggcatgtgccaccgcgcctgaccttgatatgatattttcaaagagtcctttaggtcat

SEQ ID NO: 76219 - DNA, 601 bp, Human
gccccacaacatattcctgattgttttttcttttttactgtattaaatcgcagatcagctatacacacttctggtgactacattttatgagttgctttttgtttttcttttttaggtgggcgtattattgataagttttttttgttttttgtttttttgagacggagttttgcgcttgtcacccaggctggagtgcggtggggtgatgttggctcactgcaacctctgcccctgcaggtccaagcgattattctgcctcagcttcccaagtagctgggactacagcatgccaccacgcccyggctaattttgtatttttagtagtttcaccatgttggcctggctggtctcgaactttccatcctcaagtgatccacccgcctcggcctcccaaagtgctgggattacaggcatgtgccaccgcgcctgaccttgatatgatattttcaaagagtcctttaggtcattttaatacaaacatgccatttaatgtaaaacagaaatattgattttattatttggacggtgcatattctttcggtatgttttcttggattaacttttgcttagaactaaaaaccaaagacttctactttatccc

SEQ ID NO: 76220 - DNA, 601 bp, Human
gtggagatattgatgatatgtgcatatcccagagggaatagcgtttgctttttgatgcatgcccacccttgcataattgggaggttttaacatagcatatttcaccataaaggaattttattctaagaatgttaatcagaatatccctaagtaacagaagttcccatctggtcagttgcaaggtgaccaaaacactttcttggtttgagtatagtcatatgttctgtcaaatgatgttttggtcaacagtggacttcatgtaaggtagttagtggtcctgtaagattagaatggaactgaraaattcctgtcacttagtgacatcataggcataatgtcatagtgcagtgcattactcttgtttgtggtagtgctggtgtaaacctattgcactgccagttgtgtaaaagtacaacaggccacgcgtggtggctcatgcctgtagtcccagcactttgggaggccaaggcaggtggaccacttgaggtcaggagttcgagaccagcctggccaacatggtgaaaccccatctctactaaaaatacaaaaattagctgggcttggtggcatgcatatgcctgtaatcccagttactcaggag

SEQ ID NO: 76221 - DNA, 601 bp, Human
ctttttgatgcatgcccacccttgcataattgggaggttttaacatagcatatttcaccataaaggaattttattctaagaatgttaatcagaatatccctaagtaacagaagttcccatctggtcagttgcaaggtgaccaaaacactttcttggtttgagtatagtcatatgttctgtcaaatgatgttttggtcaacagtggacttcatgtaaggtagttagtggtcctgtaagattagaatggaactgaaaaattcctgtcacttagtgacatcataggcataatgtcatagtgcartgcattactcttgtttgtggtagtgctggtgtaaacctattgcactgccagttgtgtaaaagtacaacaggccacgcgtggtggctcatgcctgtagtcccagcactttgggaggccaaggcaggtggaccacttgaggtcaggagttcgagaccagcctggccaacatggtgaaaccccatctctactaaaaatacaaaaattagctgggcttggtggcatgcatatgcctgtaatcccagttactcaggaggctgaggcaggagaatcacttgaacctgggaggtggaggttgcagtg

SEQ ID NO: 76222 - DNA, 601 bp, Human
tcaatgtggtttgaattgagcgttttatttaaattactatcaaatacttgagccaaactagcgagacaaaaagaccagaccttttcttttttccgagatggagtctcacactgttgtccaggctggagtgcagtggtgcagtctcggctcactgcagcctccgcctcctgggttctagcgattctcctgcctcagcctcctgagtagctgggattacaggcgcctgccaccatgcccagctaattttctgtatttttagtagtagagatgggatttcactaaatctcgaacacctgacctygtgatttgcccaccttggcctcccaaattgctgggattactggggtgagccaccgcgcccggccgagaccagacttctgagggggagaaacttgcaaacctgtcagtgagaaagagtgaggtctgattttagatgacagaaaggaatagcttttgtgaatttcggactcccaactactagaattatgtgaatcctgaatgataatcagatgtttactcagttaagtgtttactcaaatattaataagtattgatacattgggatgccatcttatataatgattaacgacacagattctgg

SEQ ID NO: 76223 - DNA, 601 bp, Human
tagagatgggatttcactaaatctcgaacacctgacctcgtgatttgcccaccttggcctcccaaattgctgggattactggggtgagccaccgcgcccggccgagaccagacttctgagggggagaaacttgcaaacctgtcagtgagaaagagtgaggtctgattttagatgacagaaaggaatagcttttgtgaatttcggactcccaactactagaattatgtgaatcctgaatgataatcagatgtttactcagttaagtgtttactcaaatattaataagtattgatacattggkatgccatcttatataatgattaacgacacagattctgggtgtatttcagccccagtttcttctgcatatatgatagtaagtgccttcaaacaattcttgacacattaaaggtcagaaaatgttagccgtcattattgcttagtacaaacctgagctaggaaatactaacagagagctctttgtgccactgagtcctggaacttccccatactaattttgagaaggctttcttgtaagtatgtgacagatactgtttcctccactttctgtttattgcatataaccactattcttgtatgt

SEQ ID NO: 76224 - DNA, 601 bp, Human
ttttagatgacagaaaggaatagcttttgtgaatttcggactcccaactactagaattatgtgaatcctgaatgataatcagatgtttactcagttaagtgtttactcaaatattaataagtattgatacattgggatgccatcttatataatgattaacgacacagattctgggtgtatttcagccccagtttcttctgcatatatgatagtaagtgccttcaaacaattcttgacacattaaaggtcagaaaatgttagccgtcattattgcttagtacaaacctgagctaggaaatamtaacagagagctctttgtgccactgagtcctggaacttccccatactaattttgagaaggctttcttgtaagtatgtgacagatactgtttcctccactttctgtttattgcatataaccactattcttgtatgtaagtacgtataacagtttctttactattcccattattcagcgtttataatctggtttgacatatcagtgttggtgctgagagggaaaggtatttctaggtaggataaaatggtgaaaagtgatttaacactgttgtatgcttgcttttggccaggaactataggg

SEQ ID NO: 76225 - DNA, 601 bp, Human
ctttgggatggagcaggagtgctttgtgggcatttccattttatcatgtagattattaaagagatgtattcaaagattgaagtttaataaaattgatcatttgtactgctttaccaaagggcatacatgaagctgccttttttgtgtttcactgcatgtgtgttgcaatgaacaacacagtgactgactaccagtggggtttggtgccactgacttggtgtgtactgagacacttaacagttttacccatccttgcttttgtattatcaaagcagatgtcagtgcagtggaaaaaaaaaaagtcctttattcctgaaatgtctagccctcacctatatctgtcacttttcttcttcactcttttctcattatacttgctatttgtttaccaatgtacctgaaatgactttttacttatgctttgtgaattcatgaaagccatgggccttctcagaaaaatatttttacatatacacaatattacagacaatttgtggtactatacagagccactaaaggccattttggtctctgaatccacgttagttattcttttgttttgagacggagtctcactttgtcacccaggctggagtgcagt

SEQ ID NO: 76226 - DNA, 601 bp, Human
gaacaataatacgaatgatggctgatcgatcacctgaaactgtggaagacagaagacaatagaatggtgttctctttaaagcactgaaagaaaaaaaatgacaacctagaattctttatttattttgagatggagttttgctcgtgtggccgaggcttggagtgcaatggcgtgatcttggctaactgcaacctctgcctcccgggttcaagcgattctcctgcttcagcctcccgagtagctgggattacaggcatgtgccaccacgcctggctaattttgtatttttagtagaggcagrgtttctccatcttggtcaggctggtctagaattctaaatctagaatatccttcaatagtaaagtaaaatgaagacaaactaaagctcagaaaatatattgctgatatgctggcactagagaatattaaagcaagttctttgtgttgcaagaaaataacagataaaagcaaagaactgcagaaagaaatgaacaatggtaaggataaatgtgagtaaatacaaattctgactgtttaaaataatagttgtggcttgtgggatttaaaatatgtggaaacaaaaatacgacaactgtagaac

SEQ ID NO: 76227 - DNA, 601 bp, Human
gaagataccaattctgtctagacttacctacttattccccgctccccccccccacccttttttttttttttttgaggcagagtttcactcttgttgcccaggctgcagtgcggtggcacgatcgtggctcactgccacctctgtctcttgggttcaagcgattctcctgcctcagcctcctgggtagctgggattacaggcacctgccatcacgcctggctaatttttgtatttttagtagaggcggagtttcaccatgttggccaggctggtctcttcctgacctcaggtgatccacccrcctcggcctcccaaagtgctgggattacaggcatgagccactgtactcggccttattcccaatttaacacctcacaagtttgggggtggaggggctagacacaagccaattttaaaacatatttgaaagttcaaaaggaaaatctaaagaacaaaattgggatgtttatattactagataccgagactttataaaaagccatagtaattaagacattgtggtattgatgcaaaaatagacaaatggggtaatgagctatatagtggctaaaaacagacctgttcctgtatggtcacctga

SEQ ID NO: 76228 - DNA, 601 bp, Human
caagtttgggggtggaggggctagacacaagccaattttaaaacatatttgaaagttcaaaaggaaaatctaaagaacaaaattgggatgtttatattactagataccgagactttataaaaagccatagtaattaagacattgtggtattgatgcaaaaatagacaaatggggtaatgagctatatagtggctaaaaacagacctgttcctgtatggtcacctgatttttctacaaagctgccattgcggttcagtggggaaaaggatgatctttatgataaatggtgctgaatcaactkggtatctgcttagataaaaaccttgacctttacatcaaaccatacacaaaattaatttgagatgggttatagaatgaagtgggctaaaacaataaaatatctggaaggaaacataaggaaatatgtttagagaaggcaagaatttcttgaataagatgcaaaaggccttaaccaaaaaaagattgactaagattttttaagatttaaattcattaaagaacttctgttcatcaaaagatagcatgaagagatggaaaaagtccagttttaaagaatgaacaaaagacttaaaacgaactt

SEQ ID NO: 76229 - DNA, 601 bp, Human
gtcctcggggaaatcaaattaaatccaacgaataccaccatatacccaacaaaatgactaaaattaaaaatactgataatttgcagtatcagtaaagatatggaccaacagtgttaggaggattatgaattggtatagccactttgggaaactgatggtatctactacttaatgaaataaactgacccgagcagttctactgctttgttctatacatacctaagataaatatgcccatggatattcatagcatttgtaatagccccaaactggaaataatccaaatagagtagtaaagatwttgtcatatgttcatagaatggaatacaggttgaatattttttatccaaaatgcttgggaccccaagtgtttggaatttggatttttttcagatttttgagtatttgtattatacttaccagttaagcatccgtaatctgataatctgaaatctgaaatgctccaatgagcattttctttgagcatcatattagcactaaaaaaggtttcggttttggagcattttggatttcagattagggatactcagcctgtatttcaaatgactgttaaacacaattatatggatgtatctcacag

SEQ ID NO: 76230 - DNA, 601 bp, Human
ggatagtcttataaactagcatatttgctaaagcacatttgaatgttgtctgtgtctcctgtttattgcctcctttttacttttatattaatatattaatggaatatatagcttttgcatgtggaggcctttttttttttaaagcctcttattgacctggcaaaggaatcagcaatttttagcaagaaatatgtggaattttattttactttggagatggggtctcactctcacccaggctggagtgcagtggcacgatctcagctcactgtagcctctgccttctggggtcaagtgaacsttccacctcaacctctgccttgagtagctgggaccacaagcatgcaccatcatgcccagctaattttttgtattttgggtagagatggggtttcatcgtgttgcccagggcgatcttgcgctcctgagctcaagtgatccacccaccttggcctcccaatgtgctgggattacaggtgtgagccaccgtgcccggcctttatttttattttgcagagacagggtcttgctctgtcaccaagactgaaatgccctagtgccatcatagctcactgcagcctcaacctcttggcctcaagca

SEQ ID NO: 76231 - DNA, 601 bp, Human
gatgcgagataagcaggccagaccttaaagggtgcgggctctgaaatgtttttttgtgtgtgttttttttgttgttgttttttttctgtttgtttgttttttttttatttgagacggagtctcgctcttgttgcccaggctggagtgcaatggggcgatctcagctcactgcaacctctgcccccgggttcaagcgattctcctaactcagcctcccaattagctgggattacaggcatgcgccaccacgcctggctaattttgtatttttggagagatggggtttctccatgttgatcargctggttttgaactcccgacctcaggtgatccacccacctcaacctcccaaggtgctgggattacaggcatgagccaccgtgcccggccctgaaatcttttaagtctctttggctactaggccccaggttggtcacaggacagcaaaaaacaggactgcatttcatcaacagcagacttgaggagcatcatcaggaaccagtaacaatgaaaatagaagtcagagatcatagaataacattattttaaaccatgggaccaaatagggtaatttgctgcctgtgtgacttttctgattttt

SEQ ID NO: 76232 - DNA, 601 bp, Human; identical to SEQ ID NO: 25765

SEQ ID NO: 76233 - DNA, 601 bp, Human; identical to SEQ ID NO: 25766

SEQ ID NO: 76234 - DNA, 601 bp, Human; identical to SEQ ID NO: 25767

SEQ ID NO: 76235 - DNA, 601 bp, Human; identical to SEQ ID NO: 25768

SEQ ID NO: 76236 - DNA, 601 bp, Human; identical to SEQ ID NO: 25769

SEQ ID NO: 76237 - DNA, 601 bp, Human; identical to SEQ ID NO: 25770

SEQ ID NO: 76238 - DNA, 601 bp, Human
tcaaccagaaagggcttaagaattgagactgactattccagtggattttgtgtgctagtgaatttcttaaaacatcatacagggagcttgggatatatcaatgatagagattgaatacattgccactaattctacaaatggttttataatgcctctatcaagatatgatgtactgtaactgaaaatgaagatgccctttcctcctaaaccatactatgatgtttatggattatttaaaattcttaaaactgacttaactctttaaaaattatcttcttggctgggcgcggtggctcacacytgtaatcccagcactctgggaggccgaagcgggcggatcacgaggttaggagatcgagaccatcctggctaacacagtgaaaccccatctctactaaaaatacaaaaaattagccgggcgtggtagcgggcacctgtagtcccagctactcgggaggctgaggcaggagaatggcgtgaacccgggaggcagagtttgcagtgagcagagattgcaccactgcatcccagcctgggcaacagagcgagactccgtctcaaaaaaatatatatatatcttctcttagccactgcaattctt

SEQ ID NO: 76239 - DNA, 601 bp, Human
ttcttggctgggcgcggtggctcacacctgtaatcccagcactctgggaggccgaagcgggcggatcacgaggttaggagatcgagaccatcctggctaacacagtgaaaccccatctctactaaaaatacaaaaaattagccgggcgtggtagcgggcacctgtagtcccagctactcgggaggctgaggcaggagaatggcgtgaacccgggaggcagagtttgcagtgagcagagattgcaccactgcatcccagcctgggcaacagagcgagactccgtctcaaaaaaatatatatrtatcttctcttagccactgcaattcttagaaaatcaccatcaccatctcaacatccacccttcttttaatatcactacagttggacttttacccactccgttaccctcaatcaccaagaaacttgcattgaggtctgatgatttaattgtaagtggcacatttttggtcttcgtcctactgcccttgttcatggcacatttcctactttaggacgattgtttcccctttcgggatacgtttactatactaagccctttgtcttgatcattccttctcaatacctaatgttcattctccct

SEQ ID NO: 76240 - DNA, 601 bp, Human
cgggaggctgaggcaggagaatggcgtgaacccgggaggcagagtttgcagtgagcagagattgcaccactgcatcccagcctgggcaacagagcgagactccgtctcaaaaaaatatatatatatcttctcttagccactgcaattcttagaaaatcaccatcaccatctcaacatccacccttcttttaatatcactacagttggacttttacccactccgttaccctcaatcaccaagaaacttgcattgaggtctgatgatttaattgtaagtggcacatttttggtcttcgtcctrctgcccttgttcatggcacatttcctactttaggacgattgtttcccctttcgggatacgtttactatactaagccctttgtcttgatcattccttctcaatacctaatgttcattctccctcatctacctgcctattaaatgtttgaattcctcagaattcatttgctggtcttctcactttgtattcctaaggtggtctgagtccctcttaagatttccactaccattaatatgatgacaatactcaagtaaatatttttaaccctgacctcttttccagggctccaaacattaccaa

SEQ ID NO: 76241 - DNA, 601 bp, Human
gttcatggcacatttcctactttaggacgattgtttcccctttcgggatacgtttactatactaagccctttgtcttgatcattccttctcaatacctaatgttcattctccctcatctacctgcctattaaatgtttgaattcctcagaattcatttgctggtcttctcactttgtattcctaaggtggtctgagtccctcttaagatttccactaccattaatatgatgacaatactcaagtaaatatttttaaccctgacctcttttccagggctccaaacattaccaaagtcaaggrtctgatctgattttgttcttccacatttaaaaaaaaatcctcagggtctcagtagaaaatgtttttttttcgctcaagtgatctgtagatcaaatacaattccagtgaaatcacaattgagttttttatggaattaggcaattgtttttaatgtttatgtggaagaacaaaagatcaaaaagtaaccaagacaatcctgaaaaaaaaatggaggatactagccctaccaaatataaagacttattaaaaagctctagtctgttattggctcagggataagtaaaatagactaacagaata

SEQ ID NO: 76242 - DNA, 601 bp, Human
acctcttttccagggctccaaacattaccaaagtcaaggatctgatctgattttgttcttccacatttaaaaaaaaatcctcagggtctcagtagaaaatgtttttttttcgctcaagtgatctgtagatcaaatacaattccagtgaaatcacaattgagttttttatggaattaggcaattgtttttaatgtttatgtggaagaacaaaagatcaaaaagtaaccaagacaatcctgaaaaaaaaatggaggatactagccctaccaaatataaagacttattaaaaagctctagtctrttattggctcagggataagtaaaatagactaacagaatagactgtggtgctcagcagtggaaccgtaaggaaaggatgaactgttgaggaaataccactgggttgtttggttattcatatggagaaactacccaaaagatgaacagccttttccatgtattgttgtgctgtaagtgccatgcacatatttcctatatgtggaaagggttggaaagtactaccttaagaggccatggaagattatatttggtttgtatggttgctttaacaaaagtataagttacataggctggaatactt

SEQ ID NO: 76243 - DNA, 601 bp, Human
ttcttccacatttaaaaaaaaatcctcagggtctcagtagaaaatgtttttttttcgctcaagtgatctgtagatcaaatacaattccagtgaaatcacaattgagttttttatggaattaggcaattgtttttaatgtttatgtggaagaacaaaagatcaaaaagtaaccaagacaatcctgaaaaaaaaatggaggatactagccctaccaaatataaagacttattaaaaagctctagtctgttattggctcagggataagtaaaatagactaacagaatagactgtggtgctcagaagtggaaccgtaaggaaaggatgaactgttgaggaaataccactgggttgtttggttattcatatggagaaactacccaaaagatgaacagccttttccatgtattgttgtgctgtaagtgccatgcacatatttcctatatgtggaaagggttggaaagtactaccttaagaggccatggaagattatatttggtttgtatggttgctttaacaaaagtataagttacataggctggaatacttaggcaagtgatggtcattgtttagtaaaaggtaagagggcaagaaaggaactgaa

SEQ ID NO: 76244 - DNA, 601 bp, Human
ggaggatactagccctaccaaatataaagacttattaaaaagctctagtctgttattggctcagggataagtaaaatagactaacagaatagactgtggtgctcagcagtggaaccgtaaggaaaggatgaactgttgaggaaataccactgggttgtttggttattcatatggagaaactacccaaaagatgaacagccttttccatgtattgttgtgctgtaagtgccatgcacatatttcctatatgtggaaagggttggaaagtactaccttaagaggccatggaagattatattttgtttgtatggttgctttaacaaaagtataagttacataggctggaatacttaggcaagtgatggtcattgtttagtaaaaggtaagagggcaagaaaggaactgaaatttgatgtagatgtgctatattctataaatctgtaaattttgttcttaattgctgtatttctgtcctttaaaggtttgctctgtgatttgctatggtctgatccagataaggatgtgcaaggctggggagaaaatgatcgtggtgtttcctttacttttggagctgatgtagtcagtaaatttctgaatcgtc

SEQ ID NO: 76245 - DNA, 601 bp, Human; identical to SEQ ID NO: 25771

SEQ ID NO: 76246 - DNA, 601 bp, Human; identical to SEQ ID NO: 25772

SEQ ID NO: 76247 - DNA, 601 bp, Human; identical to SEQ ID NO: 25773

SEQ ID NO: 76248 - DNA, 601 bp, Human; identical to SEQ ID NO: 25774

SEQ ID NO: 76249 - DNA, 601 bp, Human; identical to SEQ ID NO: 25775

SEQ ID NO: 76250 - DNA, 601 bp, Human; identical to SEQ ID NO: 25776

SEQ ID NO: 76251 - DNA, 601 bp, Human; identical to SEQ ID NO: 25777

SEQ ID NO: 76252 - DNA, 601 bp, Human; identical to SEQ ID NO: 25778

SEQ ID NO: 76253 - DNA, 601 bp, Human; identical to SEQ ID NO: 25779

SEQ ID NO: 76254 - DNA, 601 bp, Human; identical to SEQ ID NO: 25780

SEQ ID NO: 76255 - DNA, 601 bp, Human; identical to SEQ ID NO: 25781

SEQ ID NO: 76256 - DNA, 601 bp, Human
acagcgccaccacctcggtgccctcctcgccggagcctcggacctcatccacgtccaccaccgtggcggcgggcgctcggggctcccccggggtccccgcccgtccggagcccgacggctcgggcccagcctcctggcgcccgcggcccccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcamgggagcgcagtccctgtggagtcgctgcgggtccgcgtggcgtgcccgggggaccctaaagaccgtcgggtgggggctgagggcgaggggcgggacaccggggccgcgggcggggcgcacccggaaccccgacagctgtgtcttggtggagctgtggactgcgcccgccgactcccacggccggggcggcgctgaagcagagagaggcctgggtgggagagccggccccgggcagggtgcgggcgttgaaaagtgcgtgtctgcaggtgccaacccgggctgtgaagactcatctcctgg

SEQ ID NO: 76257 - DNA, 601 bp, Human
gattttggcttctctacttcccagctacacgacttgggcatgttacttaatttctcagagcatgtttcctcatctgtgataagaggatggtgagagattaaataactcagtaaaacacccagtgtgtgcctggcatatagtaggggtttcataaatggtggcttccttacttgtctaccctaccagtgtgatctgctgcctcacagttacaagccctctaacctcagcattgaacccagcaaccatttactgaacagaggtttctgactgatgaaagggtatcatcaactgggcaaaacartattaacgtgacccatttaaattataccccaactgcagaaatcttccttaaatggtagctttcagtgatccagcatgtactgctttgctggtaactaggaaatgttaaaacttcagagccagcaggaagcaatataacacactattccttatttaatttcttttaacacctgtcatcccactaaagtggtaatcatttttttcttccactcattataaaaaagactggaggtagacaaaattttcccaagagttgtttctcctgcagaagcaaaagagacacctttctttgcattccctc

SEQ ID NO: 76258 - DNA, 601 bp, Human
ggctactttgtttacctactcaagcctcagcaatggtggacaccccacccccagcgaggctgcggcctcgcagatcaatctcagactgctgcgctagcagtgagcaaggctccttgggcatgggacccaccgagccaggcacgggagaggatcaccttgtctgcaggttgctaagagcttgggaaaagcacagtatttgggtgtgagtgtcctgtttttccaggtagtctgtcatggcatcccttagctaggaaagggaaatcccccgaccccttgtgcttcctgggtgaggcaacgcccygccctgcttcagctcaccctccatgggctgcactcactttccgaccagtcctggtgaggtgaaccagttacctcagttggaaatgcagaaatcacctgtcttctgtgtcgatcatgctgggcgctgtagaccggagctgttcctatttggccatcttctgtccggtttgttttaagtgattccaagcacatgtccagaggcttatcttccatgaaataacttccccattcattacaagccttaatgtctgaagttccatcattttaacacctccattaaggtgttgatctcaatagtctt

SEQ ID NO: 76259 - DNA, 601 bp, Human
ttagccattcgtctaatcttttttaaaggttttaagcttccttgcgatgggttcgaacatcctcctttagcttggaggagtttgttattactgactttctgaagcctacttctgtcaagtcctcaaagtcattctccatccagctttgtttcattgctggcaaggagctgcaaccttttggtttagaagaggcgctctgatttttagaatgttcagctttctgctctggtttctccccatctttgtggttttatctacctttggtctttaatgttggtgacctacagatgtggttttggcrtagatgacctttttgttgatgttgatgctattcctttctgtttgttagttttccatctaacagtcaggtccctcagccgcagatctgttggagtttgctagagttccactccagaccccgtttgcctgggtatcaccagcggaggctgcagaacagcaaatattgctgcctgatgcttcctctgaaagcttcatcccaggggggcagccgcctatatgaggtgtctgttggcccctactgggaggtgtctcccagttacactacacgggggtcagggacccacttgagggggcagtctgt

SEQ ID NO: 76260 - DNA, 601 bp, Human
ttcttgtgccatggttttcagctccatcaggtcatttaaggtcttctctatactgtttattctagttagccattcgtctaatcttttttaaaggttttaagcttccttgcgatgggttcgaacatcctcctttagcttggaggagtttgttattactgactttctgaagcctacttctgtcaagtcctcaaagtcattctccatccagctttgtttcattgctggcaaggagctgcaaccttttggtttagaagaggcgctctgatttttagaatgttcagctttctgctctggtttctcyccatctttgtggttttatctacctttggtctttaatgttggtgacctacagatgtggttttggcatagatgacctttttgttgatgttgatgctattcctttctgtttgttagttttccatctaacagtcaggtccctcagccgcagatctgttggagtttgctagagttccactccagaccccgtttgcctgggtatcaccagcggaggctgcagaacagcaaatattgctgcctgatgcttcctctgaaagcttcatcccaggggggcagccgcctatatgaggtgtctgttggcccc

SEQ ID NO: 76261 - DNA, 601 bp, Human
gaagcttagtttggctggatatgaaattctgggttgaaaattattttctttaagaatgttgaatgtaggcccccactctcttctagcttataggatttctgccaagagatccactgttagtctaatgggcttccttttgtgggtaactcgacctttctctctggctgcccttaacactttttccttcatttcaaccttggtgaatctgacaattatgtgtcttggggttgcttttctcaaggagtatctttgtggtgttctctgtatttcctgaatttaaatgttggcctgccttgctagrttggggaagttctcctggataatatcctgaagagtgttttgcaacttggtccattctccccatcactttcaggtacacaaatctgccaagaccagctcggtcagggagacctttacccagtggtgctaaaggaatttaaagacacacacacagaaatatagaggtttgaagtgggaaatcaggggtctcacagctttcagagctgagatcccggaacagagatttacccatgtttttattaacagcaagccagtcattagcattgtttctatagatattaaattaactaaaagtatccct

SEQ ID NO: 76262 - DNA, 601 bp, Human
tcttctgctagcttttgaatttgtttgctcttgcttctctagttcttttaattgtgatgttagggtgtcaattttagatctttcctggtttctcttgtgggcatttagtgctataaattttcctctacatcctgctttaaatgcgtcccagagattctggtatgttgtgtctttgttctcattggtttcaaagaacatctgtatttctgccttcatttcgtgatttacccagtagtcattcaggagcaagttgttcagtttccatgtagttgtgtggttttgagtgagtttcttaatcctragttctaatttgattgcactgtggtctgagagacagtttgttgtgatttctgttcttttacatttgctgaggagtgctttacttccaattatgtggtcaattttagaataaatatgatgtggtgctgagaagaatatatattctgttgatttggggtggagagttctgtagatgcctattaggtctgcttgttgcagagctgagttctggtcctggatatccttgttaactttctgtgtcattgatctgtctaatgctgagagcagggtgttaaattttcccattattattgcatgggaa

SEQ ID NO: 76263 - DNA, 601 bp, Human
ctatttgaatctactctcttttcttctttattagtcttgctagcggtctattttgttaatcttttcaaaaaaccagctcctggattcattgattttttaaagggtttttttctgtctctatctctttcagttctgctctgatcttagttacttcttgtcttctgctagcttttgaatttgtttgctcttgcttctctagttcttttaattgtgatgttagggtgtcaattttagatctttcctggtttctcttgtgggcatttagtgctataaattttcctctacatcctgctttaaatgygtcccagagattctggtatgttgtgtctttgttctcattggtttcaaagaacatctgtatttctgccttcatttcgtgatttacccagtagtcattcaggagcaagttgttcagtttccatgtagttgtgtggttttgagtgagtttcttaatcctgagttctaatttgattgcactgtggtctgagagacagtttgttgtgatttctgttcttttacatttgctgaggagtgctttacttccaattatgtggtcaattttagaataaatatgatgtggtgctgagaagaatatatattc

SEQ ID NO: 76264 - DNA, 601 bp, Human
ctttctatgtttgggtagccagttttcccagcacgatttattaaatagggaatcctttccccattgcttgtttttgttgggtttgtcaaagatcagatggttgtagatgtgttgtgttatttctgaggcctctgttctgttccattggtctatacctctgttttggtagcaataccatgctgttttggttactgtagccttgtagtatagtttgaagtcaggtagtgtgatgcctccagctttgttccttttgcttaggattgtcttgacaatgtgggctctttttttggttccatatgarctttaaagtagttttttcaagttctgtgaagaaagtcattggtagcttgatggggatggcattgaatctataaattactttgggcagtatggccattttcatgatattgattcttcctatctatgagcatggaatgttctcccatttgtttctatcctcttttatttagttgagcagtggcttacagttctccttgaggaggtccttcacgtcccttgtaagttggattcctaggtattttattctctttgtagcaattgtgaatgggagttcactcatgatttggctctctgtttttct

SEQ ID NO: 76265 - DNA, 601 bp, Human; identical to SEQ ID NO: 37708

SEQ ID NO: 76266 - DNA, 601 bp, Human; identical to SEQ ID NO: 37709

SEQ ID NO: 76267 - DNA, 601 bp, Human; identical to SEQ ID NO: 37710

SEQ ID NO: 76268 - DNA, 601 bp, Human; identical to SEQ ID NO: 37711

SEQ ID NO: 76269 - DNA, 601 bp, Human; identical to SEQ ID NO: 37712

SEQ ID NO: 76270 - DNA, 601 bp, Human; identical to SEQ ID NO: 37713

SEQ ID NO: 76271 - DNA, 601 bp, Human; identical to SEQ ID NO: 37714

SEQ ID NO: 76272 - DNA, 601 bp, Human; identical to SEQ ID NO: 37715

SEQ ID NO: 76273 - DNA, 601 bp, Human; identical to SEQ ID NO: 37716

SEQ ID NO: 76274 - DNA, 601 bp, Human; identical to SEQ ID NO: 37717

SEQ ID NO: 76275 - DNA, 601 bp, Human; identical to SEQ ID NO: 37718

SEQ ID NO: 76276 - DNA, 601 bp, Human; identical to SEQ ID NO: 37719

SEQ ID NO: 76277 - DNA, 601 bp, Human; identical to SEQ ID NO: 37720

SEQ ID NO: 76278 - DNA, 601 bp, Human; identical to SEQ ID NO: 37721

SEQ ID NO: 76279 - DNA, 601 bp, Human; identical to SEQ ID NO: 37722

SEQ ID NO: 76280 - DNA, 601 bp, Human; identical to SEQ ID NO: 37723

SEQ ID NO: 76281 - DNA, 601 bp, Human; identical to SEQ ID NO: 37724

SEQ ID NO: 76282 - DNA, 601 bp, Human; identical to SEQ ID NO: 37725

SEQ ID NO: 76283 - DNA, 601 bp, Human; identical to SEQ ID NO: 37726

SEQ ID NO: 76284 - DNA, 601 bp, Human; identical to SEQ ID NO: 37727

SEQ ID NO: 76285 - DNA, 601 bp, Human; identical to SEQ ID NO: 37728

SEQ ID NO: 76286 - DNA, 601 bp, Human; identical to SEQ ID NO: 37729

SEQ ID NO: 76287 - DNA, 601 bp, Human; identical to SEQ ID NO: 37730

SEQ ID NO: 76288 - DNA, 601 bp, Human; identical to SEQ ID NO: 37731

SEQ ID NO: 76289 - DNA, 601 bp, Human; identical to SEQ ID NO: 37732

SEQ ID NO: 76290 - DNA, 601 bp, Human; identical to SEQ ID NO: 37733

SEQ ID NO: 76291 - DNA, 601 bp, Human; identical to SEQ ID NO: 37734

SEQ ID NO: 76292 - DNA, 601 bp, Human; identical to SEQ ID NO: 37735

SEQ ID NO: 76293 - DNA, 601 bp, Human; identical to SEQ ID NO: 37736

SEQ ID NO: 76294 - DNA, 601 bp, Human; identical to SEQ ID NO: 37737

SEQ ID NO: 76295 - DNA, 601 bp, Human; identical to SEQ ID NO: 37738

SEQ ID NO: 76296 - DNA, 601 bp, Human; identical to SEQ ID NO: 37739

SEQ ID NO: 76297 - DNA, 601 bp, Human; identical to SEQ ID NO: 37740

SEQ ID NO: 76298 - DNA, 601 bp, Human; identical to SEQ ID NO: 37741

SEQ ID NO: 76299 - DNA, 601 bp, Human
gctggagtgcagtagcacgatctcggctcactgcaagctccgccttccgggttcatgccattctcctgcctcagcctcctgagtagctgggactacaggcgcccaccaccacgcctggctaatttttttgtatttttagtagagacggggtttcactgtgttagccaggatgttcttgatctcctgacctcgtgatccgcccaccttggcctcccaaagtgctgggattacaggcgtgagccaccacgcccggccatgtttgtaccttttcacccacttctcatcatcctctccactcacmcttcccagtctctgttatctattttcccactctctacctccatgtgttcaaatttttagctcccacgtatgcgtaagaacatgtgatatttgtctttttgtgcctggcttatttcacttaagataatgatcttcagttctatccctgttgctgcagatgacaggatctcattcttttttacggctgaatagtactccattgtgtatatgtaccgcattttgtttatccattcatctgttgatggatacttaacgttgattctatatctttgctattgttaatagtgctgcaataaacagg

SEQ ID NO: 76300 - DNA, 601 bp, Human
catactccttagtcaagaaatgaaatatattgaaatttgtgcatgtaaaaggaggattattggaacaataccataaaattgcctgaattgcctgcaacccaactgtagaaagtgctgtcagacctcatagacctagacatttaccaaatagtcattctctttatctctttactttgattcaatatgggcatagttgcattcacctattattctctgcagattggctttctccatttattttgctgatcgtggttaaaaacagttaaccagtgatgagtctgcccaacctcaccattgcctrccatcacttactctgctatagtgcccatatcttggttcaaattcactggtgagacattcagatgtgtagcttgtctgataatggttgaatgtctttgagtgagggtccaaacctggttgcatgagttgtgaccctgtgggtggggagtggatgcgaacaacccaatagcccactgcttactccataggggatgtaggatggagaaggctctctgagaagaaggcatgaactgtgcagatgagatgacttagaaaatgactgtctctttgtaatctatcattaaactgtacttattcttta

SEQ ID NO: 76301 - DNA, 601 bp, Human
tcagaagagaagctgtaaaattgcagtgtgacttgatgtctgaggtctcaattggcttcattgatcttgtagatggaagtgtggaggagaaagaacgactataaaaataaaggaattgagctgagtgcagtggcttatgcttaaaatcccagcatctcaggaggctgaggcaggagagtcactcaagggcaggagtttgagatcagcctgggcaaaatagtgagacctccatctctacaataaataaacaaattagccaggcatggttgcatgcacctgtagtccaagctgcttgggaggytgaagtgggaggatcacttgagcccagtagttcgaggctgcagtgagctatgattttgtaccactgcactccagtctgggtgacagagtgagaccctgtctctaaaatgaaatgaaataaagaaattggaacacaggaggcaaaggaataatgtttcctattataatttaattaaaaccttaatttattttacaagtgagctttatagttttgttatttgtacaagtcataatcccactttattgtaagttagccagacagtttaaaatgaagacactccagaacagtggttaagtgttc

SEQ ID NO: 76302 - DNA, 601 bp, Human
tttagatgcatgtataatttttttatataaagaatgagatggcaacccaatttacttttttagcccggataactatctagttgtttcaacacaatttgtggaataatctgtttctattcttaagtttgaaagacaaacctcatgctgcattaacttcttatgtttatttggattcaattctggactgcttctttatttggttccactaatgtgtttgattatttatcatatgcctcatttaaataattgttcaatagtttacctcagtcaacctttttttcataaatttttgtctcatttktactttcaagtccagtttcagtgcattctacttcttgttttttcttattttcaaaatgtaaatgcaaagaatacaatatatttagtattttatgtaacttacaagtaatttatccctacttttctaagaagttggaaacatttcacctttcatttcacttgatcctgacatacttaaggggtgcttatcattttctcgagttggttccaagttgttgctgtttcctattaccaggtgctaattcctacctggtttcactgtgcttactccttctccaatactctcaacgattccagcccc

SEQ ID NO: 76303 - DNA, 601 bp, Human
tttaaagcattcatatatatatatacacacacatatatgtgtatatatatatttctttaaattagacatgtattttgtttgcctttttttatttaaaaattgcttttaaagaaattatttctatattaagaaaattggtccattgtcatactgggttttgacttttggggttttttttaaacatgcagaatctatgtaatttttacattgtcaaatttatctatataaatatctattttatatctgctgggtatttttttgtattgattaaaatttccttccctcctccaagataatacatttctcccatgttattttatagtacttctatggttttgcttttcacatttaatttttagatgcatgtataatttttttatataaagaatgagatggcaacccaatttacttttttagcccggataactatctagttgtttcaacacaatttgtggaataatctgtttctattcttaagtttgaaagacaaacctcatgctgcattaacttcttatgtttatttggattcaattctggactgcttctttatttggttccactaatgtgtttgattatttatcatatgcctcatttaaataat

SEQ ID NO: 76304 - DNA, 601 bp, Human
cttttaaaatgttttttatttttaatatgtctgaggttgggcatattttaatgtgtttaaagcattcatatatatatatacacacacatatatgtgtatatatatatttctttaaattagacatgtattttgtttgcctttttttatttaaaaattgcttttaaagaaattatttctatattaagaaaattggtccattgtcatactgggttttgacttttggggttttttttaaacatgcagaatctatgtaatttttacattgtcaaatttatctatataaatatctattttatatctkctgggtatttttttgtattgattaaaatttccttccctcctccaagataatacagttctcccatgttattttatagtacttctatggttttgcttttcacatttaatttttagatgcatgtataatttttttatataaagaatgagatggcaacccaatttacttttttagcccggataactatctagttgtttcaacacaatttgtggaataatctgtttctattcttaagtttgaaagacaaacctcatgctgcattaacttcttatgtttatttggattcaattctggactgcttct

SEQ ID NO: 76305 - DNA, 601 bp, Human
ttcccacccccagccttttaaaatgttttttatttttaatatgtctgaggttgggcatattttaatgtgtttaaagcattcatatatatatatacacacacatatatgtgtatatatatatttctttaaattagacatgtattttgtttgcctttttttatttaaaaattgcttttaaagaaattatttctatattaagaaaattggtccattgtcatactgggttttgacttttggggttttttttaaacatgcagaatctatgtaatttttacattgtcaaatttatctatataaatayctattttatatctgctgggtatttttttgtattgattaaaatttccttccctcctccaagataatacagttctcccatgttattttatagtacttctatggttttgcttttcacatttaatttttagatgcatgtataatttttttatataaagaatgagatggcaacccaatttacttttttagcccggataactatctagttgtttcaacacaatttgtggaataatctgtttctattcttaagtttgaaagacaaacctcatgctgcattaacttcttatgtttatttggattcaat

SEQ ID NO: 76306 - DNA, 601 bp, Human
taagtaacttcccctcactttctattcttttatataaaccacgtttagccagaaaaaccaccactttttttccccttcatttttgaaatgaacccgtttaatcgtgactagtaaatatttttcttggaaacttatctcagatctgacatgaaagacgactgaaagtgaaaagcacattgatttataaggtcattaatcaaattttaatcttatcttgcttaaaacttctggctttgaaattatatgaaagttctagatttagtatctgggatagtgaacaaatttgtaagagtacacagayggcaccagctgagatgtcatggaacacaaggaaaattaaatagagcaaagtggagggaattttagaaagctcattcaactataatctaaacgatgactggtaaaagtattggtaattttcactccagaggattacataccagaacgtccagatttccaatggcctcaaagcagaagtctataccagcatctgtcatatcaaataaaacttcttgaatgggtttctttaagtcctgagggttgaggcactcagtagcacccaattcctgtgccttcttaaatttctccttgttgacatcca

SEQ ID NO: 76307 - DNA, 601 bp, Human
ccctttatattgggtattcatatgttgaaaaaaaaaatctgtaatataaagctgttgttttatgtcctttcttaagcgtttatggtacatttttctatttcccaccttcacctcctcaggcatttccacctttccctgcttcatccatacctccaaaaacagaacccttcaaagaacgtcctgagaagaacaactggccactgattttgagttgaacactggcaggcaacaccccaacaaccacacagaccccatagctctcattgcaggaggcgagggcagctgcctgttagaaagtgaygcaatacagtataggggttaaaagatgtatgtgaggattgagcctacatcttaatttcagcttaactcctaaatggtctatgactttcttttctgattctccctattctcatttgaagtaacatttatcttgtaaggatgctatgaaacacatataagacgttgtatgttgcttagtatagtacctggcactttaggactcaataaatggaaataacaaaaatgaaaatagtaaaaacatccacagtagtgataataataaaaataatttttataaaaattattactgatgcaggtggct

SEQ ID NO: 76308 - DNA, 601 bp, Human
cttgacaattacttgcttttcttggttctagcttaggttaggctccccaacttcttctccaaactaccacaaactcttctaatagatttatttttaatttaagtttgtttctgttatgtgtaaccaagaatactaattactgttctatgtcatgacatgaagggccagtgtatatttctatttgtttttatattttgattggtgatctgataaaacatttttacatctatgtcaaccctccactttttttcttatttcaaccaaatgacataggaaagaaaattctaggaccacagacggkactaggcagtgtttctcaacaagggcactactggcattttgggtggggaacattctttcttttgcacattgtgggaggtttagcaggactgtccaacacctgttaaatgctattgttgattgaaaatcattgaaccagaggactatactatttgtggaataaactaatttacattaatgatcactatatgagtgctagagtggccagtgaattagtttcattcactgagggttttaagaatattggtaatcttatttttataagacttagctgagtatgtgtattttgaattaacattat

SEQ ID NO: 76309 - DNA, 601 bp, Human; identical to SEQ ID NO: 39292

SEQ ID NO: 76310 - DNA, 601 bp, Human; identical to SEQ ID NO: 39293

SEQ ID NO: 76311 - DNA, 601 bp, Human; identical to SEQ ID NO: 33707

SEQ ID NO: 76312 - DNA, 601 bp, Human
tccctttacattctctctacttgtcatttccctctctctcagctccccaggctctacaatcctatcatctagcagcagaggagcagctgtccttccgcatgctccaaacttcctcctttgccaaccacagctgggcacacagtgagggctcaggatggctgggtgacctgcagactcatggctgggacactgtcttgggcaccatccgctttctgaagccctggtcccatggaaacttcagcaagcaggagctgaaaaacttacagtcactgttccagttatacttccatagttttatccrgatagtgcaagcttctgctggtcaatttcagcttgaatgtaagttcgttgctctaagctgataatttgcctgggaacaccaactattttccaaagtggaagatagtatatagactctgaccatcatttaaccttactaaccttgttccccactctctgactcccactccctcctctgcttcacccttcaccaccacccacactccaccatatacacaaaagggcctgcatgtacatatctcaacatgaatatagcttcatgtctggctctttggaatgattgtctcctctggatcttctg

SEQ ID NO: 76313 - DNA, 601 bp, Human
tctaggtcaccagccaccaatggtcaggaatgaacctccctcatagcctgggagctttcacctgtaaattcatctatactctttgaaccaatgtttgtttttatttcttagggcatcaagtcacataaatcgctcacactgtgaggcagggactctttttaaaatatttggtccaagttaaggtttccttgtgagcagatcagtatccactctcctcctacttttggatacttgaatacccttgtccaggtctttccagcctctgtcttcctggcttctctcctatccccagactctaccrattaaaatccctctctgtcctgtgctgtctactctcttgatgcctctttcagaagccttgtttcttggcatgcagtagaaacagcttcaagcttaattctcggcagtgtagtttaggcaagaggtaatgttttctctggtttgtgatgctcttcctgacagcgtctgggtctttgcctattttttctctgcctgcaggcaatatgtgaagctggtgatgtctttacattaatttctggatctcggaaatgataactccaagtccattgtagaaatgacctcaggcttgtcctctttatct

SEQ ID NO: 76314 - DNA, 601 bp, Human
tgtccacgtacccaagtgtctgtggttggcacgaatctcagtgaaaaattcccttgaaatccccacaccaggggcactctcaaaacttcaaaaatctgccttctcatttcttggttcccccttcatgctctgaggatgaggttttcactgaatccactcttgcttggtgaggctgatgacagtcaggcctcatggtgagctctttgtggatttagaggtgccttgcccaggtctaagccctcagagaaaacattctagtctctctcattctctgacccagaggtcggagtataagtgagcsctatggggctttctggctggtgaaaggctggctcttccactcccactgaggggagctctcccttgttaacctctgtgtcctctgcagaagtggaagtgagttgggcccttggctgcctctcatcatagactcttcacatccatagttctcagagctcagtcaccccttggctgtgggggtaagagtctctccccatctaggccaaatgcattggtatgatttggtttgaccttgctgtttattgatataagacttaaagcttcagattagggcaagtccatgtaaggtggggcctggtgc

SEQ ID NO: 76315 - DNA, 601 bp, Human
gcatcatcctggtgggatttgatgtttctcatctcatatgagaagatctgagctgaacaggagaagtttgattctcagaccatgcacacaccgtgggagagtcttgaaaggcccagagagtgcccatcttgctctgtgcttccccttggccttggctgctctggctttaagcctgtaatctatccagagagggtaccatgcctggagtttgggctggttccctgaatctttgtgagctattttctgcccatccagcaagatagagtgcttgttctcctgcttacctcacaaagataaagatttcaaacagttcaaaattctcctacttctcgttagtgtggcatagggtaccctggcacacccagggcaagaaagacaatcatgccccatgccacccccaggtttcatggggccagaggtagaaatggggctgaggccgggcgcggtggctcacgcctgtaatcccagcactttgggaggctgaagtgggcggatcacaaggtcaggagatcgagaccatcctggctaacacggtgaaacaccttctctactaaaaatacaaaaaataattagccgagcatggtggcgggcacctgtactc

SEQ ID NO: 76316 - DNA, 601 bp, Human
caccagcctgggcagagccaggccagggctctcctgccatcattgtttgattgagctttcaggctgtctctgtgcaattgcaagaggtagcacctgtcccatgaaccagtagggctgggttcgaaagctgacagccatctctaaaatgcagattttaagtggtatcttagttatatcccattttttaatctatataaatataaaatataatttttatataatttaattatagttatatacacaatttaattacagtaataataatgagagtggtaataattaagcaggatttataatgtaygaagcacagtgctaagtaaaatatcataatctcatctaatcctccaatagccctatatgatgcaggcattattattgttatcattattattatctccattttgcagatgaggaaactgaggtacagaagggttaaggaacctacacaaggatcaataataagaggaggagctggtatttcaatacgagagaagatttggaagggcaggcagcacgcattcattgttaacagctgtgtacttgcggggcagtgtgattcgcatgggtggactcacactttttacttcatgcatttgtgtaa

SEQ ID NO: 76317 - DNA, 601 bp, Human
gagaagaacaacaaatagaattctggcttcctcctgctgtagcagtaacattttaggatcggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccgtgcagcccgtgcaacccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgctggtgttgtgtgaaagtcttttggttaaacccactgc

SEQ ID NO: 76318 - DNA, 601 bp, Human
ctggcttcctcctgctgtagcagtaacattttaggatcggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccgtgcagcccgtgcaacccctgcaacccctgcagcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgctggtgttgtgtgaaagtcttttggttaaacccactgcaggagccctgcagagttagtga

SEQ ID NO: 76319 - DNA, 601 bp, Human
gcagtaacattttaggatcggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccgtgcagcccgtgcaacccctgcaacccctgcarcccctgcaacccgtgcagcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgctggtgttgtgtgaaagtcttttggttaaacccactgcaggagccctgcagagttagtgaacattggaataattagtgg

SEQ ID NO: 76320 - DNA, 601 bp, Human
cggtgaatgtatgcggttttgaacccgatcaagtcaaagttcgagtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccgtgcagcccgtgcaacccctgcaacccctgcagcccctgcaacccgtgcarcccatatgatccttgcaacccgtgttatccctgtggaagccgattttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgctggtgttgtgtgaaagtcttttggttaaacccactgcaggagccctgcagagttagtgaacattggaataattagtggatgggaatagaaggacga

SEQ ID NO: 76321 - DNA, 601 bp, Human
gtgaaggatggaaaggtatgtgtgtcggctgagcgggagaacaggtacgactgccttggatcgaaaaagtacagctacatgaacatctgcaaagagttcagcttgccgccctgtgtggatgagaaggatgtaacatactcctatgggctcggcagctgtgtcaagatcgagtctccttgctacccttgcacttctccttgcagcccgtgcagcccgtgcaacccctgcaacccctgcagcccctgcaacccgtgcagcccatatgatccttgcaacccgtgttatccctgtggaagccgaytttcctgtaggaagatgattttgtaaagtgcgcataggaacccattacttaatagaagtcagttactccagccaggcagctctcccaatgtttctcctctccttcccatggcccctgttgttgaagtacgtaggaaactgaatacataactgcaatctgctggtgttgtgtgaaagtcttttggttaaacccactgcaggagccctgcagagttagtgaacattggaataattagtggatgggaatagaaggacgatatggtgagatccaccctcccattccctcctccatactcaacta

SEQ ID NO: 76322 - DNA, 601 bp, Human
cccgcagctctttgggctaatccgtccgggaactcttcggactgtcccctcgcgttttggaaaagtcagcagcctggccaagcagcctggccttgcgagtcgccggctggtctgaaactagtcctgggcaaggacgcccccagagctgcggtgcagggtggagggtaggtgggattcgctagcacccctcaacctcctctcacccggtggtccccagctcctggcccctttcctggtctggtcaccagatgttggctttatgcccagccatttctacgtcgagtatgtgtgggggtgggakgaaggagtgactaagcaaaattaggaagggcatgagcttggacgaaagacatccccaggacccttcagagacccccacccgctccagccctgtcattcagaatgggaggaagggaggaggggcagtttatgcgtggaaatgtgcaccaccgagctatttatactaaaaagttagaaacgaccaagatactctgcaatacgggattctaaataaattaaggttcatctacttaagttattagacagttaaataacttagtatgagaaccagctaagtgccttggcaatgttaagttgcaaa

SEQ ID NO: 76323 - DNA, 601 bp, Human
cacctcctactacatacacagtgaagttgatccccactgagtatgaatagagatgtcttgaagccagatcttaaacccagaggtcttacgtagtgatatctgcaaaaagggggcataaatgcaccctagagctcgctgtcagatgcaaggcaggttcactgccaaactgatggggaggagggaatgaaaatataaatgtactgcaaaattaatttacagggttccttattttacatgttcctgtctttataattttacagctgactttagatcgtactagtataatggtgaggaacaacasacactggggcctatcgaagggtggagggtggaaggagggagaggatcaggaaaaataactaatggatactaggcttaatacctgggtgaggaaataacccatatagcaaacctccaatgatgcacatttacctgtgtaacaaacctgcacatcctgcacatgtacccctgaacttaaaagtaaaaaaaaaaaaaaaaaaaaaatctaaagaagggatcatactggtatagtaattaattgaggtagttagaatagcagtgaaggaagggctaaaagatgctctgatctcaaatcttgata

SEQ ID NO: 76324 - DNA, 601 bp, Human
aaaattaatttacagggttccttattttacatgttcctgtctttataattttacagctgactttagatcgtactagtataatggtgaggaacaacagacactggggcctatcgaagggtggagggtggaaggagggagaggatcaggaaaaataactaatggatactaggcttaatacctgggtgaggaaataacccatatagcaaacctccaatgatgcacatttacctgtgtaacaaacctgcacatcctgcacatgtacccctgaacttaaaagtaaaaaaaaaaaaaaaaaaaaaawctaaagaagggatcatactggtatagtaattaattgaggtagttagaatagcagtgaaggaagggctaaaagatgctctgatctcaaatcttgataacttagttattttgctaatggctatgtagaaaaatggcaaattggccgggcacagtggctcacacctgtaatcctagcactttgggaggccgaggcaggcagatcatctaaggtcaggagttcgagaccacactggacaacatggtgaaaccctgtctctactaaaaaatacaaaattagctgggcatggtggcatgcacctat

SEQ ID NO: 76325 - DNA, 601 bp, Human
gggggatgcatgaatgaaggatctgtgaagttaagcaggacacaaaaggggtataatcacaggtgagactgggtcagtgagcctgtgctctggtagcaatggaagacagttcagagtagggctggagagaactggagaccatttcaataatcaaatgcagtgaggatggtggggcatttgagaaatgtgtaatacacttggcataaccctgtgataggttggatgtgggaggtgagaagctaacctacaacatctgaattctgtgccaatgttttccctcgacaattgtttgagtaaattwgattcttttttttttttttttttgagacagagtctcactctgttgcccaggctggaatgcagtggcacaatctcaactcactgtaacttccaactcccaggttcaagctattctcctgcctccacctcacaagtagctgggattacaggcacctgccaccatgcccagttaatttttgtatttttagtagagatggagtttcaccatgttggccaagctagtctcaaactcctgacctcaagtgatctgcctgcctcagcctcccaaagtgctgggattacaggcgtgagccaccgcgcc

SEQ ID NO: 76326 - DNA, 601 bp, Human
ctctggagaagagaggctatgtgaaggctgggctctggactccagaggcagtgatagaacacccagatgcaggttggtgtccacatccccaagagtgtctacctgagtggtattttatttaaatctgattgagagaagatcaagaaaaaaataacaactgtttcaaaggggtgttttgcttgctaagattgccaagatgtggagataatggcagtatacaggcggaagtatatggaagaaaatgacctctctctctctcatacacacacctacccacatcacacacccacccatccacacrcccacacacactcccacacacacacatccatgcactcacaccccaaccccacatccacacacaccccacatccacacccacatacaccacaaacacacatacacacccacacaacacactctcacacacacacacactctcatacacacacacatctgcatcttaatgtacaggcagtgctaaaatagacatcttaatatttgttccatgaatatttaccttgtagatatacagagtttccttaaaacagcaaaactgttcctgcttctgattcaccctgctgacaatgtgcatggttaa

SEQ ID NO: 76327 - DNA, 601 bp, Human
tatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgawccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgt

SEQ ID NO: 76328 - DNA, 601 bp, Human
tatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgatccctgaatgaaaaactatatgttattgttataggaatgaaaatgtttactcaraaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtg

SEQ ID NO: 76329 - DNA, 601 bp, Human
ctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggwggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaccttcccttcccatcttgctaccatggtttctggcctcctcagattcaaag

SEQ ID NO: 76330 - DNA, 601 bp, Human
aactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaamcttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtc

SEQ ID NO: 76331 - DNA, 601 bp, Human
aatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaartaatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttct

SEQ ID NO: 76332 - DNA, 601 bp, Human
agtcccagctacctggggggctgaggcaggaggattgcttgaatccaggaggtctaggctgcagtgagccaagattgtgccactgcactccagcctgggcaacagagtaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttc

SEQ ID NO: 76333 - DNA, 601 bp, Human
tcataacagcaacccttcctgcgaaatttatattccctgagaattggaggattattgggcatcttgagggataagtagaaataccaacagataaaaagtgtgaagaagcctgtagatggagggtggaagaagtctgagtgggacatttactcagatgagccataattgacactcctttcctgtcgaagtgtgaaggagtacatccatctttctttggcttttaagaatcgaatcaatgaatgcaagaatattatttcacttgagtatttctctccacaaacctaatgaattcttggctttstagatacataacgttctttttttttcccttaagtcagaatgtgtagttagttgtggaaatagcctaccagtatgtgtccatgcgtgcagggctaggcctgtcttcttggcttctgttgcatggtaggtacttaggcgacgttagggaatggatagtagtagggatactgttggctctgttgaggaatttgtagagggaaattccttctgttgggtgctctgtgaaactaataaggcagtgtgaaatactgtacttatttcagagaccggctgtgaggcttaagtagaggtgcagcattca

SEQ ID NO: 76334 - DNA, 601 bp, Human
tttatattccctgagaattggaggattattgggcatcttgagggataagtagaaataccaacagataaaaagtgtgaagaagcctgtagatggagggtggaagaagtctgagtgggacatttactcagatgagccataattgacactcctttcctgtcgaagtgtgaaggagtacatccatctttctttggcttttaagaatcgaatcaatgaatgcaagaatattatttcacttgagtatttctctccacaaacctaatgaattcttggctttctagatacataacgttctttttttttyccttaagtcagaatgtgtagttagttgtggaaatagcctaccagtatgtgtccatgcgtgcagggctaggcctgtcttcttggcttctgttgcatggtaggtacttaggcgacgttagggaatggatagtagtagggatactgttggctctgttgaggaatttgtagagggaaattccttctgttgggtgctctgtgaaactaataaggcagtgtgaaatactgtacttatttcagagaccggctgtgaggcttaagtagaggtgcagcattcataagtgtaatagagaataaccttcat

SEQ ID NO: 76335 - DNA, 601 bp, Human
ctggcagagccactataggtccttactggaaaaggggactcaaacccttgcagcccggatggcatcgctcaggcctgatgagaaacaaagcatgctgcaggtggggcagaacgtttgtactagaggcatctggacaactcccttgttttagagaaaagaatcctgaagtttaggagttcagcaacatacccagggcaactgttagcaacagcacagccaggtgtataattctgggctcctggaaagaccttccactaataatactgatgatgataatgatgacggtaacaactcttattcrctgaagagtttaggagcagacattgcattgagggttttacatgttaccccgtttaatcctctcaacaacttacaaggtagcaattctcttattaacccactttacacacagggtgcagagaggttaaggcaccaaagtcaaacaccttgttggaagcacaggcaggacaggaacctaaatccagctaaaagtttctgctcttgaccattatacttaactatccctaaactatattgcttccaaacaaggcagaaaaggctattttcaactaaagtataaaccagcaagttttgaccatta

SEQ ID NO: 76336 - DNA, 601 bp, Human
attcgctgaagagtttaggagcagacattgcattgagggttttacatgttaccccgtttaatcctctcaacaacttacaaggtagcaattctcttattaacccactttacacacagggtgcagagaggttaaggcaccaaagtcaaacaccttgttggaagcacaggcaggacaggaacctaaatccagctaaaagtttctgctcttgaccattatacttaactatccctaaactatattgcttccaaacaaggcagaaaaggctattttcaactaaagtataaaccagcaagttttgacyattagataatttttcacatatactaccttttcctatcaagatacaaagacaatcaacacttcgggatataaagaacaaaattattttgactttaaggagaaagaaggctcaagactctccagcctggaaaagagaactgaacagagacccagacttgcaaattaggggctaaagccaaaaccaagtctctttgggatttctgtccagtgcctttcaccttcagcatgtcacgtattttcaaggacttcgttctaagtgcacagtggtgctgctaggctcagtgagtgatttcagaaatca

SEQ ID NO: 76337 - DNA, 601 bp, Human
agagagaacatccctgccgccaaggacttcgcaatctagccaataccaatcgaagctataatctctctcagatattttgatcattgatccacagtcagaagtgtatttctattatggcctgggagggatgcacctacacacagccttactgtgtgtcacacattgttatttttcactgttctatttcatttaaaaatgtatcaacccactaaatcaattctctgactgtggattgtgattaacagtttgaaaagccccaactctagcccctttttggcacaaactttaaaacaaaacaaacaaatgtcaggaagttcttcctcagactagtttaagtttcttgggctatcgggttaattggatttgtatcgctgaatatgtcctcagtggcagatgcaccagcatatccgatctgtgaagggtataaaaagtggactcctgcaggcccacattcaaatgctgactctctggcatgttagctatgtgacttctccagatcttggtctataaaacagaagataattccactcacccctctggcttgttacaagggacctacctggtactggttctgtctttctcagcagaggggctgtgggca

SEQ ID NO: 76338 - DNA, 601 bp, Human
tccacagtcagaagtgtatttctattatggcctgggagggatgcacctacacacagccttactgtgtgtcacacattgttatttttcactgttctatttcatttaaaaatgtatcaacccactaaatcaattctctgactgtggattgtgattaacagtttgaaaagccccaactctagcccctttttggcacaaactttaaaacaaaacaaaaaaatgtcaggaagttcttcctcagactagtttaagtttcttgggctatcgggttaattggatttgtatcgctgaatatgtcctcagkggcagatgcaccagcatatccgatctgtgaagggtataaaaagtggactcctgcaggcccacattcaaatgctgactctctggcatgttagctatgtgacttctccagatcttggtctataaaacagaagataattccactcacccctctggcttgttacaagggacctacctggtactggttctgtctttctcagcagaggggctgtgggcatgggaggaagggagacaagtctggtcatgtggcacgaccagtttacgcaacacaagacctgtggtagccaattccacccctcggcct

SEQ ID NO: 76339 - DNA, 601 bp, Human
agtttgaaaagccccaactctagcccctttttggcacaaactttaaaacaaaacaaaaaaatgtcaggaagttcttcctcagactagtttaagtttcttgggctatcgggttaattggatttgtatcgctgaatatgtcctcagtggcagatgcaccagcatatccgatctgtgaagggtataaaaagtggactcctgcaggcccacattcaaatgctgactctctggcatgttagctatgtgacttctccagatcttggtctataaaacagaagataattccactcacccctctggcttkttacaagggacctacctggtactggttctgtctttctcagcagaggggctgtgggcatgggaggaagggagacaagtctggtcatgtggcacgaccagtttacgcaacacaagacctgtggtagccaattccacccctcggcctgctaccatgttaagtgattcgaaatccttcaaatcttttatgcaggcatccattgtattccacatggaagtacaataaataagatgcctaagatataacagggcataggccaagtctccgccattgtagagcttgctgttaatctaggcaggtggc

SEQ ID NO: 76340 - DNA, 601 bp, Human
tgaaaagccccaactctagcccctttttggcacaaactttaaaacaaaacaaaaaaatgtcaggaagttcttcctcagactagtttaagtttcttgggctatcgggttaattggatttgtatcgctgaatatgtcctcagtggcagatgcaccagcatatccgatctgtgaagggtataaaaagtggactcctgcaggcccacattcaaatgctgactctctggcatgttagctatgtgacttctccagatcttggtctataaaacagaagataattccactcacccctctggcttgttamaagggacctacctggtactggttctgtctttctcagcagaggggctgtgggcatgggaggaagggagacaagtctggtcatgtggcacgaccagtttacgcaacacaagacctgtggtagccaattccacccctcggcctgctaccatgttaagtgattcgaaatccttcaaatcttttatgcaggcatccattgtattccacatggaagtacaataaataagatgcctaagatataacagggcataggccaagtctccgccattgtagagcttgctgttaatctaggcaggtggccagg

SEQ ID NO: 76341 - DNA, 601 bp, Human
tcatgtggcacgaccagtttacgcaacacaagacctgtggtagccaattccacccctcggcctgctaccatgttaagtgattcgaaatccttcaaatcttttatgcaggcatccattgtattccacatggaagtacaataaataagatgcctaagatataacagggcataggccaagtctccgccattgtagagcttgctgttaatctaggcaggtggccaggtaaacaggtaactgtaactgaccgcaccaggtggtataacataagtctgggagtctgatgagagagtgtctgatgagmgagtgtctcatgcagggaagtctagtccttgatcccatttgcaattcccttagtgtcaaaaaccacaccttgcaaacttctaatttataacacataaagacttaaaaaccactaccaccacactgaggacaagaatccttgtctgtagccacagcaataagagggctatcaactccagttctatctcccctacgagatgctaagttccttgagacctgaagtaagagaattgctcaagatcacacagcaaatacacaaaattggaaaccccaaagatcaaaaattgcaggtcactttgct

SEQ ID NO: 76342 - DNA, 601 bp, Human
atttataggacacagactcagaaaggttcagtaaccagctcaggctcacaaagccaggaaacggccgggagggaacctaggatgggaccacacattcctgagggagaagagaaccctactgtgtacacgatccccagggcatttgaagagggcattctttcactttcggaatacaagctgattttaaacaggcatcttctcggttgtgttttatgaaacttacaggggaagctatggtatagaagtatgctacctaagagtgacttcccttaagaatccccatctgtaaaatggagatgaygacgaccactccctgggagcactggacaagactttctgggcaaagtcctgaaaactctgacactccacaaacacaaatgacctggagcagcagcattactgccaggcccctggaagtagcttatggggacaaactgaagagaaaggcaaaacacacactccccgctacaaaagtgcttagtcctccaaaatgcagggaaggcacggagtactgatgatgaggaatggtgggtcaacagccagtgcacacagaggaggtggtgcatccaatgcgttccccacctatgttaactcacagatc

SEQ ID NO: 76343 - DNA, 601 bp, Human
agcaactgaagctattatccaacttgaagcagaggccagctaatattgggtaaaaattaaatttgattccttgaaagaaaaaagttccatagagttagtgaggatcagcaattttcagaaaatttaaggaagtgaggtggaaaaattccactccccccattcctaaagggttttgaagcccacccactcctggctctcctgcaggaatagagaactgcagtgtctccagactcttcccactttataaatacaccctacgaccaaccagagagtgcttgctgccaaactcctgggcaaacgygaccaacaggattggacccggaaattagatgtccaagcagcccagtcatactcaattcaaaatagatatctgtgacctacttagtcttcgagtaccattctcaaagccaaaaaacaagacagggccactgacttcagcagagccctgcatgggcccctgctttcctgtcagatgaaacgtgcactgcaacagtgatgactcaagaaattatctcaggatagctggacagaaaccccagcttggaaagagctgattcaaacagttgtgaaaaagcaaaaagtcacagaagtcctgccaaca

SEQ ID NO: 76344 - DNA, 601 bp, Human
tccaacttgaagcagaggccagctaatattgggtaaaaattaaatttgattccttgaaagaaaaaagttccatagagttagtgaggatcagcaattttcagaaaatttaaggaagtgaggtggaaaaattccactccccccattcctaaagggttttgaagcccacccactcctggctctcctgcaggaatagagaactgcagtgtctccagactcttcccactttataaatacaccctacgaccaaccagagagtgcttgctgccaaactcctgggcaaacgtgaccaacaggattggayccggaaattagatgtccaagcagcccagtcatactcaattcaaaatagatatctgtgacctacttagtcttcgagtaccattctcaaagccaaaaaacaagacagggccactgacttcagcagagccctgcatgggcccctgctttcctgtcagatgaaacgtgcactgcaacagtgatgactcaagaaattatctcaggatagctggacagaaaccccagcttggaaagagctgattcaaacagttgtgaaaaagcaaaaagtcacagaagtcctgccaacagtttatcctctctgact

SEQ ID NO: 76345 - DNA, 601 bp, Human
cagtgatgactcaagaaattatctcaggatagctggacagaaaccccagcttggaaagagctgattcaaacagttgtgaaaaagcaaaaagtcacagaagtcctgccaacagtttatcctctctgactatccccaataatccatcttcatccacttggactgagggttacacctctcatgacagggacttctcaagctgtctatccctaacactcatattggtttgagtatacatatcttcccataaaacaagggattctgcctactgtaccttgatgttctacaaagcatcaagcacagmaagggtccaatgaagagcaagcaccacccaagggggaccccctcccctccccaggggcagaccaccaggttccagcccactcacacgcttggctgctcaagattagagaacagaaacagacaaatatttgctaaaaaaaaaaaaaaaattaggaagacaaacaagaccagggaaagttgctgtgtactttcaaccaccgcagttacagaatgatctcctaaattacaactcatttcaccaaagagatgagagttttggggagagtgaatccaaggaatttggcagggacaagttccagtg

SEQ ID NO: 76346 - DNA, 601 bp, Human
tctatccctaacactcatattggtttgagtatacatatcttcccataaaacaagggattctgcctactgtaccttgatgttctacaaagcatcaagcacagaaagggtccaatgaagagcaagcaccacccaagggggaccccctcccctccccaggggcagaccaccaggttccagcccactcacacgcttggctgctcaagattagagaacagaaacagacaaatatttgctaaaaaaaaaaaaaaaattaggaagacaaacaagaccagggaaagttgctgtgtactttcaaccaccrcagttacagaatgatctcctaaattacaactcatttcaccaaagagatgagagttttggggagagtgaatccaaggaatttggcagggacaagttccagtgaaatcctagagcattcagcactaggcagtacaacaccaggtagacagtggaacattatacttcaccagtgaagcgatggtagaggaaacaagctgctgccaaaaacaaaaatgaaataaagcaaacctgctgctcttcacatccgcatccatcctcctcacatctccaaggtcagccccactgttctcacgcaccattg

SEQ ID NO: 76347 - DNA, 601 bp, Human
aagcacagaaagggtccaatgaagagcaagcaccacccaagggggaccccctcccctccccaggggcagaccaccaggttccagcccactcacacgcttggctgctcaagattagagaacagaaacagacaaatatttgctaaaaaaaaaaaaaaaattaggaagacaaacaagaccagggaaagttgctgtgtactttcaaccaccgcagttacagaatgatctcctaaattacaactcatttcaccaaagagatgagagttttggggagagtgaatccaaggaatttggcagggacaarttccagtgaaatcctagagcattcagcactaggcagtacaacaccaggtagacagtggaacattatacttcaccagtgaagcgatggtagaggaaacaagctgctgccaaaaacaaaaatgaaataaagcaaacctgctgctcttcacatccgcatccatcctcctcacatctccaaggtcagccccactgttctcacgcaccattgtacactcaaaattctcatcagagaaacttccttgagagccctgtggtttcctcagcactttttccctacatcatgacatttaatcatcaccac

SEQ ID NO: 76348 - DNA, 601 bp, Human
aaaattaggaagacaaacaagaccagggaaagttgctgtgtactttcaaccaccgcagttacagaatgatctcctaaattacaactcatttcaccaaagagatgagagttttggggagagtgaatccaaggaatttggcagggacaagttccagtgaaatcctagagcattcagcactaggcagtacaacaccaggtagacagtggaacattatacttcaccagtgaagcgatggtagaggaaacaagctgctgccaaaaacaaaaatgaaataaagcaaacctgctgctcttcacatccrcatccatcctcctcacatctccaaggtcagccccactgttctcacgcaccattgtacactcaaaattctcatcagagaaacttccttgagagccctgtggtttcctcagcactttttccctacatcatgacatttaatcatcaccaccatcctgggaggcaggtggaacaggcatttttatcactccctgagaaatgaggaaatggaagcctaagtatgtctaccacacggcacaatcaggactaaagtacagactaattcccaagttcaatgtgtgttctccaaaataacccagacctg

SEQ ID NO: 76349 - DNA, 601 bp, Human
gaacctgggacctttctgagtatgtcagttctgggttcaaatcctgcctctgaagctgactagctctgtgactttgggcaggtagctttgtttctgtaagtctcagcgtcctcatttatcacataaggggttccaaaaaaaaatctctcaggggatgtggttaaggccacaaaactatacacttaaaaatagttgaaaaggcaatttttttccttgagacatggtctcactgtcacccaggctggagtgcagggacatgatcacagctcactgcaacttcagcttcttgggctcaagcgaycttcccaactcagcctcttaagtagctgggactacaggcacacaccaccacgcataactaattttttaaaaatttttttgtagagatggggtctcactatattgtccaggctggtctccaactcctaggctcaagtgatcctcctgcctcagtctcccaaagggctgggattataggcatgagacaccacaaccagcctaaaaaagcaatttttacgtatatttcaccacaataacaaaaattaggttaatatttgtttgcttttaagaaacaggatgggttttgctatgtagccctcaa

SEQ ID NO: 76350 - DNA, 601 bp, Human
acttaaaaatagttgaaaaggcaatttttttccttgagacatggtctcactgtcacccaggctggagtgcagggacatgatcacagctcactgcaacttcagcttcttgggctcaagcgaccttcccaactcagcctcttaagtagctgggactacaggcacacaccaccacgcataactaattttttaaaaatttttttgtagagatggggtctcactatattgtccaggctggtctccaactcctaggctcaagtgatcctcctgcctcagtctcccaaagggctgggattataggcakgagacaccacaaccagcctaaaaaagcaatttttacgtatatttcaccacaataacaaaaattaggttaatatttgtttgcttttaagaaacaggatgggttttgctatgtagccctcaaactcctgggttcaggtgatcttcccaactcagcctcctgagtagctgggcctataggtacaagtcaccacacccagtatattttgtttttttaaaataggaatgtcataggttcacagtgagaattaaataagatactgtaatggcaagttcttacattgtctggcacatactaaatcct

SEQ ID NO: 76351 - DNA, 601 bp, Human
agacatggtctcactgtcacccaggctggagtgcagggacatgatcacagctcactgcaacttcagcttcttgggctcaagcgaccttcccaactcagcctcttaagtagctgggactacaggcacacaccaccacgcataactaattttttaaaaatttttttgtagagatggggtctcactatattgtccaggctggtctccaactcctaggctcaagtgatcctcctgcctcagtctcccaaagggctgggattataggcatgagacaccacaaccagcctaaaaaagcaatttttaygtatatttcaccacaataacaaaaattaggttaatatttgtttgcttttaagaaacaggatgggttttgctatgtagccctcaaactcctgggttcaggtgatcttcccaactcagcctcctgagtagctgggcctataggtacaagtcaccacacccagtatattttgtttttttaaaataggaatgtcataggttcacagtgagaattaaataagatactgtaatggcaagttcttacattgtctggcacatactaaatcctaataaataataattaattatcattaataattttaat

SEQ ID NO: 76352 - DNA, 601 bp, Human
atcaggctggctgggataaaaagttcatgttccctgtgcctaaaccggctctaccttccaggagctcgcactgtgaccagggagacaggtgcaaggggctgcccagagtgggtggagaggtgaagggagacccccatgccaatcatttcatccaaccctctaggttaaagatgagagaactgaggcccagggaggcaagtaacttatcgaaggcagcagtgatgaaatcagaacttaatgttccagtaccaatctggataccagaagaccaacttctcagggttctaagtgaaatcacagsatgccgcctactcagagcccagcaaagatgccagggcccacatccaatacatcctgtccatcaacaagtacgtatttactagatgttgggggcatgtcagcagagacaaaagccacccctgggcataggacaaggaggctgtcttatgggaggggaacacgtggagccctgtctggctcccactcgtgggcaaggcctttctgttctaactataacaaggaagcaaagcctgcctccacagattctgaaggaacactacctgagtcaaaacttcctgtagcactctggcagagaaaggct

SEQ ID NO: 76353 - DNA, 601 bp, Human
accagttatctctgaggacctggaggagctggcacctggggaggggtgctgggtgaaggggaatgtgacaagtctgctgtgtccttctgcactatttaaatgcaagggcaggctgcaggagaatacatttacatattacctatatgatttcagaaaaaaagcacctaaactgattaaaaaaccaccaccaccaaaacaagctacttatgctgatgtgaaattgctgcaccaatttgaacaggtttctatgctgcacttccaggtcttcccaagactgacaaagttcaagccaatttctgcrgtactgatgacagactgaattgggactaacaaggaagaaggaaaatgtgggatgcaaggaaaacatctgtaaaagctctgtggaagctgcaaaccagtcctaccctgaacctgctcatcaccaaaactcactagttctggggccttcctccctctcatccctataggatgagaaataagccaaaaccggaatcaagagagaattccctttcccacggcagagggaggcctccactgtcaccagcagagctgctcccaggcaaagccaaagaaacggcctggccaaactccaccttcctga

SEQ ID NO: 76354 - DNA, 601 bp, Human
tatttgtaatcatttggatgtgggttttttgttttggtcattttttggcaaaataaaaagttgacagcctcagtttccattcccactcccaaaatgtttttgtaatggttttggtctatgaaatctgaaagcctcagaaattctcactttataatctcagagacctggacaatccctgcaaaggcttcagacccatcagaaaatcaactgttgttgttttgttgtttctcatgttttaatcatgtagcctgtttccttttctgcctcatacctacttggcagtcatttaactccagtggtkaaaacatggggttaaggggacttcactgccagaatcacatctgtggctgtgggtcaggagggagctgggccttggttctgtcctgtccacaaggaagacctggacttgaggtctggttgttaccagtggagggtccaggttcttggcatttcgaacatttgaacaaagaactggagaaaacacacaaacaaagcaaggaaagagtgaagcaacaaaagcagaaatttattgaaaatgaaactctacagggtgggaacagcctcaagcaggtggctcaagggccctgggtacagaattttc

SEQ ID NO: 76355 - DNA, 601 bp, Human
tggcagggagagtccttgggtgtccccaacactcttccaccgtaggggagctacttaaccctaagaggagatattgttcttaatccctgttttacaaagaaggaaaataagacttagaacgtttaagcaattcaccccaagcctggttaaatacaaagttcaaatacttaattaaccttaacctctttggtcatagttcaggtgcttgattggtgttacctgaagttaaatctgatatgaattcccagaagccaacattatggaaagacttttctagaactaggaaagaggtaaaaaaaawttttttgagtcagggtctcactctgttgcccaggctggagtgcagtggcacaatcacatctcactgcagcttcaacctcctgggctcaaacgatcctcctgcctcagcctccccagtagcttggaccacaggcatgcaccaccatgcttaactaatttatttatttttttttttttttatgttgagacaaggtctcactatgttgcccaggctggtcttgaactcctgggctcaagtgatccttccacctcagcctcccgaagtgctgtgattacagacacaaaccatcatgtttggcca

SEQ ID NO: 76356 - DNA, 601 bp, Human
tcaaatacttaattaaccttaacctctttggtcatagttcaggtgcttgattggtgttacctgaagttaaatctgatatgaattcccagaagccaacattatggaaagacttttctagaactaggaaagaggtaaaaaaaatttttttgagtcagggtctcactctgttgcccaggctggagtgcagtggcacaatcacatctcactgcagcttcaacctcctgggctcaaacgatcctcctgcctcagcctccccagtagcttggaccacaggcatgcaccaccatgcttaactaatttrtttatttttttttttttttatgttgagacaaggtctcactatgttgcccaggctggtcttgaactcctgggctcaagtgatccttccacctcagcctcccgaagtgctgtgattacagacacaaaccatcatgtttggccaagaggtaaaacttaccctccctaagttaagagggaaaactaccagcttcttggatttaagaagccgtagagcttgaagtcctgtacatttatgtaagtatcaagtgttataataaaaatgtctttttctcactggtagtaattcttttaaagacttcaa

SEQ ID NO: 76357 - DNA, 601 bp, Human
cttaattaaccttaacctctttggtcatagttcaggtgcttgattggtgttacctgaagttaaatctgatatgaattcccagaagccaacattatggaaagacttttctagaactaggaaagaggtaaaaaaaatttttttgagtcagggtctcactctgttgcccaggctggagtgcagtggcacaatcacatctcactgcagcttcaacctcctgggctcaaacgatcctcctgcctcagcctccccagtagcttggaccacaggcatgcaccaccatgcttaactaatttatttattattttttttttttatgttgagacaaggtctcactatgttgcccaggctggtcttgaactcctgggctcaagtgatccttccacctcagcctcccgaagtgctgtgattacagacacaaaccatcatgtttggccaagaggtaaaacttaccctccctaagttaagagggaaaactaccagcttcttggatttaagaagccgtagagcttgaagtcctgtacatttatgtaagtatcaagtgttataataaaaatgtctttttctcactggtagtaattcttttaaagacttcaaacaaaat

SEQ ID NO: 76358 - DNA, 601 bp, Human
aattaaccttaacctctttggtcatagttcaggtgcttgattggtgttacctgaagttaaatctgatatgaattcccagaagccaacattatggaaagacttttctagaactaggaaagaggtaaaaaaaatttttttgagtcagggtctcactctgttgcccaggctggagtgcagtggcacaatcacatctcactgcagcttcaacctcctgggctcaaacgatcctcctgcctcagcctccccagtagcttggaccacaggcatgcaccaccatgcttaactaatttatttatttttatttttttttatgttgagacaaggtctcactatgttgcccaggctggtcttgaactcctgggctcaagtgatccttccacctcagcctcccgaagtgctgtgattacagacacaaaccatcatgtttggccaagaggtaaaacttaccctccctaagttaagagggaaaactaccagcttcttggatttaagaagccgtagagcttgaagtcctgtacatttatgtaagtatcaagtgttataataaaaatgtctttttctcactggtagtaattcttttaaagacttcaaacaaaattat

SEQ ID NO: 76359 - DNA, 601 bp, Human
taacctctttggtcatagttcaggtgcttgattggtgttacctgaagttaaatctgatatgaattcccagaagccaacattatggaaagacttttctagaactaggaaagaggtaaaaaaaatttttttgagtcagggtctcactctgttgcccaggctggagtgcagtggcacaatcacatctcactgcagcttcaacctcctgggctcaaacgatcctcctgcctcagcctccccagtagcttggaccacaggcatgcaccaccatgcttaactaatttatttatttttttttttttttatgttgagacaaggtctcactatgttgcccaggctggtcttgaactcctgggctcaagtgatccttccacctcagcctcccgaagtgctgtgattacagacacaaaccatcatgtttggccaagaggtaaaacttaccctccctaagttaagagggaaaactaccagcttcttggatttaagaagccgtagagcttgaagtcctgtacatttatgtaagtatcaagtgttataataaaaatgtctttttctcactggtagtaattcttttaaagacttcaaacaaaattatacctattct

SEQ ID NO: 76360 - DNA, 596 bp, Human
agatctctgctttcgtttgaaaaaagcaccagagcgctactgaaaagttcaacccaaatcttcatgcttactgccctgttttctgaaatttaagtctctagctaaagaatgggaaggaattcctactctacccctgctgccggcaaccaaagcatgctctcaagccaagaacaccagtgaaccctttaaatttctccacaactttctccctgctggcaaatgtcaagtttctatttcaaaagaaataagagcgtcattaacatgcctgtcttcatgctcttctaactcctttcagaatttkggggggttttgcttgagaaagtaagaccacactaaaatcacaactccccagggtgtatcattaaaggtggaactcggccaggcatggtgcctcatgcctgtaatcccaacaatttgggagactgaggtaggaggaccgcttgagctcaggagttcgagatcagcctgggcaacatggtgaaaccgcatctctacaaaaaattttaaaaaattaaaaaataaaaatagccaggcgtggtggcacaccctggtagtacccagctacttggggggctgaggcaggaggagcacttgag

SEQ ID NO: 76361 - DNA, 560 bp, Human
ctactgaaaagttcaacccaaatcttcatgcttactgccctgttttctgaaatttaagtctctagctaaagaatgggaaggaattcctactctacccctgctgccggcaaccaaagcatgctctcaagccaagaacaccagtgaaccctttaaatttctccacaactttctccctgctggcaaatgtcaagtttctatttcaaaagaaataagagcgtcattaacatgcctgtcttcatgctcttctaactcctttcagaattttggggggttttgcttgagaaagtaagaccacactaaratcacaactccccagggtgtatcattaaaggtggaactcggccaggcatggtgcctcatgcctgtaatcccaacaatttgggagactgaggtaggaggaccgcttgagctcaggagttcgagatcagcctgggcaacatggtgaaaccgcatctctacaaaaaattttaaaaaattaaaaaataaaaatagccaggcgtggtggcacaccctggtagtacccagctacttggggggctgaggcaggaggagcacttgag

SEQ ID NO: 76362 - DNA, 601 bp, Human
gtctccccagaggtgcagaggcaagacagggagtccccagcttcttccacaggggcttccttctctatccaacccacactctgctctctgaattcctgactcccctcagctgcagcacttaggtgagtattttactccaggtgagtattttgctagttcctgtgcatatgcagtctctgcacctaaactgtcagtgcctggagagcggatggctctatctaactctccttttttaatgctcatagtgtctacaagagaacttgattcatagccaccattcaacaaacacctgtttaatggrattgaattttcagcatttagtagtgtactaaacatctgatgtgaaataagagccaaattaggcaaagtaagcatgatttagaagtgcagagatggaaagaaaatggtatgaagagcattggtgtagaagtacttcctgaaacttgaaggaatccatctggtatcgctttgattgactttgttaaggacacaattcctaggttctgagactcctcaactctaagatgcaacagtcattgaacaacagtttactttttgaggggtgaaaaatggctgctttcaatgtttacatatattgaga

SEQ ID NO: 76363 - DNA, 601 bp, Human
ggctttattgtgcctggatgcatttttaatatacccactaaatttcagccagactgaagactggctggcaataatgatttataagggagggtagagtccctcactttctatcccagagtccgctcccacttgagggtctgggggttggcagccccctactgcctgctggctctgtggagcttttaggaaaagatttcaagcacgatctcacggcctcaaccaggatctgaaagatgactgaagggcttcccattctggtaatagaccccacccaggacctcagcatatcccattagagctygccagcctccaacacagcaggattggattggctgtccaccggcccctctcatatcctcctccatcgttctctctctgccaggcttttgaagttccttttcctgctcacgaaccctgctggcaccacatagcctacaggatagtgtccaagtgcctcagtcgggaaagcaagaactgacctttttttgaagccccacacaatagaaagctttcatatcaagcaccccatttaacttcatgaaaaccacgactaggcttattatggccatttagggatgaagacactaaggcaaaagatcat

SEQ ID NO: 76364 - DNA, 601 bp, Human
ccaacacagcaggattggattggctgtccaccggcccctctcatatcctcctccatcgttctctctctgccaggcttttgaagttccttttcctgctcacgaaccctgctggcaccacatagcctacaggatagtgtccaagtgcctcagtcgggaaagcaagaactgacctttttttgaagccccacacaatagaaagctttcatatcaagcaccccatttaacttcatgaaaaccacgactaggcttattatggccatttagggatgaagacactaaggcaaaagatcatataaagtcrcacaactggtcaagctttcaccacatttctatttctccttcctttccaacattttctctaccactcactcctttgtgtcagccaggcaggccccctactcactgtcccctgactgtcacaccttgcccacagggcccctccacctaagggcctcccctttctgcattccaaatcccacccattcctcaaggtttggctcaagtctccccttctccaaaaagctttcttagaccccagttctctccccatcctctgaatttccacttattacgccactactccttgaacatatccaggtat

SEQ ID NO: 76365 - DNA, 601 bp, Human
aagtttttcgagaaggagagtaaacataatctaagcacatgttaggaagattaattagaggttggatgggtaatgcccacatgttttctgggaagactgacccaactggagaagggcaaggaagtcctgaatgagtagccttcattctacttctgcagaggactaattgtcactctgtggacagtttgacaggtccagggagtcagaatggcaggacagataagtcaggagtagggtaggatagtaagaaagcatctacaggaggaaaagactgaaggtgagtggggaagtggacatgaaygtgttgacaaaggtcagcctgaccagctccctgagttggggcaagcccaggtgaggcccagcaccaggccatggaaatccagccactacaatgccaagtgaaaggtgagagtttagagtttagactggtattggcagagccacatgagagatgaaggaagagcagccaggagctgcgagtgggcaggaagtggggatgagtggcgtccactgcaggttctccctgcaggacagagctccaagccagaagggaaaggaagcagaggagtgctctgaaaaagcagcagccctgcagccgagg

SEQ ID NO: 76366 - DNA, 601 bp, Human
gactaattgtcactctgtggacagtttgacaggtccagggagtcagaatggcaggacagataagtcaggagtagggtaggatagtaagaaagcatctacaggaggaaaagactgaaggtgagtggggaagtggacatgaatgtgttgacaaaggtcagcctgaccagctccctgagttggggcaagcccaggtgaggcccagcaccaggccatggaaatccagccactacaatgccaagtgaaaggtgagagtttagagtttagactggtattggcagagccacatgagagatgaaggaasagcagccaggagctgcgagtgggcaggaagtggggatgagtggcgtccactgcaggttctccctgcaggacagagctccaagccagaagggaaaggaagcagaggagtgctctgaaaaagcagcagccctgcagccgagggaccgaggggctgaacggtttctccactgagagatccagttctcaggtaggaactgagaatcagaaacaagggagaggcacatcctgttttacgagaaaaatcaaggtcttcaaagataactgtaataggtttccatttgtctgtttttattgtggtaaa

SEQ ID NO: 76367 - DNA, 601 bp, Human
caagccagaagggaaaggaagcagaggagtgctctgaaaaagcagcagccctgcagccgagggaccgaggggctgaacggtttctccactgagagatccagttctcaggtaggaactgagaatcagaaacaagggagaggcacatcctgttttacgagaaaaatcaaggtcttcaaagataactgtaataggtttccatttgtctgtttttattgtggtaaaatatgtgtaacataaaacttaccgttttaaccaatataaagtgtacaattcagtggcattaagtacactcacagtgctrtgcagctatcaccactatccaggtccagaacattttcaccaccgcaaatgcaaactccaccctcatcaagcagttgctctccattccccactccccaccagtccctggcaaccactcatctgctcactgtttctatggatttgcctatcctggatattttatataaatagaatcatgtaatatgtgaccttttgtgtctggtgtctttctcatggcatgtttctgaggtttacccatgtgatagcatataatggtcaattttatgtgccaatttgactgggccatagagtgccaggtatt

SEQ ID NO: 76368 - DNA, 601 bp, Human
ataaaacttaccgttttaaccaatataaagtgtacaattcagtggcattaagtacactcacagtgctatgcagctatcaccactatccaggtccagaacattttcaccaccgcaaatgcaaactccaccctcatcaagcagttgctctccattccccactccccaccagtccctggcaaccactcatctgctcactgtttctatggatttgcctatcctggatattttatataaatagaatcatgtaatatgtgaccttttgtgtctggtgtctttctcatggcatgtttctgaggtttayccatgtgatagcatataatggtcaattttatgtgccaatttgactgggccatagagtgccaggtatttggttaaacgttattctgggtgtgtctgtgagggtgtctctggatgaaattaacatctgaattgatggcctgagaaaggaggttgcccttcccagagtgggtgggccccatgcaatcaattaaaggcttgaatagaacaaaaaggctgtgtaagaaaggatttgttctctctctatatgaatgtcttccagtgagacattggtcttctgcctttggacttggactcagaatag

SEQ ID NO: 76369 - DNA, 601 bp, Human
acactcacagtgctatgcagctatcaccactatccaggtccagaacattttcaccaccgcaaatgcaaactccaccctcatcaagcagttgctctccattccccactccccaccagtccctggcaaccactcatctgctcactgtttctatggatttgcctatcctggatattttatataaatagaatcatgtaatatgtgaccttttgtgtctggtgtctttctcatggcatgtttctgaggtttacccatgtgatagcatataatggtcaattttatgtgccaatttgactgggccatrgagtgccaggtatttggttaaacgttattctgggtgtgtctgtgagggtgtctctggatgaaattaacatctgaattgatggcctgagaaaggaggttgcccttcccagagtgggtgggccccatgcaatcaattaaaggcttgaatagaacaaaaaggctgtgtaagaaaggatttgttctctctctatatgaatgtcttccagtgagacattggtcttctgcctttggacttggactcagaatagaccttacaccattgactctcctggttctcaggcctttggattaggactgaaac

SEQ ID NO: 76370 - DNA, 601 bp, Human
tctggctctgttgcccaggctggagtgcagtggcacaatcttggctcactgcaacctctgccttccgggttcaagcgattctcctgcctcagccttctgagtagctgggattacaggtgcccgccaccatgcctggctaatttttgtatttttttttgtagagacgaggtttcaccatattggccaggctggtgtcaaactcctgacctcaagtgatccacccacctcggcctcccaaagtgctgggattacagggatgagccaccacgcccagcctccagttctttatgataaatctctstgtgtgtgtgtgtgtgtgtgtgtgtgtgtgtgtgtgtgtgtgtatacatatatacatacactcatacatatatcctattggttctttttttttgagaatcctcactaatacatagcatgtatcattactttatttctttaatggctgcataatattccattgtatggatatatcacattttgtttatccattcatcagctgatcagcatttgggttgttttcatcatgcgccaaggttttaaaatcctggttccccatttacattgcagggtggcttggtcaaatcacttaccctctctg

SEQ ID NO: 76371 - DNA, 601 bp, Human
gccagcctgagtttgagacctggctgagcccctggactgcagtgtaaccttgagagagtccagattctgtgggagtggaccaggatgttgcctttctctccaccgccctgtctctatccagatctacttcactggctgctccatgaacccagcccgctcttttggccctgcggtggtcatgaatcggttcagccccgctcactgggtgagtctgtcccttcccctggctccctggagatgagggcctggagacccagcagtggcagctcagagctcaccagacctggattctgtgggtctrgagcttgggggtgggccagggagtggtggctgacagagaaagggacacagtaggggatgggattcagctagaggggcagaggtggctttgtatggcctgaaccgctggggacagggagtctgagtatctatccgcttatggaagaggctctactgaacctggaggtgcagaggggctctgtgtcaattcccttgaggatttggtgtccgtccccctcggtgtctgcgtgctggtcctctctgatgttttatttatctgtccctgttgagggggttgggagagtcttcctgtgggtctgtc

SEQ ID NO: 76372 - DNA, 601 bp, Human
gatctacttcactggctgctccatgaacccagcccgctcttttggccctgcggtggtcatgaatcggttcagccccgctcactgggtgagtctgtcccttcccctggctccctggagatgagggcctggagacccagcagtggcagctcagagctcaccagacctggattctgtgggtctagagcttgggggtgggccagggagtggtggctgacagagaaagggacacagtaggggatgggattcagctagaggggcagaggtggctttgtatggcctgaaccgctggggacagggagtmtgagtatctatccgcttatggaagaggctctactgaacctggaggtgcagaggggctctgtgtcaattcccttgaggatttggtgtccgtccccctcggtgtctgcgtgctggtcctctctgatgttttatttatctgtccctgttgagggggttgggagagtcttcctgtgggtctgtccctgtggacagtctgtctgccccccctttggaagctcatggtcactctctccagggtctgcttctatccctgcgtggaggggacacgcgctctgttcatccgtctctctgaggacccacg

SEQ ID NO: 76373 - DNA, 601 bp, Human
tcccttcccctggctccctggagatgagggcctggagacccagcagtggcagctcagagctcaccagacctggattctgtgggtctagagcttgggggtgggccagggagtggtggctgacagagaaagggacacagtaggggatgggattcagctagaggggcagaggtggctttgtatggcctgaaccgctggggacagggagtctgagtatctatccgcttatggaagaggctctactgaacctggaggtgcagaggggctctgtgtcaattcccttgaggatttggtgtccgtcccyctcggtgtctgcgtgctggtcctctctgatgttttatttatctgtccctgttgagggggttgggagagtcttcctgtgggtctgtccctgtggacagtctgtctgccccccctttggaagctcatggtcactctctccagggtctgcttctatccctgcgtggaggggacacgcgctctgttcatccgtctctctgaggacccacgtgtcccctctgaaggtttatttgcttctctttccggtgtggttggagggagcctgtccctctgggaatccgtttgccttctttgagggtctagg

SEQ ID NO: 76374 - DNA, 601 bp, Human
agggaggatcatagctctatgatgtaagagcctccatttagtattgctttagtgaaatcagtagcatcataaggtgtggtcttgaatgtgcccacaggtgtgacatgaaaaggatttgttccacaaaagcttaaaagcctttctcaaaattgggaaaactatgaaggcaagcacagacatataattagtgtcctaaaatcttccatataatcatttaaagtttttttaaaaatttgctcctatgttttcccaaagtctagggctttctctaaaagaaatgggtctcttcaaaatatttcawtgtcttttattactgtttaagcataccagaaaaccaaaacatacaggatttacaagtggtaaagtaagtttttcttttgtctggctgtaggaaatgataactgaagcttcattttacctatttaatgctaccaagagaagagtatttttcagaaatataaagattttaatacctgccacatggaaagctaataataacagcaaaataaaacaagaatcatatgaaaaggtaagaatccaggatttcattcaatgatctcaaggggaaaaaaaacaccaaaatatactgtgctcaaacgat

SEQ ID NO: 76375 - DNA, 601 bp, Human
tgtggtcttgaatgtgcccacaggtgtgacatgaaaaggatttgttccacaaaagcttaaaagcctttctcaaaattgggaaaactatgaaggcaagcacagacatataattagtgtcctaaaatcttccatataatcatttaaagtttttttaaaaatttgctcctatgttttcccaaagtctagggctttctctaaaagaaatgggtctcttcaaaatatttcattgtcttttattactgtttaagcataccagaaaaccaaaacatacaggatttacaagtggtaaagtaagtttttmttttgtctggctgtaggaaatgataactgaagcttcattttacctatttaatgctaccaagagaagagtatttttcagaaatataaagattttaatacctgccacatggaaagctaataataacagcaaaataaaacaagaatcatatgaaaaggtaagaatccaggatttcattcaatgatctcaaggggaaaaaaaacaccaaaatatactgtgctcaaacgataaaagtgagaagttaagtaaaaacaaatcatcagtattaacaatgcaaataatattaatgggcagaatgttatc

SEQ ID NO: 76376 - DNA, 601 bp, Human
tactctgtcagaaattgaatggtatagcaatccagataggtaccccaatgtcctgaagaagttaaagagcctgtgaaaagcatttgacctatgaccagatgaaagcatttgagaatgcttgcacatgaagataggataggtgggggaactggggtaagctgggaagagttagtgtttaagctccaactaagtgccaggcattttacatatattatttaattctcacataacttaaaattagtttctgtgatcacaaattaaaacactggggcttgaataaggtatggactttgtcccaaayctaacagctagtaaattacagagccataatttgaatgtctatttgcctccaaaacccatgctttttgcactaagctttgttgtctctagctgtcaatagagatttaatgcatctattgggccttcaatagaactaagaagtattggagacaacaaacaccaaaaccaggttgccataggtaacacttgatcctaatggaggggagagaaataagtaaagcaaaagtgaaaatatgagtgaacggaaagaccaaaggaaacaatcgtccctggatgctgttcatttatctgttggatacca

SEQ ID NO: 76377 - DNA, 601 bp, Human
agaactaagaagtattggagacaacaaacaccaaaaccaggttgccataggtaacacttgatcctaatggaggggagagaaataagtaaagcaaaagtgaaaatatgagtgaacggaaagaccaaaggaaacaatcgtccctggatgctgttcatttatctgttggataccaattctttaacctcagaatgtcaattaagcaaacagtgaatgatcattatgtacgggaccacgctaggcacttcagagaacccaaggaccagcaaggtagttcctgtccttccaagtctacaatgagatktaggtaggaatcatggaagggggaaagggttaggaaaagtagataagagctgaattactgtggtctataaggtataaagtaaccccaaacagcctctgagtattccattccatgaagggcactctttccttttggcctcaggacaaattttcagacataggaatgaggttttacccaagtgaggactatccaagagtgtgacctcttcagccttttttgtaggtacttccttgtaatgaccttggcttgaattcttatctttctaaaaataaatgttaattattataaaagtaatttata

SEQ ID NO: 76378 - DNA, 601 bp, Human
tgaggttttacccaagtgaggactatccaagagtgtgacctcttcagccttttttgtaggtacttccttgtaatgaccttggcttgaattcttatctttctaaaaataaatgttaattattataaaagtaatttatactcattgaaaaaaattaaataatgtagaaacatggaaaataaaaatgaaaaattgtattgtcctcttcttctcagtggcacacacacagacacagatggacacacatacatacaacacacacacacacacacacacaaaacacatatacatattgtacatagartgataattgtgtatattggatcgtattagatctatttttccaaaatcagcttttaaaaaaacttaacagcatatttaacttttaagtgcatatccagaacaatctgtcatctttcttcccaaaaataaaagaaacaatgttatatataacattttcttgtcttgatagttatatgagtggatatttcagttttggacttaaaatatgttttagcaacagtaatggaaatggtcaggccataagatgaaatataacttcattggaatgatcgttttgctgatctaattggttacaggaaag

SEQ ID NO: 76379 - DNA, 601 bp, Human
acctcttcagccttttttgtaggtacttccttgtaatgaccttggcttgaattcttatctttctaaaaataaatgttaattattataaaagtaatttatactcattgaaaaaaattaaataatgtagaaacatggaaaataaaaatgaaaaattgtattgtcctcttcttctcagtggcacacacacagacacagatggacacacatacatacaacacacacacacacacacacacaaaacacatatacatattgtacatagagtgataattgtgtatattggatcgtattagatctattkttccaaaatcagcttttaaaaaaacttaacagcatatttaacttttaagtgcatatccagaacaatctgtcatctttcttcccaaaaataaaagaaacaatgttatatataacattttcttgtcttgatagttatatgagtggatatttcagttttggacttaaaatatgttttagcaacagtaatggaaatggtcaggccataagatgaaatataacttcattggaatgatcgttttgctgatctaattggttacaggaaagaaaggacaaattttcaaagaaataatgttctattgtc

SEQ ID NO: 76380 - DNA, 601 bp, Human
gatatttcagttttggacttaaaatatgttttagcaacagtaatggaaatggtcaggccataagatgaaatataacttcattggaatgatcgttttgctgatctaattggttacaggaaagaaaggacaaattttcaaagaaataatgttctattgtcttacaccaataaaataacccacagaaagttgttcacaaaaggctgtaacattttacagccttctgaatggttctgaacgatgtataaatgcttttagaatttcttcaaatattttaattgcattttatagtgttttgttataycagacttttacaggattgacttttgagaatattttaatctggaatgtggaaagatcaaatggaagtaattaggttccataaaaatttgctaagctttcataacatagacctttttggaaatcccaagtgattttattgatatgtagctgtgggtgcattttaaactccatccacaaggtgtttttcttcaattttgtttttaaattgggttataattacatacaataaaatgcacacatcttaagtgtacagttcaaagtgctttaatgaatgtatacatttatgtcaccaacaacagag

SEQ ID NO: 76381 - DNA, 601 bp, Human
aagtattacaaggcatttcttttaatttaggcaaatgtcatagtgactgactggtatggggcacatggagatgatccatacaccctacaatacagagggtgtggaaaagagggaaaatacattcatttcacacctaatttcctactgaatgataacttaacagctggctacggatcacgaggtaagtgggaccaataaaacaatagccattggacaatactacttataatattctgtgcttggtgctgaaagggactcactcacaaaacctgaaacttgtcaaggacttaccactcaaagkgggagataggtcatatgcccatgcaaagatgaggggctaaagtgaactcgaaagagtttagcaccagattagtggcccagagaggagtgctataagaattcaatcaaggaaacgtcatttagagtcaagggtggtcagaaatgtcctcacaaaggaaaaggtcttcaagattgaacatcattttgataaatggaaagaagggagaaaatagtgggaagactatgaagaaaactgtggcagcagaaaaattaaaggcatataggagagacagagaccctgatgatggtgcagggagactgt

SEQ ID NO: 76382 - DNA, 601 bp, Human
tttcacacctaatttcctactgaatgataacttaacagctggctacggatcacgaggtaagtgggaccaataaaacaatagccattggacaatactacttataatattctgtgcttggtgctgaaagggactcactcacaaaacctgaaacttgtcaaggacttaccactcaaagggggagataggtcatatgcccatgcaaagatgaggggctaaagtgaactcgaaagagtttagcaccagattagtggcccagagaggagtgctataagaattcaatcaaggaaacgtcatttagagycaagggtggtcagaaatgtcctcacaaaggaaaaggtcttcaagattgaacatcattttgataaatggaaagaagggagaaaatagtgggaagactatgaagaaaactgtggcagcagaaaaattaaaggcatataggagagacagagaccctgatgatggtgcagggagactgtgggcagtgggagaaaacgttgaaacatacatgagggccaggtgatgcactaaaatggccacattttcaagtcaccactcaaggtttctaagcacaggagtgactccatcaaagcagtgttttaag

SEQ ID NO: 76383 - DNA, 601 bp, Human
taaaaatgggtggagacagtgagatgggaaggatagtaataaggacactgaggatttcctatgcgctagccgctctgtggtttccttttcaaatgttatcgtacttaattctagcaactctaagcgatgagaaatactccagagataaaaaacaaaaagaggtctgaactgctgcagaaggaaaggcaagaggcacgtggagacagcattaaggaacaaggcacacaccaggtttttgtcagacatggaaaaaaccagcttcaagaagaaatcccacaagtctggatctaggcaaattcaytgtgaagagcaatagactatgccagggaaagtggttcagcctgtggttagatattgatggctggagtttgggagagaagtcagggtcataggcctagagactggtatttagtgagtgagatctgagggagaaaatagtaagcacagttcgccagtcaaggactatctatcccaatctttattttttgtttttgatttaatgtaacagtagtgcctttcaagtgatgtcttaattttcttttttatccctagttaaatctaaactagggttttgttaacaaggattttgttatcctctgta

SEQ ID NO: 76384 - DNA, 601 bp, Human
gaaatactccagagataaaaaacaaaaagaggtctgaactgctgcagaaggaaaggcaagaggcacgtggagacagcattaaggaacaaggcacacaccaggtttttgtcagacatggaaaaaaccagcttcaagaagaaatcccacaagtctggatctaggcaaattcattgtgaagagcaatagactatgccagggaaagtggttcagcctgtggttagatattgatggctggagtttgggagagaagtcagggtcataggcctagagactggtatttagtgagtgagatctgagggasaaaatagtaagcacagttcgccagtcaaggactatctatcccaatctttattttttgtttttgatttaatgtaacagtagtgcctttcaagtgatgtcttaattttcttttttatccctagttaaatctaaactagggttttgttaacaaggattttgttatcctctgtatagttagcaggaagtggagtgaaacactccataaaatacactttacaaaacactttataaatctttagaaaaacgtagttttttttctttcctggtaaccttgagatgctgataatctctgctcaagcat

SEQ ID NO: 76385 - DNA, 601 bp, Human
aaaaaaccagcttcaagaagaaatcccacaagtctggatctaggcaaattcattgtgaagagcaatagactatgccagggaaagtggttcagcctgtggttagatattgatggctggagtttgggagagaagtcagggtcataggcctagagactggtatttagtgagtgagatctgagggagaaaatagtaagcacagttcgccagtcaaggactatctatcccaatctttattttttgtttttgatttaatgtaacagtagtgcctttcaagtgatgtcttaattttcttttttatccytagttaaatctaaactagggttttgttaacaaggattttgttatcctctgtatagttagcaggaagtggagtgaaacactccataaaatacactttacaaaacactttataaatctttagaaaaacgtagttttttttctttcctggtaaccttgagatgctgataatctctgctcaagcatgatttcatcagcacttctaaatttcatgagtaggcacaatctttccctcaacactcacagcttggactgctaccctcccttcctttgcctcgaggtccaaaaattacacaatatgcca

SEQ ID NO: 76386 - DNA, 601 bp, Human
actatgccagggaaagtggttcagcctgtggttagatattgatggctggagtttgggagagaagtcagggtcataggcctagagactggtatttagtgagtgagatctgagggagaaaatagtaagcacagttcgccagtcaaggactatctatcccaatctttattttttgtttttgatttaatgtaacagtagtgcctttcaagtgatgtcttaattttcttttttatccctagttaaatctaaactagggttttgttaacaaggattttgttatcctctgtatagttagcaggaagtrgagtgaaacactccataaaatacactttacaaaacactttataaatctttagaaaaacgtagttttttttctttcctggtaaccttgagatgctgataatctctgctcaagcatgatttcatcagcacttctaaatttcatgagtaggcacaatctttccctcaacactcacagcttggactgctaccctcccttcctttgcctcgaggtccaaaaattacacaatatgccacagcctgagtcaactcagcacacacttcctgagttcccggaacttaaaataattcagaaaaaagaaat

SEQ ID NO: 76387 - DNA, 592 bp, Human
gtgagtgagatctgagggagaaaatagtaagcacagttcgccagtcaaggactatctatcccaatctttattttttgtttttgatttaatgtaacagtagtgcctttcaagtgatgtcttaattttcttttttatccctagttaaatctaaactagggttttgttaacaaggattttgttatcctctgtatagttagcaggaagtggagtgaaacactccataaaatacactttacaaaacactttataaatctttagaaaaacgtagttttttttctttcctggtaaccttgagatgctrataatctctgctcaagcatgatttcatcagcacttctaaatttcatgagtaggcacaatctttccctcaacactcacagcttggactgctaccctcccttcctttgcctcgaggtccaaaaattacacaatatgccacagcctgagtcaactcagcacacacttcctgagttcccggaacttaaaataattcagaaaaaagaaatgtgtgctttgggaggggagttcatctggaaagcttatatgggaaagctgtggtctgaactttgaaggggaatgtaagattttgaga

SEQ ID NO: 76388 - DNA, 601 bp, Human
gctcctaggtttcaactattgctctagatagaagaattacctgcaagaaaaaaagcaggtctgcttggatagctcagacagaagattaggaaagctttatttgcctatctggatatgcttctttccctttctccaaaccctgaacttagaggcctctacaaagctgaatagaaacctgttgggcagcttcactggggagatgagaggatgtgggactactcactagcttcaaatagatgtgcaacaagtaaattactgcatttacaagaccaaacatattttcatgctgccttttttatgrtggtaggtggtggagtaggaggagatgggaataggataggggagaggaaaaggggagagagggaagtaacttaaactctttggtcattccaaagagtatgtgtggtcaagaaatgttacgtcttcactagttagcaaggcacattgctgagattttagaagctcaaaagcaaaagttctttcttccgcaggccgagtgtttgtccatgaatgggcccacctccgttggggtgtgttcgatgagtataacaatgacaaacctttctacataaatgggcaaaatcaaattaaagtgacaagg

SEQ ID NO: 76389 - DNA, 601 bp, Human
aaaccctgaacttagaggcctctacaaagctgaatagaaacctgttgggcagcttcactggggagatgagaggatgtgggactactcactagcttcaaatagatgtgcaacaagtaaattactgcatttacaagaccaaacatattttcatgctgccttttttatgatggtaggtggtggagtaggaggagatgggaataggataggggagaggaaaaggggagagagggaagtaacttaaactctttggtcattccaaagagtatgtgtggtcaagaaatgttacgtcttcactagttascaaggcacattgctgagattttagaagctcaaaagcaaaagttctttcttccgcaggccgagtgtttgtccatgaatgggcccacctccgttggggtgtgttcgatgagtataacaatgacaaacctttctacataaatgggcaaaatcaaattaaagtgacaaggttagtactttttttcatgttataattcattatttatttgactctaaaattgcttataacttaagcaattaaataattgcctaatttaagcaattaatttaattgcagctaaaacttagctgataagaaagagat

SEQ ID NO: 76390 - DNA, 601 bp, Human
ggggagagagggaagtaacttaaactctttggtcattccaaagagtatgtgtggtcaagaaatgttacgtcttcactagttagcaaggcacattgctgagattttagaagctcaaaagcaaaagttctttcttccgcaggccgagtgtttgtccatgaatgggcccacctccgttggggtgtgttcgatgagtataacaatgacaaacctttctacataaatgggcaaaatcaaattaaagtgacaaggttagtactttttttcatgttataattcattatttatttgactctaaaattgmttataacttaagcaattaaataattgcctaatttaagcaattaatttaattgcagctaaaacttagctgataagaaagagatcctttcacttttcagttcttaagttatatgacatttttctttaaattggtatttatgtggttcaaatatcaaaacaatataaaaagtcatgcttgtacctgtcttgcttgcagcactatcttcactgtttcccctcatgccctctaagtaaccactttgattagtttcttgtttattttttcaatatttcttcaggcaaattcaaatgaatagaaaca

SEQ ID NO: 76391 - DNA, 601 bp, Human
aattaaataattgcctaatttaagcaattaatttaattgcagctaaaacttagctgataagaaagagatcctttcacttttcagttcttaagttatatgacatttttctttaaattggtatttatgtggttcaaatatcaaaacaatataaaaagtcatgcttgtacctgtcttgcttgcagcactatcttcactgtttcccctcatgccctctaagtaaccactttgattagtttcttgtttattttttcaatatttcttcaggcaaattcaaatgaatagaaacatatgtttttcctcrctctgtgttttataattgcatagtgttccattatgtgactataccataatttattcaaccagtctcctcttggtggacacacaggttgtttcccatcttttgtattatcagtaacacgcagttcatagcattacacatgtgtcatttctcatacgtgcagacagattaacatatcaaattcttccaacaattactgagtcaaagggtgattttggtagctattgactgattcttctcctacaattgccactgttttacattcctatcaacaacatttgagatcgcttgtttaggaaagaa

SEQ ID NO: 76392 - DNA, 601 bp, Human
ggcttcccaaagtccatctggatttcctagtatcttttgctttgaccctatttagttgttaaagcccttgttaatacagaacccctccatcaagataaaatgctttaaaataaaatagagtgcatttctaaatcagtgaactttcttaatgaagcagttttttgtttgtttttgttgtttgtttgtttttttgtttgttttttgagacggagtttcgctcctgtcgcccaggctggagtgcaatggcacgatttcggctcactgaaacttctgccacctgggttcaagcaattctcctgcrtcagcctcctcagtagctaggattacaggtgcccaacaccacgcctggctaatttttgtatttttagtagagacagggtttcaccatgttggctaggctggtcttaaactcttgacctcaggtgatccaccagcctcagcctcccaaagtaatgggattacaggtgtgagccacagcaccccgccagtagagcagtttttaaagttttgtatatatctagcaggctacaatccttgtaacaattatataagctagtcaacaagaaacataagtgtttctaaaatagacctaattcccagt

SEQ ID NO: 76393 - DNA, 601 bp, Human
gtgcaatggcacgatttcggctcactgaaacttctgccacctgggttcaagcaattctcctgcgtcagcctcctcagtagctaggattacaggtgcccaacaccacgcctggctaatttttgtatttttagtagagacagggtttcaccatgttggctaggctggtcttaaactcttgacctcaggtgatccaccagcctcagcctcccaaagtaatgggattacaggtgtgagccacagcaccccgccagtagagcagtttttaaagttttgtatatatctagcaggctacaatccttgwaacaattatataagctagtcaacaagaaacataagtgtttctaaaatagacctaattcccagtttctctttccatttttaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtaagtatgcccttggaatgacacactcttgcaggattccttctcttcccatgtttcaa

SEQ ID NO: 76394 - DNA, 601 bp, Human
caatggcacgatttcggctcactgaaacttctgccacctgggttcaagcaattctcctgcgtcagcctcctcagtagctaggattacaggtgcccaacaccacgcctggctaatttttgtatttttagtagagacagggtttcaccatgttggctaggctggtcttaaactcttgacctcaggtgatccaccagcctcagcctcccaaagtaatgggattacaggtgtgagccacagcaccccgccagtagagcagtttttaaagttttgtatatatctagcaggctacaatccttgtaayaattatataagctagtcaacaagaaacataagtgtttctaaaatagacctaattcccagtttctctttccatttttaggtgttcatctgacatcacaggcatttttgtgtgtgaaaaaggtccttgcccccaagaaaactgtattattagtaagctttttaaagaaggatgcacctttatctacaatagcacccaaaatgcaactgcatcaataatgttcatgcaaagtttatcttctgtaagtatgcccttggaatgacacactcttgcaggattccttctcttcccatgtttcaagta

SEQ ID NO: 76395 - DNA, 601 bp, Human
ttcccatgtttcaagtatttaaattataagataattaagatgcactatactttagaacttgggggaccctagagttcatctagtttttatctacagatttaaaaattggaacccccaagataattacccaaatgataccttcaggaaagtgactatttgctttcctgggaggtttaacaaagggactctggggaccacaaaataaactgttcttatggtggtgttcttgtattctttcataagaaattacattgggttaatgagagtgatataacaaatggttataattctctcgtttgargtagcagaccactctgtatttgaaatgcctttcctcaatctctttcctttgttttgaatagtctagaacttaacagtaaggtatcaccaggagaagtcaaccaactctgctttgcagaaacccaaccttgtcaatattccatgctaactaactgacaagagactagcatataaatccagaatattattttttaaactattaattaaaaagagtactctgtcatgggcatctcatacttgcatcctctggccaacttattttctctctggatgaagcagcctggaacagccaattctcacc

SEQ ID NO: 76396 - DNA, 601 bp, Human
tagcatataaatccagaatattattttttaaactattaattaaaaagagtactctgtcatgggcatctcatacttgcatcctctggccaacttattttctctctggatgaagcagcctggaacagccaattctcaccagatgcatagtcagagagcatggaatcagaaacgagggagttaggtgattcagaggttagtagcatcagccttcatgacctgatatatctctcaaagttcacaaaagcctgtaagtcacatctgtgggtcatctcttcacagatctgggggtacagcccacacrtgcctctgtggagttttctctttgtgtccatggctgaccaatgccccttggattgacatgctattttatttcattctggttttagtcaggactagaagttattttgtaactttaagacaatttttcatatttcttgtcccatacattatgtttcttatttatagctttaatatctgatactaacctaatgcattcgatccacattatttatgactaggtactatcttcacgatgttttgaaagacctactcataaatatcttgtcagaaaagttttacaatcccataaccatagtcatga

SEQ ID NO: 76397 - DNA, 601 bp, Human
ttcctaagaaactcatgtccttaagcagttatcaacctttcaaagcttcagctttcttttctatgaagttagagctgagacaagagaggctattcagttgcttctaactctaagtttccatggctctgttaatgggaagtatcgactctttgtaggaatagagccactgggaatagatggtgatgcattacttagcaatgcaaaccatatttttaagtggggtattgacataggttcagtatcatttagtgaattatatctatatttctgtaaattatatctatatttccaaattgagtgsgggtggggggatcaggaagtaaatttaagttgtttatccccttatctatttttacagagatcaatatttgaggtagaaaaatatatattgactgatcaacaaataaaggtgcagtggtcattaaatattattccaaggagtaggctgatcatgataacttcttctggctgttttcctaatacaatattgtgctaagggaagagggagattgttttgttttgtttttaagagtaagattatgtatatatatacacatacatggtttgttatctaataccaataaactttaatagagattgc

SEQ ID NO: 76398 - DNA, 601 bp, Human
actcatgtccttaagcagttatcaacctttcaaagcttcagctttcttttctatgaagttagagctgagacaagagaggctattcagttgcttctaactctaagtttccatggctctgttaatgggaagtatcgactctttgtaggaatagagccactgggaatagatggtgatgcattacttagcaatgcaaaccatatttttaagtggggtattgacataggttcagtatcatttagtgaattatatctatatttctgtaaattatatctatatttccaaattgagtgggggtggggggatcaggaagtaaatttaagttgtttatccccttatctatttttacagagatcaatatttgaggtagaaaaatatatattgactgatcaacaaataaaggtgcagtggtcattaaatattattccaaggagtaggctgatcatgataacttcttctggctgttttcctaatacaatattgtgctaagggaagagggagattgttttgttttgtttttaagagtaagattatgtatatatatacacatacatggtttgttatctaataccaataaactttaatagagattgctctcagaacc

SEQ ID NO: 76399 - DNA, 601 bp, Human
ggctattcagttgcttctaactctaagtttccatggctctgttaatgggaagtatcgactctttgtaggaatagagccactgggaatagatggtgatgcattacttagcaatgcaaaccatatttttaagtggggtattgacataggttcagtatcatttagtgaattatatctatatttctgtaaattatatctatatttccaaattgagtgggggtggggggatcaggaagtaaatttaagttgtttatccccttatctatttttacagagatcaatatttgaggtagaaaaatatatrttgactgatcaacaaataaaggtgcagtggtcattaaatattattccaaggagtaggctgatcatgataacttcttctggctgttttcctaatacaatattgtgctaagggaagagggagattgttttgttttgtttttaagagtaagattatgtatatatatacacatacatggtttgttatctaataccaataaactttaatagagattgctctcagaaccacaaagatgctagtgttcccagcaagaatgccaaggtttatttgtaatttgatgtcattcttgaaggaaagaggtat

SEQ ID NO: 76400 - DNA, 601 bp, Human
cagtatcatttagtgaattatatctatatttctgtaaattatatctatatttccaaattgagtgggggtggggggatcaggaagtaaatttaagttgtttatccccttatctatttttacagagatcaatatttgaggtagaaaaatatatattgactgatcaacaaataaaggtgcagtggtcattaaatattattccaaggagtaggctgatcatgataacttcttctggctgttttcctaatacaatattgtgctaagggaagagggagattgttttgttttgtttttaagagtaagwttatgtatatatatacacatacatggtttgttatctaataccaataaactttaatagagattgctctcagaaccacaaagatgctagtgttcccagcaagaatgccaaggtttatttgtaatttgatgtcattcttgaaggaaagaggtatatcactgtaccacttttgatttcttttctttcagttcaccttttcttttacctatagttccttgagaatgagaactatgtttgctttgggagaagtgcctctctttattaaagactgtttttatttccaggtggttgaattttgtaatg

SEQ ID NO: 76401 - DNA, 601 bp, Human
ttatcctgatgctctccctccctgctgtcacccaggctggagtgcagtggcacaatttcagctcactgcagcctcgacctctagggctcaagtgatcttcccatctcagtcttccaagtagctgggactacaggtgcgggacaccatgccttttctatcagtttttaattatttttattttcaggaggtaagggtgagagttggaggaggcaaaaggtttggaatagtcaaggacatcctattttttgggggttgggaggaacaaattcagaatgtggccaaaagttgagataatgcagayaaatgaaatccacagataatttctaacccttatttttgctactaattgaaactctttccaacaaagatccttttccaaaattcttacctataatgatcaaaaattcttatgtataatgaaaagttcctgctggctacattctactcactggtaaatatccctggttgaggaagtaaactgtgaatttgcagtgaaagtgaatgtccattatatggctattttccatgtcattgtgtacagaagaccatatctcagtcatctagcaatctagcagcctccagctgctttaactgattaaag

SEQ ID NO: 76402 - DNA, 601 bp, Human
cccatctcagtcttccaagtagctgggactacaggtgcgggacaccatgccttttctatcagtttttaattatttttattttcaggaggtaagggtgagagttggaggaggcaaaaggtttggaatagtcaaggacatcctattttttgggggttgggaggaacaaattcagaatgtggccaaaagttgagataatgcagataaatgaaatccacagataatttctaacccttatttttgctactaattgaaactctttccaacaaagatccttttccaaaattcttacctataatgatcraaaattcttatgtataatgaaaagttcctgctggctacattctactcactggtaaatatccctggttgaggaagtaaactgtgaatttgcagtgaaagtgaatgtccattatatggctattttccatgtcattgtgtacagaagaccatatctcagtcatctagcaatctagcagcctccagctgctttaactgattaaagtcttagtctccacaatcaggcagctgtgttttaatcctggctgcttcactactgtgtaatatgtcttcgttataaagagcatgatggcccctctgaagc

SEQ ID NO: 76403 - DNA, 601 bp, Human
gtggccaagaggcaaaaaaagaaggatttgttcaagggaagggcattcatttgtatgactataactaacactgggtagatctgagaggtggcgaatgggatagagacataggtatggatttgagagaaatttaagatattgagttgatgggacctgttcaagaatatggaggctggtaacagaaatggtaagagagtcctgggttgctggcttagctagctgggagtagagatcaagattgggagtgatgatctgatgaccatgaagatggcaatagctattctattgtgagtgcttactyagtatccattttgcagatgagaaaactgaagctaaaaaaaaaaagtaattttactatgatcacataattagcaaaagttgaaggcagagttctaagtccttgttttaccccctttacaacttacttcccaatattgtaagagaaacagtattagaattcaaagtgtagagttgccatcttcatggttgtcaaatcatcactcccaactagttaagccagaaacctgtgtcctaagaagtgtgaaatgcaggtctagatccacccaggaagatgcttgagttggagatagagatcagtgtc

SEQ ID NO: 76404 - DNA, 601 bp, Human
tcacttgatcctcatggcaattctaatttcataaacaagaaagctatcatcctcactctacagatgaagtacccagcctaaggtgaccacaatagcagagggtagtgccggggcagatcatgggtcctctgactgccactcctctctagcaaaggtctctttgcaatgttttcttttacctggactgcatttttaaaacagcagttacaaatttcgtctcagctgggttcatgaatctttgaattctaagttggagtgaaatagtggggatgatgagaaacagagagtggtaaattatgarcatcttgttggaggcagagccccaagccactccctcttccctgaaagcatgcatttttgagcctgcaattaatcaaacaatattctaatattatgttactctttaaagctcaaaaaattatgatccaacatctctaaagaattagcagagatgtttgctaattgagttacttcatcatacttttgtctactaaccaaatgttgccattttcttttttcctttttgggacataggctgacagactccttcaactacaacaagctgcagaattttatttgatgcagattgttgaaattcata

SEQ ID NO: 76405 - DNA, 601 bp, Human
ttcataaacaagaaagctatcatcctcactctacagatgaagtacccagcctaaggtgaccacaatagcagagggtagtgccggggcagatcatgggtcctctgactgccactcctctctagcaaaggtctctttgcaatgttttcttttacctggactgcatttttaaaacagcagttacaaatttcgtctcagctgggttcatgaatctttgaattctaagttggagtgaaatagtggggatgatgagaaacagagagtggtaaattatgaacatcttgttggaggcagagccccaagycactccctcttccctgaaagcatgcatttttgagcctgcaattaatcaaacaatattctaatattatgttactctttaaagctcaaaaaattatgatccaacatctctaaagaattagcagagatgtttgctaattgagttacttcatcatacttttgtctactaaccaaatgttgccattttcttttttcctttttgggacataggctgacagactccttcaactacaacaagctgcagaattttatttgatgcagattgttgaaattcataccttcgtgggcattgccagtttcgaca

SEQ ID NO: 76406 - DNA, 601 bp, Human
gggacataggctgacagactccttcaactacaacaagctgcagaattttatttgatgcagattgttgaaattcataccttcgtgggcattgccagtttcgacagcaaaggagagatcagagcccagctacaccaaattaacagcaatgatgatcgaaagttgctggtttcatatctgcccaccactgtatcagctaaaacagacatcagcatttgttcagggcttaagaaaggatttgaggtacagtagagcatcctaagccttggatcaccatcattttcctttccctcttttagtataygaggtttcctctgatgatgggcagtttgttacagggtggtcataacagcctcaactatgaaagtaatgatggattatctttcaagtcaggaaccatgccttattcaccattgtactccttgtgcctagcaaagtacatagcatacaatagttgcttaataaatacttgttgacagaataagaaaataaatgaatacaatggatgagactagaggacctaaacaacatctgggcattttctaaactgttcctagccattctgggccatttttacctttcaattttcttgtcaaaatcagca

SEQ ID NO: 76407 - DNA, 601 bp, Human
ggtttcatatctgcccaccactgtatcagctaaaacagacatcagcatttgttcagggcttaagaaaggatttgaggtacagtagagcatcctaagccttggatcaccatcattttcctttccctcttttagtatacgaggtttcctctgatgatgggcagtttgttacagggtggtcataacagcctcaactatgaaagtaatgatggattatctttcaagtcaggaaccatgccttattcaccattgtactccttgtgcctagcaaagtacatagcatacaatagttgcttaataaatrcttgttgacagaataagaaaataaatgaatacaatggatgagactagaggacctaaacaacatctgggcattttctaaactgttcctagccattctgggccatttttacctttcaattttcttgtcaaaatcagcatgtctagcttctgtctatagtcattctagacttcacgcacatcagaaccaattaaggcaacacatcacaattaaggccagaagtgtgtttcaggaatgacagagtttatttaaatcaacacaagtttgcattcagcatctgggatgcttatctgatagcaaaca

SEQ ID NO: 76408 - DNA, 601 bp, Human
caccactgtatcagctaaaacagacatcagcatttgttcagggcttaagaaaggatttgaggtacagtagagcatcctaagccttggatcaccatcattttcctttccctcttttagtatacgaggtttcctctgatgatgggcagtttgttacagggtggtcataacagcctcaactatgaaagtaatgatggattatctttcaagtcaggaaccatgccttattcaccattgtactccttgtgcctagcaaagtacatagcatacaatagttgcttaataaatacttgttgacagaatragaaaataaatgaatacaatggatgagactagaggacctaaacaacatctgggcattttctaaactgttcctagccattctgggccatttttacctttcaattttcttgtcaaaatcagcatgtctagcttctgtctatagtcattctagacttcacgcacatcagaaccaattaaggcaacacatcacaattaaggccagaagtgtgtttcaggaatgacagagtttatttaaatcaacacaagtttgcattcagcatctgggatgcttatctgatagcaaacaagacacatcagctat

SEQ ID NO: 76409 - DNA, 601 bp, Human
catcagcatttgttcagggcttaagaaaggatttgaggtacagtagagcatcctaagccttggatcaccatcattttcctttccctcttttagtatacgaggtttcctctgatgatgggcagtttgttacagggtggtcataacagcctcaactatgaaagtaatgatggattatctttcaagtcaggaaccatgccttattcaccattgtactccttgtgcctagcaaagtacatagcatacaatagttgcttaataaatacttgttgacagaataagaaaataaatgaatacaatggaygagactagaggacctaaacaacatctgggcattttctaaactgttcctagccattctgggccatttttacctttcaattttcttgtcaaaatcagcatgtctagcttctgtctatagtcattctagacttcacgcacatcagaaccaattaaggcaacacatcacaattaaggccagaagtgtgtttcaggaatgacagagtttatttaaatcaacacaagtttgcattcagcatctgggatgcttatctgatagcaaacaagacacatcagctatggtttttgctgcccatggtctaaa

SEQ ID NO: 76410 - DNA, 601 bp, Human
atcagcatttgttcagggcttaagaaaggatttgaggtacagtagagcatcctaagccttggatcaccatcattttcctttccctcttttagtatacgaggtttcctctgatgatgggcagtttgttacagggtggtcataacagcctcaactatgaaagtaatgatggattatctttcaagtcaggaaccatgccttattcaccattgtactccttgtgcctagcaaagtacatagcatacaatagttgcttaataaatacttgttgacagaataagaaaataaatgaatacaatggatragactagaggacctaaacaacatctgggcattttctaaactgttcctagccattctgggccatttttacctttcaattttcttgtcaaaatcagcatgtctagcttctgtctatagtcattctagacttcacgcacatcagaaccaattaaggcaacacatcacaattaaggccagaagtgtgtttcaggaatgacagagtttatttaaatcaacacaagtttgcattcagcatctgggatgcttatctgatagcaaacaagacacatcagctatggtttttgctgcccatggtctaaac

SEQ ID NO: 76411 - DNA, 601 bp, Human
tcataacagcctcaactatgaaagtaatgatggattatctttcaagtcaggaaccatgccttattcaccattgtactccttgtgcctagcaaagtacatagcatacaatagttgcttaataaatacttgttgacagaataagaaaataaatgaatacaatggatgagactagaggacctaaacaacatctgggcattttctaaactgttcctagccattctgggccatttttacctttcaattttcttgtcaaaatcagcatgtctagcttctgtctatagtcattctagacttcacgcayatcagaaccaattaaggcaacacatcacaattaaggccagaagtgtgtttcaggaatgacagagtttatttaaatcaacacaagtttgcattcagcatctgggatgcttatctgatagcaaacaagacacatcagctatggtttttgctgcccatggtctaaaccttggctatctattgaaatcacctggggattaaaaaaaatactaatgtgtgagtctaacccccagagattctgatttaattgatctgggatgtgacctgaccattaaaattgtttaagtctccacatttgattcta

SEQ ID NO: 76412 - DNA, 601 bp, Human
aagtcaggaaccatgccttattcaccattgtactccttgtgcctagcaaagtacatagcatacaatagttgcttaataaatacttgttgacagaataagaaaataaatgaatacaatggatgagactagaggacctaaacaacatctgggcattttctaaactgttcctagccattctgggccatttttacctttcaattttcttgtcaaaatcagcatgtctagcttctgtctatagtcattctagacttcacgcacatcagaaccaattaaggcaacacatcacaattaaggccagaaktgtgtttcaggaatgacagagtttatttaaatcaacacaagtttgcattcagcatctgggatgcttatctgatagcaaacaagacacatcagctatggtttttgctgcccatggtctaaaccttggctatctattgaaatcacctggggattaaaaaaaatactaatgtgtgagtctaacccccagagattctgatttaattgatctgggatgtgacctgaccattaaaattgtttaagtctccacatttgattctaacgtgtagccaagactgagaaccactgctctaggtggtcactt

SEQ ID NO: 76413 - DNA, 601 bp, Human
taaaattgtttaagtctccacatttgattctaacgtgtagccaagactgagaaccactgctctaggtggtcacttactggatctcagaggcaagcctctcacacaataatgtattccacatcttctatgatggatacagttctaaactatggggacaccttgatgattcaagcaggaaaagtccctgctcacaagcaaactggcagtggaatgtagggtgacaagtgctgtgatggggtgaggtaaaacttgagtggagatgggcgtggggtgtaggagctacagtgggaatttggatgasagtgaattcttttgctcaataaaacaatttgaactacacttccttccaagtgactaattctctatgttcaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggtaataaacttttaaaaacttatcttttggagcatgtccctttaacttgac

SEQ ID NO: 76414 - DNA, 601 bp, Human
taattctctatgttcaggtggttgaaaaactgaatggaaaagcttatggctctgtgatgatattagtgaccagcggagatgataagcttcttggcaattgcttacccactgtgctcagcagtggttcaacaattcactccattgccctgggttcatctgcagccccaaatctggaggaattatcacgtcttacaggtaataaacttttaaaaacttatcttttggagcatgtccctttaacttgactatccaagacacaactatgaaactcattatatggcttaattgaaaatacagaaaytgtttttaaaaaacgcacacacatattgctagaatctgtcaaaattttgctgattttttttttacattttccctaaaggttccaactatatacatccaaaaaataatattttataattctgtgttaagccagtgtgagcatgcataatcatggagctaaaacatatgtttaagattaaatgctttgtgggcgggcgcggtggctcacacctgtaatcccagcacattgggaggctgaggtgggcggatcgcttgaggtcaggagtttgagaccagcctggccaacatggtaaaaccccac

SEQ ID NO: 76415 - DNA, 601 bp, Human
tagtgaccagcggagatgataagcttcttggcaattgcttacccactgtgctcagcagtggttcaacaattcactccattgccctgggttcatctgcagccccaaatctggaggaattatcacgtcttacaggtaataaacttttaaaaacttatcttttggagcatgtccctttaacttgactatccaagacacaactatgaaactcattatatggcttaattgaaaatacagaaactgtttttaaaaaacgcacacacatattgctagaatctgtcaaaattttgctgattttttttttacattttccctaaaggttccaactatatacatccaaaaaataatattttataattctgtgttaagccagtgtgagcatgcataatcatggagctaaaacatatgtttaagattaaatgctttgtgggcgggcgcggtggctcacacctgtaatcccagcacattgggaggctgaggtgggcggatcgcttgaggtcaggagtttgagaccagcctggccaacatggtaaaaccccacttctactaaaaatacaaaaattagcagagcatggtggcgggtccctatactcccagctactcg

SEQ ID NO: 76416 - DNA, 601 bp, Human
taaacttttaaaaacttatcttttggagcatgtccctttaacttgactatccaagacacaactatgaaactcattatatggcttaattgaaaatacagaaactgtttttaaaaaacgcacacacatattgctagaatctgtcaaaattttgctgattttttttttacattttccctaaaggttccaactatatacatccaaaaaataatattttataattctgtgttaagccagtgtgagcatgcataatcatggagctaaaacatatgtttaagattaaatgctttgtgggcgggcgcgrtggctcacacctgtaatcccagcacattgggaggctgaggtgggcggatcgcttgaggtcaggagtttgagaccagcctggccaacatggtaaaaccccacttctactaaaaatacaaaaattagcagagcatggtggcgggtccctatactcccagctactcgggaggctgaggcaggagaatcactagaactcaggaggcagaggttgcagtcacctgagatcacgctactgcactccagcctgggtgacagagcgagaccccatctcaaaaaagaaaaagattaaatgcactaactt

SEQ ID NO: 76417 - DNA, 601 bp, Human
ctatccaagacacaactatgaaactcattatatggcttaattgaaaatacagaaactgtttttaaaaaacgcacacacatattgctagaatctgtcaaaattttgctgattttttttttacattttccctaaaggttccaactatatacatccaaaaaataatattttataattctgtgttaagccagtgtgagcatgcataatcatggagctaaaacatatgtttaagattaaatgctttgtgggcgggcgcggtggctcacacctgtaatcccagcacattgggaggctgaggtgggcrgatcgcttgaggtcaggagtttgagaccagcctggccaacatggtaaaaccccacttctactaaaaatacaaaaattagcagagcatggtggcgggtccctatactcccagctactcgggaggctgaggcaggagaatcactagaactcaggaggcagaggttgcagtcacctgagatcacgctactgcactccagcctgggtgacagagcgagaccccatctcaaaaaagaaaaagattaaatgcactaacttctataatagggacacacacagtgttttaagatacatatctttttat

SEQ ID NO: 76418 - DNA, 601 bp, Human
gctaaaacatatgtttaagattaaatgctttgtgggcgggcgcggtggctcacacctgtaatcccagcacattgggaggctgaggtgggcggatcgcttgaggtcaggagtttgagaccagcctggccaacatggtaaaaccccacttctactaaaaatacaaaaattagcagagcatggtggcgggtccctatactcccagctactcgggaggctgaggcaggagaatcactagaactcaggaggcagaggttgcagtcacctgagatcacgctactgcactccagcctgggtgacagarcgagaccccatctcaaaaaagaaaaagattaaatgcactaacttctataatagggacacacacagtgttttaagatacatatctttttatactaaataaggcacagaataattttatcttatattccttattcaataaaaaatgggcatgctgatttgacaaatgaaaggttttattgaattatctttaaaagcaatgttttcagaatataaatgtaaacatatagggatgtaaatagcaattaacctaaattatcttaaaattaccttaatctgaagactattcaataaatatttattg

SEQ ID NO: 76419 - DNA, 601 bp, Human
aacactcctatcatgtatttcaggaggtttaaagttctttgttccagatatatcaaactccaatagcatgattgatgctttcagtagaatttcctctggaactggagacattttccagcaacatattcaggtcagaattttctcaatgttatatttccaggtggggagtgggaagggagaaggaaacaagggaaatcaacgaattgtgctacctgcttcattaaccttacttgaatatgtaacagctgtgtatggaaggcttttaaaaggctgcttggcatcaccagagccaggctttcarccctaggagccatttaccacaattgccacctcagcttttcaaagtctgcgagtggagcttgttcctttcttgtggctcaagtgcagatgggggtgtggcagaggcaaggtgcagaagaaaaataaggaactgtgaatttacttttagtgttatagtaactttctgtcaatcagaattcatcttatttttgcttcttcaacatctttgaagctcttccttgtataaggggtatcaactatttcattaaattctaccacaaatatctaaatatctctttgactaccacaacttacatgattt

SEQ ID NO: 76420 - DNA, 601 bp, Human
gcttgatgtgaccaatgcagcctgtcaatttatttaacgtgaagattatatttacacagtgaaggcaataaacacaattccacaataagaagtaaaaatgtgaattatatatgacaatatctagtacagattaggctacaattggctcttctgataatgctcaatctttatgccctgtgacttcctctgcaacaatagggaataaaaacaaatgtttaaagaagtaaaaaataaatttaacaaaatattactcatatgggatcaaataagccttaacgttcccaaacttgtccccctcccsacaagctgttggagtcattagctccattggagtgaggtgggaactacatgtaaatcttcttcaacagcccagggcccagcatagcatgtggcccagccatcagcaatccataaatatttcttaaattcatttgaacaaacaattcacaatgtctttgctgttatccaccaatataattttacacgctttgcagatttgagcaattaacgaagcattactaatgtgcttatttaataaatgtaaattttcaaagttatttagagacttgtatccattggaaatacgcagtaattaaatgca

SEQ ID NO: 76421 - DNA, 601 bp, Human
atttatcacagaggatttttataaggatcaagtgagattgtgaagcctttagcatggggccaggcatacgtttgtactctgtacatgttacacatgtgtgtgcacacacgtggcttattatgaatggctaaataattttttttttttttgagatggagtcttgctcttctcccaggctggagtgcagtggcgcgatctcagctcactgcagcctccacctccttggttcaagcaatttccctgcctcagtctcccgagcacctgggattacaggcacatgccaccacacctgactaatttkttggtatttttagtacagaaagggtttcaccatgttggccagactagtctcaaactcctgacctcaggcaatccactcgccttggcctcccaaagtgctgggattacaggcatgagccactgtgcccggcctaaataattttttaacgtagcaaaaccatgccaaaacccaagattttatttcttatcgaaatatataaaaggatctggacagattatatacaaattaataaaatttaagcatattcacaaatgaaaatttttaaaagcttgtcattgtaattgctgatctgaggccaat

SEQ ID NO: 76422 - DNA, 601 bp, Human
tgagatggagtcttgctcttctcccaggctggagtgcagtggcgcgatctcagctcactgcagcctccacctccttggttcaagcaatttccctgcctcagtctcccgagcacctgggattacaggcacatgccaccacacctgactaatttgttggtatttttagtacagaaagggtttcaccatgttggccagactagtctcaaactcctgacctcaggcaatccactcgccttggcctcccaaagtgctgggattacaggcatgagccactgtgcccggcctaaataattttttaacrtagcaaaaccatgccaaaacccaagattttatttcttatcgaaatatataaaaggatctggacagattatatacaaattaataaaatttaagcatattcacaaatgaaaatttttaaaagcttgtcattgtaattgctgatctgaggccaatgttggtttggataagagataatatgaggacagctaacatcttttaataaagaataatgaaatgacacttgcattaactacaacaaaatgttttatacctactgtacttaaataacatgcaatattttgctttgcaaagtattttttat

SEQ ID NO: 76423 - DNA, 601 bp, Human
ttttaaggggattggacacacaaacttcaggagggaagaatcccctctcccatggtagaatcctctatcttgataaaatggttgctttattggtcagattttggacttggatcgtctttgttataatattaatagtacagagcatgtaagattttctgcattcatttgaaattcctaataccaaccatcttttaatttataaaaaaatgagggaaacttataataaaacaaaaaatactaccctcacagacgattaatagcatgcaatctatgaaatattacatacattaaaagtctccamttactgtgtgcctggctcatcacacagtatccttccaagacgatctatagaattcaaaactgtacaaaaattttaaaatatgcagaaaacccaaaaggtattttgtaaaacaaagatcacacacacattagtactaaatagggaaaaaaaatcagcagacccatggactccccctgctcccaactgcaggtcttcagtatagaggatttcaccagtgtcttctgcactcccccaatccagtaggggtccaacagaccagctgcattcctcctgactgccaccaactctgttttctgcata

SEQ ID NO: 76424 - DNA, 601 bp, Human
actcagctgtgcccccagccactgtggaagcctttgtggaaagagacagcctccattttcctcatcctgtgatgatttatgccaatgtgaaacagggattttatcccattcttaatgccactgtcactgccacagttgagccagagactggagatcctgttacgctgagactccttgatgatggagcaggtaacaaggaatgtcatgacattttatcatcttctcaacagctgttgtgatatgatgcggtagtatcaatattaagcttatctgtaagattccttgagttcaatttttttttaatcttacaatattctcaaattcttatagagtcactgatatactgaatagctacaggttaacatggaaaaagagagtccttgtgagactcctcatagtgtctatgtttgagcaaagggtgggaggcagccgctggacaccttggtcctggcttccacttgctgaggtcatacaggagcaggcttctatgtccttatgacatacttatattcctctaagagtcactagctttattattcactgaagtaatcagattggactgttaaaatagcaaatgaaaatcagaagggaggtgcagtga

SEQ ID NO: 76425 - DNA, 601 bp, Human
gacagcgaacccactttttccctttggaccccagttatgaagaaaaaattggaaactgaacttgtgacctataagatgaccctagacccaagaggctgggttgaagagagggcacagctcagttctagcacagccaatgccttttacgtgtgtaatttggtcccaagaagacccagcctgcaagcctagtggaatcagaatagagaaaagttctcattctgcacatacagcattcagagcctcgtcatcatacattatagatggtatagcatccagccaggtaaacagcagcacttgggaycctttgaaaaacaaattcctttgttgttccatctttcctatttggttattttcctaaattacattcttagaatggcagtagacctgcctcttggcagcccgaagtgtttgatctgctaacaaaattatattcttttgccctgttgtttcaaagttaatcttttttcaagagtcttaagtttggtagcccatcagtatcttgccatggcaatcatgtatgatgtgcaggaaaacaaaagttcattcaaagggttttggttcaagtccaccactgggggataccagagaagtcttcttgttt

SEQ ID NO: 76426 - DNA, 601 bp, Human
actcccctagggaatatcgtctgattcagctcaattggcttttatattattccttggaactattttatttgtttgatatctaaatgtatgcactaaaaaaaggaacaataaaaaatactgctcaggcatcaaaatgtaaattgtttcccctccaatcaatacttaacacgcatgtacatagttgtttaatacttttataatggaagcagtatttatttgctcagtaaatgaactgtaataaaacttatacctctgaaatgatttacaatttaaaatgtactttttcatgcatactctcaartaatcatcacaacaaccctgcaagataagttatctccattttatagatgagaaaactgaggctcagagacatgaagcctcatagctactaagtgacagatgcaggccttcaaattaattcctctgtctcccaagccaatgttctttccccatttctttctgcctcagttattaaaagaggtggcagtggtgactttaatatggagagattttcctttgtaatttctcaacaaagataaaccttattaatcattaaatcactaaataccaagatttgatttcttacaacagacaaaaaaga

SEQ ID NO: 76427 - DNA, 601 bp, Human
ctctgatgggtatgtgtgtactggggtggcagggagtgagagaaagagagaatttcaaaactctttacgcttaagtccatacataatttgttgactgtttcttcaatcctcagtgattcatggtaggggggtaacaggaaggcgataggtaatgcccacagattatacctaacttcattttagtcattatgttgacctctttcttgtttcatcagaattactaatagataaagagatttactgggttttctcagttcctgcttctgtgtttcctctatagaggtttaggcaagagaaagargcaaaaagttattagcagttgaaagaaggaggccaacagcccaaacagtccacacaggaaatgagttcctaaataaatatgagcttggatgttacaggcaactaagtgattcctgaagatgttttgcttttcttcaagaaaaaagttcaaaataaatggaagatagttatctttttaacaccattataatagttcctgataggaagcggtggttaaagcataatagaccaacagaaatatatcatgctacagtctttgaaaacaatctcaaaaaagacttctaagcatttttatttccaa

SEQ ID NO: 76428 - DNA, 601 bp, Human
aaactctttacgcttaagtccatacataatttgttgactgtttcttcaatcctcagtgattcatggtaggggggtaacaggaaggcgataggtaatgcccacagattatacctaacttcattttagtcattatgttgacctctttcttgtttcatcagaattactaatagataaagagatttactgggttttctcagttcctgcttctgtgtttcctctatagaggtttaggcaagagaaagaggcaaaaagttattagcagttgaaagaaggaggccaacagcccaaacagtccacacargaaatgagttcctaaataaatatgagcttggatgttacaggcaactaagtgattcctgaagatgttttgcttttcttcaagaaaaaagttcaaaataaatggaagatagttatctttttaacaccattataatagttcctgataggaagcggtggttaaagcataatagaccaacagaaatatatcatgctacagtctttgaaaacaatctcaaaaaagacttctaagcatttttatttccaaaaatgcagattctttataaatattattcatgtattttagaagttataactaatcatt

SEQ ID NO: 76429 - DNA, 601 bp, Human
gttgactgtttcttcaatcctcagtgattcatggtaggggggtaacaggaaggcgataggtaatgcccacagattatacctaacttcattttagtcattatgttgacctctttcttgtttcatcagaattactaatagataaagagatttactgggttttctcagttcctgcttctgtgtttcctctatagaggtttaggcaagagaaagaggcaaaaagttattagcagttgaaagaaggaggccaacagcccaaacagtccacacaggaaatgagttcctaaataaatatgagcttggrtgttacaggcaactaagtgattcctgaagatgttttgcttttcttcaagaaaaaagttcaaaataaatggaagatagttatctttttaacaccattataatagttcctgataggaagcggtggttaaagcataatagaccaacagaaatatatcatgctacagtctttgaaaacaatctcaaaaaagacttctaagcatttttatttccaaaaatgcagattctttataaatattattcatgtattttagaagttataactaatcatttggactattccacaccatgattctatactttt

SEQ ID NO: 76430 - DNA, 601 bp, Human
tacctcctattttctggaattttttatcaggctctttttccagctcctccttttctaccaggcctctaaatgttgtctgagtctgaaccttcttactttaccatctggagccacattgcctggttttgaaacccagctcctccatttactagctgtgtgactttgggcaagtgacttagcttctgtgtgtctcagtttcatcatctaaaaaaataagggtaataattgtaccctcttcatagccttgttgggaaaattaaatatctgatacatgtaaggccttagaaaagtgcctggcacmtagaaggtgctcaaaaagtgctacttatcattatagtaataattattattagttaatctcattaatccatatgcctttaataacatctatctgtgtataacctccaaattcataactttaaaattattaaatttagctaaaatctcttctttaagcttaaaatccagatctaaatggctcattaacatcttgaattagatgttttacaggaatcacaaactttgtaatttaatttttgttctttttctccttatcctgcttctcctcccagcttgctcattttagaaacctggaagcttt

SEQ ID NO: 76431 - DNA, 601 bp, Human
agcttttttttttttttttttttttttcattttaaaccatgtttcttttcttcaccattctgtattcatatccatcaccagcttttgcttgacatctgcagaagacatcttgaactgccactttcttgccctcctctccacaccatctcccatcccaagctgctatcttctctcatctggactattgaatggctaagtggccgccttgttgcttgctgtgctttaattcattctacaccaagcagccagagtgtcctattagaaagcaaatataattttgtcacttcccttcttccctgcrgcatgtaacattaaaatctaaaatcactttggaccatgaggtcctgtgtaaacttctctcctgcctcatctcaaacgactctccttgcttttaatttagcttttctaacttgaaacctctttttcacctcagggtttgctgttccctctacctagaatgttcttccctctcttctttagctggacagttcctactcaacctttaggaagcctttcaatgttacctctttgataccacgctaaattactgacccacattattttctttcatagcatcctgtcttctttccttcttacactt

SEQ ID NO: 76432 - DNA, 601 bp, Human
caacctttaggaagcctttcaatgttacctctttgataccacgctaaattactgacccacattattttctttcatagcatcctgtcttctttccttcttacacttatcatactttgtaaatatatgtttattaatatgattaacatgactataaattccatgagggatactgttttgtctgtaattattggcacagcatatgccctccataagtatttactgaggccgggcacagtggctcactcctgtaatcctagcactttgggagacaaaggtgggcggatcacgaggacaggagttygagaccagcctagccaacatggtgaaaccctgtctctactaaaaatacaaaaattagctgcacgtggtgacgggcacctgtaatcccagctactcaggaggctgaggcaggagaattgcttgaacctgggaggcggaggttgcagtgagccaagattacaccactgcactccagcctggacagcagagtaagactctgtctcaaaataaaataaaataaagatctactgagtgaataaatggatgaattagtgttcaaagtattgtacaaatacactcagttattctagagatgtagtaa

SEQ ID NO: 76433 - DNA, 601 bp, Human
ctgctgtatctaacattgcccaggcgcctctgtttattccccccaattctgatcctgtacctgccagagattatcttatattgaaaggagttttaacagcaatgggtttgataggaatcatttgccttattatagttgtgacacatcatactttaagcaggaaaaagagagcagacaagaaagagaatggaacaaaattattataaataaatatccaaagtgtcttccttcttagatataagacccatggccttcgactacaaaaacatactaacaaagtcaaattaacatcaaaactgtrttaaaatgcattgagtttttgtacaatacagataagatttttacatggtagatcaacaaattctttttgggggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctc

SEQ ID NO: 76434 - DNA, 601 bp, Human
ggtagattagaaaacccttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatattttatatatgaagcccctaaygcaaagctctttacctcttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatata

SEQ ID NO: 76435 - DNA, 601 bp, Human
ttacactttggctatgaacaaataataaaaattattctttaaagtaatgtctttaaaggcaaagggaagggtaaagtcggaccagtgtcaaggaaagtttgttttattgaggtggaaaaatagccccaagcagagaaaaggagggtaggtctgcattataactgtctgtgtgaagcaatcatttagttactttgattaatttttcttttctccttatctgtgcagaacaggttgcttgtttacaactgaagatcatgctatattttatatatgaagcccctaatgcaaagctctttacctyttgctattttgttatatatattacagatgaaatctcactgctaatgctcagagatcttttttcactgtaagaggtaacctttaacaatatgggtattacctttgtctcttcataccggttttatgacaaaggtctattgaatttatttgtttgtaagtttctactcccatcaaagcagctttctaagttattgccttggttattatggatgatagttatagcccttataatgccttaactaaggaagaaaagatgttattctgagtttgttttaatacatatatgaacatatagttttat

SEQ ID NO: 76436 - DNA, 601 bp, Human; identical to SEQ ID NO: 38681

SEQ ID NO: 76437 - DNA, 601 bp, Human; identical to SEQ ID NO: 38682

SEQ ID NO: 76438 - DNA, 601 bp, Human; identical to SEQ ID NO: 38683

SEQ ID NO: 76439 - DNA, 601 bp, Human; identical to SEQ ID NO: 38684

SEQ ID NO: 76440 - DNA, 601 bp, Human; identical to SEQ ID NO: 38685

SEQ ID NO: 76441 - DNA, 601 bp, Human; identical to SEQ ID NO: 38686

SEQ ID NO: 76442 - DNA, 601 bp, Human; identical to SEQ ID NO: 38687

SEQ ID NO: 76443 - DNA, 601 bp, Human; identical to SEQ ID NO: 38688

SEQ ID NO: 76444 - DNA, 601 bp, Human; identical to SEQ ID NO: 38689

SEQ ID NO: 76445 - DNA, 601 bp, Human; identical to SEQ ID NO: 38690

SEQ ID NO: 76446 - DNA, 601 bp, Human; identical to SEQ ID NO: 38691

SEQ ID NO: 76447 - DNA, 601 bp, Human; identical to SEQ ID NO: 38692

SEQ ID NO: 76448 - DNA, 601 bp, Human; identical to SEQ ID NO: 38693

SEQ ID NO: 76449 - DNA, 601 bp, Human; identical to SEQ ID NO: 38694

SEQ ID NO: 76450 - DNA, 601 bp, Human
agcatccctggggcttcagaatctcttctgtaaggaccaggccaaatccagcaggagctaacatgtgagccagagcaaggtcttttctcccagaagcaggcggctgtcaggccaggcagacggtacacaccaaagaggggctttggaacatatccgtgactctcgctcgaaaaggcttacccctcttgtgttatgttccagcaaggcaagattttggggaactgaagctgagatctgacccgtcacctttatcatcatagctgccatttatttagcccctcctacgtgcaaagtgcttcckgtaaaccctctcatttaagtctcacaaccatgaaaggtacatgtggtcatctccattttctagacaaggaaagtgaggctcaaaaaggctgagacgattgtccagagttacccagccagtaagtggccgggaaggaagtccagctctctgcaggcctcagaggcttgagctccttccctaaactggtcagtgagcgccaaagcctggagctggatcccggagtggattctccctatccccatcctggcctgtcccacccctaaaactgccccagacttgcctcctggggccaggcagccc

SEQ ID NO: 76451 - DNA, 601 bp, Human
gctgcttgtttatagctcaccaatgactcagaagcgaactgaatagattctgagaaattaaaactagaagctcaatgccagttacatacccatcaatcagaaaagaagcatggctggagttttccataggaactatgcttcagagctgggacgtaaaagcgggacatacctgcacatctcgtaaccccaacagccacacctgcatctcaaagcctccactgcccctgccctgcacttccccagaaaccacgggcagtctcgaggggaggggcctgtgccctggcagatagtaccaggtccycagacttctgtttgccacacacttgagctaaaaatttccacataaaaatctcttttttgtggactttccagggccagatggggaaagaatgagcttgggctgcctggatggggcgtcagcagcatccctggggcttcagaatctcttctgtaaggaccaggccaaatccagcaggagctaacatgtgagccagagcaaggtcttttctcccagaagcaggcggctgtcaggccaggcagacggtacacaccaaagaggggctttggaacatatccgtgactctcgctcgaaaaggcttac

SEQ ID NO: 76452 - DNA, 601 bp, Human
cctgccctgtatgggaaacccagcaaagggactcacaaaccagataagataagtcaggagttgactgcattaattaaacattctcctagctgcttgtttatagctcaccaatgactcagaagcgaactgaatagattctgagaaattaaaactagaagctcaatgccagttacatacccatcaatcagaaaagaagcatggctggagttttccataggaactatgcttcagagctgggacgtaaaagcgggacatacctgcacatctcgtaaccccaacagccacacctgcatctcaaagmctccactgcccctgccctgcacttccccagaaaccacgggcagtctcgaggggaggggcctgtgccctggcagatagtaccaggtccccagacttctgtttgccacacacttgagctaaaaatttccacataaaaatctcttttttgtggactttccagggccagatggggaaagaatgagcttgggctgcctggatggggcgtcagcagcatccctggggcttcagaatctcttctgtaaggaccaggccaaatccagcaggagctaacatgtgagccagagcaaggtcttttctccca

SEQ ID NO: 76453 - DNA, 601 bp, Human
acacagagaccctccctaccctttgaggctggtgccacagcctggccaagcataggaagttgggtaggagttgactgggaacaaagtcttgaccaggatggtgcccagggagacccaggaagcccctctgcctctcagctgaaatgccttggggctcggggaggtgggaacttggctgatcctccccattgggaatctgcctgccctgtatgggaaacccagcaaagggactcacaaaccagataagataagtcaggagttgactgcattaattaaacattctcctagctgcttgtttatagctcaccaatgactcagaagcgaactgaatagattctgagaaattaaaactagaagctcaatgccagttacatacccatcaatcagaaaagaagcatggctggagttttccataggaactatgcttcagagctgggacgtaaaagcgggacatacctgcacatctcgtaaccccaacagccacacctgcatctcaaagcctccactgcccctgccctgcacttccccagaaaccacgggcagtctcgaggggaggggcctgtgccctggcagatagtaccaggtccccagacttctgttt

SEQ ID NO: 76454 - DNA, 601 bp, Human
agacccagggagagctactgaagaggttagccaggctgtgaaaagctactgctgggctgtgaaggccagagcgctctctcccacttcctaaagaaggcgcagctttccagcccttaactccctctgctctcactttctagaggtcagggaagcagaggtgtcctctgagacatccctgcagctggcagccctgacaacaagctggctcatccaaaatcctctccaggtttggatctctagggacaaatggccacccaaagatgcagctccccacaagctctgtattcgccccccatggggtctgtgtgtgtgtgccgtcgtgggccaggttccctagcctccccacacagagaccctccctaccctttgaggctggtgccacagcctggccaagcataggaagttgggtaggagttgactgggaacaaagtcttgaccaggatggtgcccagggagacccaggaagcccctctgcctctcagctgaaatgccttggggctcggggaggtgggaacttggctgatcctccccattgggaatctgcctgccctgtatgggaaacccagcaaagggactcacaaaccagataagataagtcagg

SEQ ID NO: 76455 - DNA, 601 bp, Human
cacagggctgttgtagccaataaactgcaagtactgggtaagtgtggggatgaagggagaaggaagatgctctgcgtcccactcatccagggaaaaagctgagttcctgtgggtagtatccctatcatcaaggcaagggaagcgccaggcaggcacggcagatgcagccaggggcacccccagcatcacaagcccatcaagcagcctcactggccctgacttctatgcagtttatcacaaaccactcacagacccagggagagctactgaagaggttagccaggctgtgaaaagctactgytgggctgtgaaggccagagcgctctctcccacttcctaaagaaggcgcagctttccagcccttaactccctctgctctcactttctagaggtcagggaagcagaggtgtcctctgagacatccctgcagctggcagccctgacaacaagctggctcatccaaaatcctctccaggtttggatctctagggacaaatggccacccaaagatgcagctccccacaagctctgtattcgccccccatggggtctgtgtgtgtgtgccgtcgtgggccaggttccctagcctccccacacagag

SEQ ID NO: 76456 - DNA, 601 bp, Human
aatggccagaggctgctccctcttcaagggttctctaaataggtgaagataccgcagcgagagccctgggtacagaaaggcagtggagaagcccagagacactggacctggaagcagaaggcctgggtctgagacggtacctgggccctgccacacccacagggctgttgtagccaataaactgcaagtactgggtaagtgtggggatgaagggagaaggaagatgctctgcgtcccactcatccagggaaaaagctgagttcctgtgggtagtatccctatcatcaaggcaagggaagcsccaggcaggcacggcagatgcagccaggggcacccccagcatcacaagcccatcaagcagcctcactggccctgacttctatgcagtttatcacaaaccactcacagacccagggagagctactgaagaggttagccaggctgtgaaaagctactgctgggctgtgaaggccagagcgctctctcccacttcctaaagaaggcgcagctttccagcccttaactccctctgctctcactttctagaggtcagggaagcagaggtgtcctctgagacatccctgcagctggcagccctgac

SEQ ID NO: 76457 - DNA, 601 bp, Human
gatctccaggctagaaggacactgagtccacctgttggaccccaagatgataccacagccactctcatgagctctcaacttgccctttcgcgaggagagagcccacccttttgggcaggagttgggggtgagggctgccaataggaggcagctgctcaagctcctgggataccgtgaggatccccaagaaaagtccaagcccatgtggctggagaaagtcccttgaggcctggaagctttcagggcaagctgaaaacgtagaagtggttgtgcagaaggaagggcaattcccaatacaacrtggcttttccccagcctcttgcactgagaagccaagaagggtgactccttcatccttcaatgggagctcaccactcccacgggcacgggccaagaggcagaagaaaatcaatgtccaaatgggttgctgtgccctgatatgtctctccacagcccttgtctgaatggccagaggctgctccctcttcaagggttctctaaataggtgaagataccgcagcgagagccctgggtacagaaaggcagtggagaagcccagagacactggacctggaagcagaaggcctgggtctgagacggt

SEQ ID NO: 76458 - DNA, 601 bp, Human
gccatgtggtctgagaggttcctgttccagggccccatgtgccatacaggacaggctaccaggcccaagacttcaatctaaggtcctcagacttcagagaagagcagcattcatggaagaaaggaatcttgaatgataggaaaacccggattatcccaaaatagttgttccacaccccctccccgacagtcagggcttcctgctctttgaagccttaaggcaccagcaagcagacacatgagccaccctgctcatctcctgggatgaggaaatgggatggcttgggcccagggatctccargctagaaggacactgagtccacctgttggaccccaagatgataccacagccactctcatgagctctcaacttgccctttcgcgaggagagagcccacccttttgggcaggagttgggggtgagggctgccaataggaggcagctgctcaagctcctgggataccgtgaggatccccaagaaaagtccaagcccatgtggctggagaaagtcccttgaggcctggaagctttcagggcaagctgaaaacgtagaagtggttgtgcagaaggaagggcaattcccaatacaacgtggctttt

SEQ ID NO: 76459 - DNA, 601 bp, Human
agtggcaggcaggagggacagtgggcaggcagcttctgtggccagcagaacagcagaagcaaagctgaattcaggccacctggaggcagctcatccagccccagccccttggtcctttctgctcccgcctggcccaacctcgggactggagctgacgcccaggtctgaatctgccctcctgaacctgccttccaaggttcagactggaaaattccttgtggatttctgctgtgaaggctttcctaatcccacagcaaaaacccacaaggagtgttgttctagtgggagctcagtccttttmggaggttctggccatgtggtctgagaggttcctgttccagggccccatgtgccatacaggacaggctaccaggcccaagacttcaatctaaggtcctcagacttcagagaagagcagcattcatggaagaaaggaatcttgaatgataggaaaacccggattatcccaaaatagttgttccacaccccctccccgacagtcagggcttcctgctctttgaagccttaaggcaccagcaagcagacacatgagccaccctgctcatctcctgggatgaggaaatgggatggcttgggccca

SEQ ID NO: 76460 - DNA, 601 bp, Human
gccaccatttcctcatcgtgctacaggatacaggtcccgcctatgccccagtgaggccctccctgacttcctgaagcccaggtattgctagaagcttattcagaagaggagaagaggaagaaagccgagggaagcagtttcctttcccatctcatagtcgccgggcacaggaccctgctgggcgtgggaggtagtggcaggcaggagggacagtgggcaggcagcttctgtggccagcagaacagcagaagcaaagctgaattcaggccacctggaggcagctcatccagccccagccccwtggtcctttctgctcccgcctggcccaacctcgggactggagctgacgcccaggtctgaatctgccctcctgaacctgccttccaaggttcagactggaaaattccttgtggatttctgctgtgaaggctttcctaatcccacagcaaaaacccacaaggagtgttgttctagtgggagctcagtccttttaggaggttctggccatgtggtctgagaggttcctgttccagggccccatgtgccatacaggacaggctaccaggcccaagacttcaatctaaggtcctcagacttcaga

SEQ ID NO: 76461 - DNA, 601 bp, Human
tttgagcttggatctcgcagctcaggagtagctacctaggtgaagaaggtgggaaaatagtcccaggcctaagggtgtggcagtcaggcctatgccagttatgaagcccagtggctagaaggaagtcgcatattaaggggactaatgcgtgctactttgtgactgaggaactgcagcccacacctctagcccaggggctaatgcagcccctccaacagttggactcactgcgtcagaaatcataaactggccctccctcctcagcaatctgggatacctgcatgccaccatttcctcatcrtgctacaggatacaggtcccgcctatgccccagtgaggccctccctgacttcctgaagcccaggtattgctagaagcttattcagaagaggagaagaggaagaaagccgagggaagcagtttcctttcccatctcatagtcgccgggcacaggaccctgctgggcgtgggaggtagtggcaggcaggagggacagtgggcaggcagcttctgtggccagcagaacagcagaagcaaagctgaattcaggccacctggaggcagctcatccagccccagccccttggtcctttctgctccc

SEQ ID NO: 76462 - DNA, 601 bp, Human
cagctattcaggaggctgaggcaggagaattgattgaacccgggaggtggaggctgcagtcagccaagatcacaccattgcactccagcctgggcaacaagagcgaaactctatctcaaagaaattaaaataataataattctgtgcagctgcaaaagggatgaggaagccctctctgaatagactattctccaagagatattattaagtttacagagcaaatgcaaaaaatgtttctatagtatgctaccttttgtgtgtaaaagaggggattccagattacacattctgcctatgtgcaaaaaaaaaaaaaaaatgctgaaaagaaattggtagccatggttgcctgtactgggggttgaaagaaacagtggatcaggaacaagtagagagagatgtcgtattgtagacattttaatttgttcaatgatttatgtttaaagcttgtgaaagtatttcctattcataaataaaatgttaagatgcaaataggtataaaattataaccttggcaagtactagcatgaaaaggtgcatagtgctctgacagcatggaatgaggaccccaacctttctctctgaagaaggtgcatttgagctt

SEQ ID NO: 76463 - DNA, 601 bp, Human
gtggcacacgcctgcaatcccagcactttgggaggccgaggcaggtggatcacctgaggtcagagtttgagactagtctgatcaacatggtgaaaccctgtctctactaaaaaaaaaaaaaaaaaaaaaaaaaaaaaaattagctgggcatagtggcaggcacctgtaatcccagctattcaggaggctgaggcaggagaattgattgaacccgggaggtggaggctgcagtcagccaagatcacaccattgcactccagcctgggcaacaagagcgaaactctatctcaaagaaattaawataataataattctgtgcagctgcaaaagggatgaggaagccctctctgaatagactattctccaagagatattattaagtttacagagcaaatgcaaaaaatgtttctatagtatgctaccttttgtgtgtaaaagaggggattccagattacacattctgcctatgtgcaaaaaaaaaaaaaaaatgctgaaaagaaattggtagccatggttgcctgtactgggggttgaaagaaacagtggatcaggaacaagtagagagagatgtcgtattgtagacattttaatttgttcaatg

SEQ ID NO: 76464 - DNA, 601 bp, Human
caaatccacgtaccctttgaacaggccatttatctcacagatatacttggcacagcataaaatggcatatgtacaagcttaatcagaagagcaaagaataaaaaaacatctaattccttcaacaagaactggctacatgatttctgaaacaatcattttgataaaattctatgcagctgcaggccgggcgcggtggcacacgcctgcaatcccagcactttgggaggccgaggcaggtggatcacctgaggtcagagtttgagactagtctgatcaacatggtgaaaccctgtctctactaaaaaaaaaaaaaaaaaaaaaaaaaaaaaaattagctgggcatagtggcaggcacctgtaatcccagctattcaggaggctgaggcaggagaattgattgaacccgggaggtggaggctgcagtcagccaagatcacaccattgcactccagcctgggcaacaagagcgaaactctatctcaaagaaattaaaataataataattctgtgcagctgcaaaagggatgaggaagccctctctgaatagactattctccaagagatattattaagtttacagagcaaatgcaaaaaatgtttc

SEQ ID NO: 76465 - DNA, 601 bp, Human
tttcacctgtcaaactgacaaaaatccacaagtttgctctcccgcccttattggtaaggccacagcagtggtggaaatatatacatcagtacagctcccatggaggggaatttggtgatattttcaaagttacaaatccacgtaccctttgaacaggccatttatctcacagatatacttggcacagcataaaatggcatatgtacaagcttaatcagaagagcaaagaataaaaaaacatctaattccttcaacaagaactggctacatgatttctgaaacaatcattttgataaaattytatgcagctgcaggccgggcgcggtggcacacgcctgcaatcccagcactttgggaggccgaggcaggtggatcacctgaggtcagagtttgagactagtctgatcaacatggtgaaaccctgtctctactaaaaaaaaaaaaaaaaaaaaaaaaaaaaaaattagctgggcatagtggcaggcacctgtaatcccagctattcaggaggctgaggcaggagaattgattgaacccgggaggtggaggctgcagtcagccaagatcacaccattgcactccagcctgggcaacaagagcg

SEQ ID NO: 76466 - DNA, 601 bp, Human
gggcctgccaggtgaggaatgcagagtgaggctacaggacacaggtcccgctcagagaggcctcgatgtctgtccctttccaggacgctggggatgctcctgtggcgagaggaactgggcctggaaaacacctcccagcccctttaggtgactccatcaccgtgcactattcacagagctgcaggcatccacaaaggacccacgttcccggaagatccagcaatggaatacctgggaggtggcccgatagctccaggaatgcccagttcctacctgtgcacctttgcacatgcaggtcccyctgctgtctcgatcttcctttcccattcttttctcaccttctgggcctaacatctcttctaggaagacccagatcttccaggaagtctcaggtacaagggcctgctctgaacgcccagttctgaaacttacttctcatgtgttatctacctggttgtcattctgcatcctagtggcttcctatttcttcttgtcccttcaattaaactctaaactcctcaggagaaagggctataccttttatccttttgtacctccaggctcctttgcccccagacaggatctagtgagtgcaaggtcg

SEQ ID NO: 76467 - DNA, 601 bp, Human
gtgccaccgagtcactgtttgatctcagacaagtcactgggcttctctgtgcctcagtttccacatttgtaaatgggatcataacatgtaacctccctccctcaggggtccccctccagcctcacctcttctcaatacccttcttacacatgacctgcctcttctagaaatacttgggttttgcaggatgagagagagggaaaaagctgaggaaaatgtcccactgtaactttttttgtcacattgctcatttgttcatgcatttcttttctttcctttctttctttctttttctttttctttttttttttttttttttgagatggaatctcactcttgttgcccaggctggactgcagtgccgcaatcttggctcactgcaacctctacttcctgggttcaagcgattctcgtacctcagcctcccaagtagctgaaattacaggtgtgctccatcattcccagctaatttttatatttttagaagagacagggtttcaccatgttggtcaggctggtctcgaactcctgacctccagtgatccgcccaccttggcctcccaaagtgctgggattacaggcgtgagcctccgcacctagc

SEQ ID NO: 76468 - DNA, 601 bp, Human; identical to SEQ ID NO: 38695

SEQ ID NO: 76469 - DNA, 601 bp, Human; identical to SEQ ID NO: 38696

SEQ ID NO: 76470 - DNA, 601 bp, Human
catttttctggagtataaggctctaaactttatgcatcataagagtgacagcttaattcgaaaagtctgtgtatgtaaaactaaaccatacatatttacatttaacagcatggcccctgctttattaaaaaatgttcctgaaggtccggcagggtagctcacgcctgtaattccagcactttcggaggccgaggaggaaggatcgcttgagcccaggatcgcttgttgcccagcctgggcaacaaagtaaggcggcccacacccgtcccccgcccctgcccgtctcttaaaaaaaaaaaaatttaatactaatgtaacggagtttataccttaaagattttttatccttaaagttcaaacatatggcaaattcatgttactccaagtatactgcaaaataaacagcactctaaatagttctgtgcctagtcttcctctcttgtgctgctgtcgacttctcgttgccctgcagtcaatgatatcacatatttctacaatacactacagtgctttcagctctacggtgcctacacaaaaacaaaataaatccataaagaggggcccctgggatggatgggaaacgcctccaacaagcctagtg

SEQ ID NO: 76471 - DNA, 601 bp, Human
actggtatatttacaataccttggctagacataaagattctccaagtccccaccagattagctagatacagagtgctgattgttgcatccacaaaccctgagctagacacagggtgctgactggcgtgtttacaaacctcgagctagatacggagtgctgattggtgtatttacaatcccttagctagacataaaggttctccaagtccccactagactcaggagcccagctggctttgcagtggatcccgcaccggggccgcaggtggagctgcctgccagtcccgggccttgcgcccatccgggcactcctcagcccttgggcccgcactcctcagcccttgggcagtcgacgggaccgggcaccgtggagcagggggtggtgctcatcggggaggcttgggctgtgtgaggcgggggggtggcggggggggggcctcaggtatggcaggctgcaggtcccaagccctgcctcatggggagtcagctaaggcccggcgagaaatccagcgcagcgccggtgggccagcactgctgggggacccggcgcaccctctgcagctagtggcccgggtgctaagcccctcactgcctgcggcca

SEQ ID NO: 76472 - DNA, 601 bp, Human
tcaagcaaccctatgcagaggccggcaaagcaagaaactgaagcctccagccaatccaggttactcagtgagctgtcttacaagtagatgctccaaccccattgaaggcttcgatgattaatgacatcttgattgcagctacacaagagaccctgagccagaaccatccagttaagtcaccccgggttcctgagccggaggaactgtgtacataaaaaatgttttaaactcctaagtgtgggagtatttgattacacagcaatagataactaatacagcgggactgtaataacctgggatratcactttgggaagaaatttagcaatacctaataaaactaaacatgtagatatctctgaactgagtctcccaattggtattccttggatgagtgaggcctaggggcagcagggtgggtcctcagtggctagagagtccatgttagttacctcagtctcaagtagcctcctctgcttactgtagaaatattatcatcttgtgtgagtgttacgacacaaaaacagttggtaagtaacatactatgacccagaaattccatttctagttatgtatcttaaagaaatcttgccaggcacagtg

SEQ ID NO: 76473 - DNA, 601 bp, Human
tggagtcttactctgttgcccaggctggagtgcagtggcgtgatttcagctcactgcaacctctgcctcccaggttcaagcaattctcctgtctcagcctcctgagtagctgggattacagatgcccgccgccacgcctggctaacttttgtatttttagtagagatgggatttcaccaggttggtcaggctggtctcgaactcctgacctcaggtgattcacccgcctcagcctcccaaagctgggattacaggcgtgagccaccacactcagcctatttctatttaatttttaagggarcagggcattatgtgaatagagagatgagaaacaatccaccggtggatacatcatcatttttcttcaatccctatttctcccccttgaaacaaaactgatgtgaattccagaaaatgcttagctaaggagagggctctctctcagactgaaaatcagaatgcgggtgcgctgtttctcctggaaatatcttgactgcgagagcagaggctgagggggatgatccctgggtcccagactgaaacaccccattgtgatactgaacaatgttgcacaaacttacccgcaagccgaagtagagaa

SEQ ID NO: 76474 - DNA, 601 bp, Human
cctgccctacaaagaaccttgtacctataaatagaccatgcagaacccactttttggaagcagaccaaagctaactttggcaggcaggcctctggggtacctgagccagccactcggaaagttggccttacccccatgggcttcttaatccagtcctgactctaagttcctgaatgaaaagtgacagaaccatgaacataaaggccctggctgtgacagtgatgaccactaggctttgacaatgataaaactgcactgcctgaagcgcaaactgtgcaaaccctttggggctagtgctccraagagagctgccaccatcaacttctaaaactccaagagcccgttgttcacattaatacatacaacattgtttgtagggagacagccccctcatccactgcaaattctgtccttcagccatgactcaggaaccaggaaggagaaggaaagagaggctgacttaccaagccaacttctgtttaagtacacagacacaaacacggggggcaccgtgaagaaatccactacagagttcacttccagccagaaccacaatttatcgttggctgcaataaactgggggaaagaagaaataagaaag

SEQ ID NO: 76475 - DNA, 601 bp, Human
aaagtgttctagtcctggtccaggaggtgccctgtacagtacagcccagcagcactctccccttaacacagaaagggacctcagtctcctgtaaggtgagagatgactcaagaagcttcatctctccctgccctacaaagaaccttgtacctataaatagaccatgcagaacccactttttggaagcagaccaaagctaactttggcaggcaggcctctggggtacctgagccagccactcggaaagttggccttacccccatgggcttcttaatccagtcctgactctaagttcctgaaygaaaagtgacagaaccatgaacataaaggccctggctgtgacagtgatgaccactaggctttgacaatgataaaactgcactgcctgaagcgcaaactgtgcaaaccctttggggctagtgctccaaagagagctgccaccatcaacttctaaaactccaagagcccgttgttcacattaatacatacaacattgtttgtagggagacagccccctcatccactgcaaattctgtccttcagccatgactcaggaaccaggaaggagaaggaaagagaggctgacttaccaagccaactt

SEQ ID NO: 76476 - DNA, 601 bp, Human
aagattcttcgaagtcatctagccaaatctttatcttacagatgaaaaacaacaggctaggtaaagaaaattgagctcccaggtcacaaagccagttagcagtgaagctacagcagctgggactgctggcacccagggccacgtaagttacactgaggacacttctcagatttgtgtgtgactctactagcctcatcaggataaggagaaaataaggaggaatcaggatacgatacggagaaaataaggaggaatcaggatacgataagcaaaaaatccagtctaaccaagcatatctcargtccaaaacaaaaacttttccttagagcaagagaatataattctaatgagaaaactgtagcaaaagaaatctttttaggatatggacacatacatatatatatatatgcatgcacacgtgtatgtgcatataatatagagattaccacacatactatattaagaagatgcttattttttaaaaaaatacttgacactaggtatataataaattcccagtgctagcaatggcatcaaaatggattgctagcggaagcctatcttgacacaacattttttaagttatccatcaatgtctgca

SEQ ID NO: 76477 - DNA, 601 bp, Human
gcaacaagatgttttaaaaggagtccctgttaacaactcatccataattttgactcaggggtgctgctgatagaattctactagcttccctgtccaccccaatgacctagatcccaaatttcccattaatgacccaagaaccttaaagactttctgagctaaaagattcttcgaagtcatctagccaaatctttatcttacagatgaaaaacaacaggctaggtaaagaaaattgagctcccaggtcacaaagccagttagcagtgaagctacagcagctgggactgctggcacccagggmcacgtaagttacactgaggacacttctcagatttgtgtgtgactctactagcctcatcaggataaggagaaaataaggaggaatcaggatacgatacggagaaaataaggaggaatcaggatacgataagcaaaaaatccagtctaaccaagcatatctcaggtccaaaacaaaaacttttccttagagcaagagaatataattctaatgagaaaactgtagcaaaagaaatctttttaggatatggacacatacatatatatatatatgcatgcacacgtgtatgtgcatataatatag

SEQ ID NO: 76478 - DNA, 601 bp, Human
gagacagacggacatatgagttctccttggagcatgttattcaaatctcaaaataagataaagctctcatttcaaggtgcatttattttagtgaggtttggatttgtaagggaaacaaaatgaataagttggtgggtggggacaggaattaaaataagcagcgtcttgctgcttgccgacatgactgtcctcacatccgctgccttattttttattctgttctggtttgttttctcctgcggtgctttaaaatatgatgggtaggttagaaagagagaccgaggtaatcctggcttctgtycattaagctcgtatgaagtacgtgctgtgctactcacattacctcggtgaatccctatgaggtgggtgctgtaattagcccattgtacaggtgagataactgagcctgaggcagataaaatgctcatgctgagcgacccatcagcaaacagtttagccaagatgtggactgagttggtggagctcagagctgagctttaatctactctgcgccaatatccggggtgttcttaagccccagtctctctgtcccagatggagcaggtcggatctccaagctgctgaggggcactaggactcg

SEQ ID NO: 76479 - DNA, 601 bp, Human
aacaagatctcctggtgcttctcatgcacagtaaagtttagaaagttaggagatgcatacaagtggttctcatcctgactgcacttcagacacaactgagaaacattaaaagaagctgagcctaggtcacaccctccacccagagattcttaggttaatggtttaaaggcttggcctgaacatgaagagttttaaaagcactctgggggattctaataaaaattcgagaaccatcccagcataagtcagtacggtggctccaaaactggagatcaccaggagtgcttgttaaaacacagaytgctggctccaactcgcggtttctgatccctgggtctcggttgagctctaagaaccctcatgtgtaacaagtccccagtaacgctgatgctgctgatccaggaaccacactttgagaaccactggtctaatcattttaaaagatgggctccagaattggactaacctgagtcttggacctgccacttacttagaccctgaacctcagtttcccaaactgtaaacttgggctatgaatatttactcatcgagttattgtgaatattaactcagagaatgactgtgagatgctgggcatagt

SEQ ID NO: 76480 - DNA, 601 bp, Human
tgggtgacctctgggggcactcaggggcccttccttccaggcttcgggcactgtcactgagaagcaactcccttgggggaggggtgcttttggtcatagcggttgagtcaagttatcagatgtcaaatagcttataggagttcaaagtgagcctatctccaccactgctaaccacgaactgcccatctgagcatgatgaaattggcccccttcccctctccccttgctacttaattgctcacaaatccagcaaattgcaggaccagcctctagggggcaccagagacctttcctttcagarcccaaaatgccatttcagtagcagcagagtagtgtgtcctggagctggagcatggtccagtgtctcttgtgctttttggcctactgagtccttaagtatatttaatttaatttgggtagggtggtagagggttccttttaacagtgtattcatgatttctctagcatttcttcaggaaagttatttatttcttttagatatagaatttttaccattggtccattcactcaaaatcacttcaaaaaacatttgctaagcttccactatgtgcaagagtgtcctgggcatacaaaaagtaaa

SEQ ID NO: 76481 - DNA, 601 bp, Human
cagaccgcacctcgagtagtcctgctctaggagaaacatgtttatattttagatacctgaaatctactttgggctgggatggccaactttcctccatctgttcctcctctaaattcctataaacttactgttctttctagaggacactccaattaagttattaacatcttatagaggcaagatctatgttttccccatctttgggtcactcctagcacctagggatttgcacacagtaggtgttcagctgaataatgcagtcgaatccctgagctggtttcaggtgttcattttctccctrtctgatctgctagccaggtcaatccattatggccctggtctcatggaaaagaatcaaggcatctattttttgaagatgatgtgaaggtaaatatacgtccagtcctagagatttaggttgctgaggaggctgttccaataataccccagatgaagtacagccatctggagaggttttggcatccatgcaaacctactgctgaattcgttccttgaagacattcattttaggatggtatttccaatttggcatataacagagccatgcaaatcaatgaggatttagaatctctacttacgg

SEQ ID NO: 76482 - DNA, 601 bp, Human
gaccagcagatctcaaagtgtggcccccagatcagcagcagcagcatcacttgggaatgtgttagccatgcagatcctcaggccccatcccaggtgtactgaatctgaaactctggggatggaacaccccaaatctgtaatttaaccagacctctaggtgactctggtgcactcaaagtttgagaaccactggtctatctagaatacatagtgtgcttgttccaaagcaattgtccttaccacgacccaaagagcctcacagaatagatttcggaaagtacgtgtgcgtgtgtgtgtgtgygtgtgtgtgtgtgtgtgtgtgtgtgtgtgtgtgttgaagtttctcaggtattcaggtatgttcctctggtttaagaaccaccactgtgccaggcctctcaacagtggctgcacaagtgaaattattcagagaacttgaaaacattctggtgactgagttcatccccaattctcatatgcttggttagaaatacagtctggccaggaggacgtgtcagagttcctgggtgattctaacatactgccaagatcatttagcccatagaagaatcaccaggagaatttgttaaaacagattcct

SEQ ID NO: 76483 - DNA, 601 bp, Human
gatatgggagcaaagtgtcaccacactagtgtttggcatttatttcgagtgatatagtgtgtcttatgaaaaatgggccaggcacagtggctcacacctgtatcccagtactttgggagaccgaagtgggcagatcacttgaggtcaggtgttcaagaccagcctgtccaacatggtgaaaccccatctctactaaaaatacaaaaattagctgggcgtggtggtgggcacctgtaatcccagctacttgggaggctgaggcaggagaatcacttgaacccaggaggcggaggttgcagtragccaagattgtgccactgcactccagcctgggcaacaatgcaagacccaatctaaaaaataataataaaaataaatttaaaaaaaagaaaaatggagctctgctcaccacctatcatctgttcttactctcatgagcaggcttgggcccaggcctgggcatctcagtgtctgcaagtgagatgactgggaaagaagatttgttcaaataagtcaccctgctattggagagaggctggaccctaagagagcccttccctcgaggagcgggctgagatactgtatccctgggagaaggttg

SEQ ID NO: 76484 - DNA, 601 bp, Human
acagcctccacctggcctgcttcacccatttgttatcttcttgtccctgtaagcatttgtgtttgcaatctggggtttatagattcatctttcctatagtagggctaaaatatcttagtttaaactccaagcctaggacaacagctggcacattacacttgttttaaggtttgttgagtgaatgatgataataataaagatgatgataataatgaaaccggcaatatttatgaagtttcttaaccagggcagagactagggtaagacagtgatgcatccagggaacaaaattgaaaggcaygctcattttctttttctttctttcttttttttttttaattttgagacaggggctgactctgtccccaggctggagtgcaatggcatgatcttgtctcactgcagcctcgacttcctcgagcaatccttccacctcagcccccaaatagcaggaacttcaaacatgcagcatcatgtctggctaatttttgtattttttgtagagatggggtctcaccatgttgcccaggctggtctcaaactccaggactcaagcgatcctcccacctcagcttcccaaattgctgggattacaggcatg

SEQ ID NO: 76485 - DNA, 601 bp, Human
cacattagggcaggtcagtgcatggaaaagctggcgacacttgtgtttcctataggtcccctttgttcccagtggagctggggcccttcgtctctaacaaaccagaagtacttgtactaatggaagggaggctatttatttcataaaataaatataaacaaacaagaaaattgaaataagaagtcctctgaccatgtgcacgttgctccagacaccaaaacatgagaaagcacttctgacccagtttgtaaattcgagttatagtattttacgtttgctaaaatattcacctaccacagtragaatttttgtttatctgatgcaacctgtttggtgttataggcagatgctaagttacaggctttgtggtggatactgggcaacagatgtggtaagaaggggagcagcccaagatgaaatttcctccaaaacaccagaggttcctgtctcaagcagagaaatcataatactgcaacacatactagtttgcaaagggcaagtcgctatggccaaaaatgattgattcagaggaagaggaagggaaggaagaagaaagagaggaagaggaggggaaggacatggaggagggaaaagaaaagga

SEQ ID NO: 76486 - DNA, 601 bp, Human
ggttttctgcggggagttgttttccatttatacttagcccgaacacgtatacctacttttcaaactcttagctattcacttgacatttgtcttcttcagtcttcactaaatagtctttggaccctttgggagtcttataagagttattttctgaaagttaaaaacgtaggaccttatttcggcagaggttaactaaaccaggcttcaaagaggattctgagggcgacagccactataatgtccattcctactttccttcactaggtggcagcacgtcacaacacatttttcagaacagtcyggggaaaatgcagttgagctaaagtgaggttggggagtctctgcgggctatgggaggaggatacacattagggcaggtcagtgcatggaaaagctggcgacacttgtgtttcctataggtcccctttgttcccagtggagctggggcccttcgtctctaacaaaccagaagtacttgtactaatggaagggaggctatttatttcataaaataaatataaacaaacaagaaaattgaaataagaagtcctctgaccatgtgcacgttgctccagacaccaaaacatgagaaagcacttct

SEQ ID NO: 76487 - DNA, 601 bp, Human
caactggactccaggattacttcctagctcttcctcctctagaagccaccatttctcttcgctatctagaccccagggaagtggctttggcaaaagcacatttgcacccatggatcatttggttttcttgtcctgttaactgcctggttctgcagcacccagagccagataatagaggtgttccttcaccagccacagctactatcaggatccctcttagtccggaggtaacagaagcaactggttgaacgtgtttcctcctgggaaatcctaaatgttccatatggcaatagggaatctrgagttgtgtttctccttgtattagggatattttccctctttcagtttcttcccattttttcccatctaaaatatgttttttccactttgctgagatgaagaccagccagagagtcaaaggaaatgacagacatgccataatagaaagaaaaaaatacagacttctgaagaatgagttgattcatgccatgaaaactcacgataaaaatattcactacttttttttggccacttgtcatagtgtgctgcctctgctaggcagctgaaagtgtctcatatgaaaagctctattatcctccac

SEQ ID NO: 76488 - DNA, 601 bp, Human
acccttattctatagaatggaacttgggaacccttatcatttgtcattcattccattgttcactcagtggctatttactgagtatctcccatgcgtgcagtgctctgtcccattctggggataaaacagagagctgagaaagatccctgccttgatggaactcacagtctgggtctggagcagcagaaagaggctcatcaagtaaccttccaagcacctttgcaatcacaacagtgaggagagctaagaaatggtacatggggtaagcttccatgatgtactgatggttatgctaattacyaaagactgtcaaatcaggacccaaattgtctagtgccaaggtggatgtctttgctccttcctttttctgccctgagacactcttcattctcagttgggtttcccttttagaatgacctgtgacatgtgtcttctcctcatgtgacactcttcctctttctaaccccagcacctagaacaaagcctgacacacgggagacactcagggcatcactgttgaacaaatgaaagaattaattcattaggagaagaaatgtaagcaaattcctgggcatccccaggccccagttttctcatcagt

SEQ ID NO: 76489 - DNA, 601 bp, Human
atgtatctattgagtgaatcatttattaatctcaaattacatccccaaatcctgttctttccttcctttgcctttttttcctagatatcaagaagcacactgattctagttaagtagttattactttgagctcagttaaagatactaaatattggcactcttggtggcccccattccaagcatccttttatgtaaaagaactgtaatcctatgagcaaagacctgtaaaactgactgcagctaagggaattatgcccccatgcagataatgctgtggaccaaacagttccgataagcaaamaaaatctctcagacaattatgttcttgtttaaggccgtttgccttggaattcccaaaaggattctggaggattgcaaatttgctggggatgaagaaagaaagtactagctagagtttaatagattattggattaagacaggccagaaacagtcaaacaagaaaagtattatgcaaaaccttctaaggttctaatctcaccttatttctattttgattaatattttcctgggaaagaaaagatgggggtttttgttgttctctgactacaatccagagataacatctttgcctccagtttt

SEQ ID NO: 76490 - DNA, 601 bp, Human
tgacagccttcaaggacagatgtgggataaggaaataaataacagctgttttactgacacttgtactcattcattcaggccaaggtgagaaggatgggtaggattcttcatatggactcactggtatatcctagtgagttttgtttaagagacagggtctctgtgtttgtcacccaggctggggtacagcggcatgattatggctctgagcagcctcaacctctttgcctcaagcgatcctcctgcctcagcttcccaagtagttaggactacaggcataagccaccacgcccaactactytttttttttgtagggatggggtctcactatgttgcccaagctggtcttcaacccctgggctcaagcaatcttcctgccctggcctcccaagctgctgagattacaggtgtgagccaccatgcctgatggagttttaatagtagttactgcattgcaccagccagatatttcatctgagaaaagtcaggcacactaggttccatcattcaattactatcctattaagctgaattcagttatgagtgtgtttagagatgtgcatgtatcttgtagtcaacgcatggataacatgtgaattct

SEQ ID NO: 76491 - DNA, 601 bp, Human
caggcttggtttgaactgcctgttgatagaaacattgtctgtcggctccatggtccttgaccacatgacagccttcaaggacagatgtgggataaggaaataaataacagctgttttactgacacttgtactcattcattcaggccaaggtgagaaggatgggtaggattcttcatatggactcactggtatatcctagtgagttttgtttaagagacagggtctctgtgtttgtcacccaggctggggtacagcggcatgattatggctctgagcagcctcaacctctttgcctcaagckatcctcctgcctcagcttcccaagtagttaggactacaggcataagccaccacgcccaactactttttttttttgtagggatggggtctcactatgttgcccaagctggtcttcaacccctgggctcaagcaatcttcctgccctggcctcccaagctgctgagattacaggtgtgagccaccatgcctgatggagttttaatagtagttactgcattgcaccagccagatatttcatctgagaaaagtcaggcacactaggttccatcattcaattactatcctattaagctgaattca

SEQ ID NO: 76492 - DNA, 601 bp, Human
gcccagtccctccaaggctctttcatccactcaatatggtcagccacaggcttggtttgaactgcctgttgatagaaacattgtctgtcggctccatggtccttgaccacatgacagccttcaaggacagatgtgggataaggaaataaataacagctgttttactgacacttgtactcattcattcaggccaaggtgagaaggatgggtaggattcttcatatggactcactggtatatcctagtgagttttgtttaagagacagggtctctgtgtttgtcacccaggctggggtacagyggcatgattatggctctgagcagcctcaacctctttgcctcaagcgatcctcctgcctcagcttcccaagtagttaggactacaggcataagccaccacgcccaactactttttttttttgtagggatggggtctcactatgttgcccaagctggtcttcaacccctgggctcaagcaatcttcctgccctggcctcccaagctgctgagattacaggtgtgagccaccatgcctgatggagttttaatagtagttactgcattgcaccagccagatatttcatctgagaaaagtcaggc

SEQ ID NO: 76493 - DNA, 601 bp, Human
tacttcagactccaggaaccagccagaacaccacctccttttggaaagtcttccctgggacacgtcaggctgtctcttttctgcctgttcccccagcactctcctgccatattcaatgcaacacactggaattctttacttacttccttctcccccatgaatgagctcaccagcccttgtcccttttcttttgttcattcattcatgtctaaattcacaaaacattcattgagggttccttttagtaacttcagtaagacttgacacagtgcctagaatgtggtaatgggaatgtctgttsaatgaaacaaaatgagctaaaaagaaataagtggatggaggtggatgaatcccaactactgtgcatctgcaggacacggtcaaagagaaggtccctaacagggtaactgggaaggctctcctcctgttcccctgctcttctccaagggtgtcaacggagtaagtcctgccccagagtaaatccactccagttactataaccacgcactgaggatccctcagctgcctccctatatgatcactctgaaatattcacaccagtccacttcctggctccccaaagaaggatgcaaattcctcc

SEQ ID NO: 76494 - DNA, 601 bp, Human
tttctacttcagactccaggaaccagccagaacaccacctccttttggaaagtcttccctgggacacgtcaggctgtctcttttctgcctgttcccccagcactctcctgccatattcaatgcaacacactggaattctttacttacttccttctcccccatgaatgagctcaccagcccttgtcccttttcttttgttcattcattcatgtctaaattcacaaaacattcattgagggttccttttagtaacttcagtaagacttgacacagtgcctagaatgtggtaatgggaatgtcygttgaatgaaacaaaatgagctaaaaagaaataagtggatggaggtggatgaatcccaactactgtgcatctgcaggacacggtcaaagagaaggtccctaacagggtaactgggaaggctctcctcctgttcccctgctcttctccaagggtgtcaacggagtaagtcctgccccagagtaaatccactccagttactataaccacgcactgaggatccctcagctgcctccctatatgatcactctgaaatattcacaccagtccacttcctggctccccaaagaaggatgcaaattc

SEQ ID NO: 76495 - DNA, 601 bp, Human
gttacacctacatccttgcttttcccctaattttcaggcctttgttcatttgcaaacacttgccctcagtttgacctgcctattcccccctcctgtagctaacaaatttctacttcagactccaggaaccagccagaacaccacctccttttggaaagtcttccctgggacacgtcaggctgtctcttttctgcctgttcccccagcactctcctgccatattcaatgcaacacactggaattctttacttacttccttctcccccatgaatgagctcaccagcccttgtcccttttcttytgttcattcattcatgtctaaattcacaaaacattcattgagggttccttttagtaacttcagtaagacttgacacagtgcctagaatgtggtaatgggaatgtctgttgaatgaaacaaaatgagctaaaaagaaataagtggatggaggtggatgaatcccaactactgtgcatctgcaggacacggtcaaagagaaggtccctaacagggtaactgggaaggctctcctcctgttcccctgctcttctccaagggtgtcaacggagtaagtcctgccccagagtaaatccactccag

SEQ ID NO: 76496 - DNA, 601 bp, Human
tacataaggaagacgtccagacttgctttacttgatcatatgaaataaactcctcttcacgctggagcaaaataagagcactcttatcttgggggttttggaagtatttctgtggtttctgggatgcaatatctcagccagaaaaataagcccttcatcctgccttcagcgaggcgagccccacagcaagggccaaagtctaggaggcctgagcatgaggctgcagtgtctccaagccccactgcctttaatgggaacagcgtcctggcaccctctccaggatcacagcagtgagctctgkcctctggtcacctgcgccaccaacaccctgacaaggtcctcctcctccttagcgatgggctgcctcctttcccacagcttctggtgcccccatgggttgggggcagggagggaagtagcaaagaattaagaatcagatccagagaagcatgtggtcatatcaaagaaggagtgtaaatagctcctatacaatgaggtgatcagatctctaagaggctcagggaaaataatcaggaataagtggaaagacagaaatgaaactgaacaaaagaaaacacttttagggagaaggaagtttgag

SEQ ID NO: 76497 - DNA, 601 bp, Human
ttctttacagcaatactgccatctcactgaattacttttgtctgtgcagcagacagggaaaatccactgggtgactacacaaataagcttaaacttaacagttttattttttaaaaaaacatgtaggccaggcacagtggctcatgcctataaccccagcactatgggaggctgaggcaggcgggtcccgaggtcaggaattcaaaaccatcctggccaacatggtgaaaccctgtctctgctaaaaaatacaaaaaattagccgggcatggtggcaagtgcctgtaatcccagctactcrggaggctagtacaagttcattttatataaatttctgtttgtctaacttatttacttatctactgtacagaaaaatatctagaatgatctttatccaatgtgatcaaatgttttatgatatttgctttggtttgttggacacattcttcttggcattttctgtgttgcttccatttctcttaaatgaatatgttgagttttttaaataataaaataattattttgaaaatacataaggaagacgtccagacttgctttacttgatcatatgaaataaactcctcttcacgctggagcaaaa

SEQ ID NO: 76498 - DNA, 601 bp, Human
tgcggtggccatggttgtccccattttacagatgtggcagcagttgaggcacagagagcttaaacatcttgccgaagctcacctagcaatgagatgatggagccgcggttgaaatttaggcagtggaactccagatgtgtgctcaccctgccctgttctgcctccctggaagcacgctcagccatggctctggctgcctctcccatgctgcccccgagatttcattccctgtatgcctgaacgtcaacacaagtgtctttcttctcagtcccatggaaacggttcctccaccattacgatmtgaactaaaacaataagaagatgctatgcaaaaaatgaacctgggtgagtactgaacactttaaaatgcaagactttactaaggctaaatagaattgaaagctatagcctcagaagagaatgtcacaaaaccctgacacagtgaaacaattacataactaagaagtgaggggaaaggatgggggagaaaatgaaatgtcattttctcttctttcacagcagaaagttcatctgttttacaccaaattaaaaaacaaagttggccgggcatggtggctcacgcctgtaatcccagcacttt

SEQ ID NO: 76499 - DNA, 601 bp, Human
tttaaagaggtgggccacaaaagcagattgaaaaagggttgacattttaaaagatccctgcaaacaactaaagaaaggagatgactgtgagattctcagagaattctttcctgcctgctattgatctccaaaaagtgtgattctataacaagagcaaacattgacagtgagtcagatacctctgtaatcatttttaaatcactcattttattcccacaacaccttacatgcggtggccatggttgtccccattttacagatgtggcagcagttgaggcacagagagcttaaacatcttgccgaagctcacctagcaatgagatgatggagccgcggttgaaatttaggcagtggaactccagatgtgtgctcaccctgccctgttctgcctccctggaagcacgctcagccatggctctggctgcctctcccatgctgcccccgagatttcattccctgtatgcctgaacgtcaacacaagtgtctttcttctcagtcccatggaaacggttcctccaccattacgatctgaactaaaacaataagaagatgctatgcaaaaaatgaacctgggtgagtactgaacactttaaaatgcaag

SEQ ID NO: 76500 - DNA, 601 bp, Human
ctgcatgagcaacttacatcctggagtttacaggtgttgcaccctgcccaaagttgctgagtgctcaccaagtcctgcttctctcagaggcagcattacctaatggacaggagtctccgggcccagctctgttgcttattaactttcccaacgtcatttgtaaaatgagaaaatgtctgttgttcacaggtgatatagttaggctctgtgtccccatccaaaatctcatcttgaattgtaatccctataatctccacctgtcaagggtgggaccaggtggaggtaattggatcacgggggyggtttccctcatgcttttctcgtgatagtgagtaagtctcaagaaagctgatggttttataagcatctggcatttcccctgcttgaactcactctgtcctgccaccctgtgaagaaggtgccttcttctcctttgccttccaccgtgattgtaagtttcctgaggcctccccaggcatgcggaactgtgagtcaattcaacctctttcctttataaattacccggtctggaggattccttcatagtagtgtgagaatggactaataccacaggttattatagaaattaaatgaattacag

SEQ ID NO: 76501 - DNA, 601 bp, Human
ggactcccagtttaaaagagagtcaaatgtccatcctgggagaattagcagagtattgtggttaagggcagaggctttgaagacaggcctggactaatttatttttgcctatggtttaggacagagggtccaagactgtctttttcatcttgtcatctcagcatttaggatagcaaggggtacatagcaggtgctaaataaatgtgttgtgaaatttaagtcctggttctaccatgcataagctgtttcctagggcaccttccataacctcttggagactcttctgtttttttgcttttgkgtgtgtgtgtgtgtgtgtgtgtgtgtgttgttgctgttgtcattattttgtaaaatgggatgtctcagttggggttcctctgcaggagaacctgagaaaaggatttgattacaaatagttaacttgggaagtgatctcaggaaacaccagtaagggaacaggaaagtggggaggagatgggaaagcatccataaagagtttgttatcaagcatttatcactgtgggcaactaaaggaaaatcccactggggtactctggcagccaggatctacacatggctttatgtgtaaacagaagag

SEQ ID NO: 76502 - DNA, 601 bp, Human
ttctttctttccctgtctctctctctctctttctttccttctttctttctctttcttcctttctgatggagtcttgctctgtcaccaggtgggagtgcagtggtgccagatcagctcactgcaacctccacctcctgggttcaagtgattcccctgcctcagcctcccaagtagctaggactacaggtgagagtcaccaggcccagctaatttttgtatttttagtagagatggagtttcaccatgttggtcaggatggtctcgatctcttgaccttgtgatctgccccccttgcccttcygaagtgctgggattacaggcatgagccaccacacctggccataaatctgcagtttctacagctactttgcaactatgaacaaatgctagtgtacacagaaaactccctccctcctgtaagcttcttatgcatgccacagactctggcctcccagctgggccagatacatttgaatgctggagcactcagctgattaagatacctaatttctgaatgatcccactcacaccaggaggacagtgtttagagcaagatgttacatctcagttgactcaccttgtgcaatgatttctttttata

SEQ ID NO: 76503 - DNA, 601 bp, Human
tttctttcctttctttctttccctgtctctctctctctctttctttccttctttctttctctttcttcctttctgatggagtcttgctctgtcaccaggtgggagtgcagtggtgccagatcagctcactgcaacctccacctcctgggttcaagtgattcccctgcctcagcctcccaagtagctaggactacaggtgagagtcaccaggcccagctaatttttgtatttttagtagagatggagtttcaccatgttggtcaggatggtctcgatctcttgaccttgtgatctgccccccttgcccttctgaagtgctgggattacaggcatgagccaccacacctggccataaatctgcagtttctacagctactttgcaactatgaacaaatgctagtgtacacagaaaactccctccctcctgtaagcttcttatgcatgccacagactctggcctcccagctgggccagatacatttgaatgctggagcactcagctgattaagatacctaatttctgaatgatcccactcacaccaggaggacagtgtttagagcaagatgttacatctcagttgactcaccttgtgcaatgatt

SEQ ID NO: 76504 - DNA, 601 bp, Human
actgggagtgttggtaatagataacccttaatatcccattcagatcaaatttctataattataatgtggctctctgcctctggaggtcactcaataacaaagaaatataactttaaaaatagccaaagtaggaaaaataacaatcattctcataaatctgcagtttctttctttctttctctctctctcttttcttctctctctcttctcttccttcctttctttcttctttctttctttcttttcttttctttctttctttcctttctttctttccctgtctctctctctctctttcttcccttctttctttctctttcttcctttctgatggagtcttgctctgtcaccaggtgggagtgcagtggtgccagatcagctcactgcaacctccacctcctgggttcaagtgattcccctgcctcagcctcccaagtagctaggactacaggtgagagtcaccaggcccagctaatttttgtatttttagtagagatggagtttcaccatgttggtcaggatggtctcgatctcttgaccttgtgatctgccccccttgcccttctgaagtgctgggattacaggcatgagccaccacacc

SEQ ID NO: 76505 - DNA, 601 bp, Human
cttcaattacagtttacaaagaacagaggtactccttccaaaaggggactcttgatttagctctctgtaaggacagaaagcataacactgaatcttgggtcagcaaaaacattttcacaagggcctcaggtatcatgagatttagctctgtttaattctgatgctcaacattaatttaaggaaaatgaagtacttgttttgggggggattaatttgctaccaggcacacctcagctgtgttttattctgaagctctaaattagcaccaggatcaacctggataatctaaatcaggggttgscaatttttttctgtaaagggccagatcataaatattttgggctttgtaagctgcacaatctctattgcaagtgctcaatgcggccattggagtgagaaaactagccacagatgatacaaaaatgaatgagcttggcctcgttccagtaaaactttccttacaaaaataggtgatggaccagatgtagcctgtaggccatagttggtcaacctctgatgtagctgacatcttgaaatgaggaaggaatgtttaatttgagaacaggtacttctacatttcacaaggtagaaatctgtaaat

SEQ ID NO: 76506 - DNA, 601 bp, Human
aattcagagatcaaatctatcctaaaattaaattcaagcagaatttttgtgccagcggctttgaataaagactgaagaacacggtgagttatatcttcaattacagtttacaaagaacagaggtactccttccaaaaggggactcttgatttagctctctgtaaggacagaaagcataacactgaatcttgggtcagcaaaaacattttcacaagggcctcaggtatcatgagatttagctctgtttaattctgatgctcaacattaatttaaggaaaatgaagtacttgttttgggggggattaatttgctaccaggcacacctcagctgtgttttattctgaagctctaaattagcaccaggatcaacctggataatctaaatcaggggttggcaatttttttctgtaaagggccagatcataaatattttgggctttgtaagctgcacaatctctattgcaagtgctcaatgcggccattggagtgagaaaactagccacagatgatacaaaaatgaatgagcttggcctcgttccagtaaaactttccttacaaaaataggtgatggaccagatgtagcctgtaggccatagttggt

SEQ ID NO: 76507 - DNA, 601 bp, Human
gaaattggctctgcattgcctgtcacctatggcaagagagaaacaactaggttatgattattgtgaactgagaaaacctataaagccaattcagagatcaaatctatcctaaaattaaattcaagcagaatttttgtgccagcggctttgaataaagactgaagaacacggtgagttatatcttcaattacagtttacaaagaacagaggtactccttccaaaaggggactcttgatttagctctctgtaaggacagaaagcataacactgaatcttgggtcagcaaaaacattttcacargggcctcaggtatcatgagatttagctctgtttaattctgatgctcaacattaatttaaggaaaatgaagtacttgttttgggggggattaatttgctaccaggcacacctcagctgtgttttattctgaagctctaaattagcaccaggatcaacctggataatctaaatcaggggttggcaatttttttctgtaaagggccagatcataaatattttgggctttgtaagctgcacaatctctattgcaagtgctcaatgcggccattggagtgagaaaactagccacagatgatacaa

SEQ ID NO: 76508 - DNA, 601 bp, Human
aaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctttgcatagccctgggaatgagccaccctcatgtttgcacccaggcctctctcttgcctcatcctgcacctgccatgagtttactactgagctcacttctgaaattggctctgcattgcctgtcacctatggcaagagagaaacaactaggttatgaytattgtgaactgagaaaacctataaagccaattcagagatcaaatctatcctaaaattaaattcaagcagaatttttgtgccagcggctttgaataaagactgaagaacacggtgagttatatcttcaattacagtttacaaagaacagaggtactccttccaaaaggggactcttgatttagctctctgtaaggacagaaagcataacactgaatcttgggtcagcaaaaacattttcacaagggcctcaggtatcatgagatttagctctgtttaattctgatgctcaacattaattt

SEQ ID NO: 76509 - DNA, 601 bp, Human
ctaaccatcagaggggtggaatagcctctaattcagcccattcttccctcatccctttccctttcatcatcagctagcagtgaaagtcaccatcctcttggacctcccatttctgaggcattgtctgtcccagaaccccatgcaggacattggagacaagtgaatctaacctcgtccaatctccctcttcttcccgtagataaaaacctgaactcaaagaagagaactggaataatcctccctaatcccacttcccatggtgagccccagctgggacgctgacacatggccccaacttttyctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaagggacacttcaggcacaacatgtaaggaggtgctccttttgggactgaccctgcctt

SEQ ID NO: 76510 - DNA, 601 bp, Human
ttcgtctttgtctcccaccccaccagcctccctccctccttcccttccccctgaaagctaaccatcagaggggtggaatagcctctaattcagcccattcttccctcatccctttccctttcatcatcagctagcagtgaaagtcaccatcctcttggacctcccatttctgaggcattgtctgtcccagaaccccatgcaggacattggagacaagtgaatctaacctcgtccaatctccctcttcttcccgtagataaaaacctgaactcaaagaagagaactggaataatcctccctwatcccacttcccatggtgagccccagctgggacgctgacacatggccccaactttttctcctgcctgatgtctggacccacaggggacagatggtggtccctggtcactgaagtacccacaggtttgattattgagacttttatctctgttgactacagggaggacctgaatcagtttacatggttaaaataaaagcgccatatacaaggataaagcaggacagggcccccaccatctaaaagtagaagggatggggattgccaggcagcacctgccaccaccaagaaaagactgagaaa

SEQ ID NO: 76511 - DNA, 601 bp, Human
aaatacatttccttttcagagtcatttatccctcagttagaaagaagtattgaccatggggaagggggactgtgaagccacctgggcatggcagagggggccaggcacagaggagggagcacaaaagaacgaacaatgaagcacatagagaaataaaacctaactcgacttgcaagccagtgatggccctatttttagctgacaagtgagtaatctgatgtgtgtgacttgaaacagggaacataaacatcaaggctgaatctataaccagccacatataacttgtactataacttattcycagaattctagactgtttgaattaagtgtctgcaggtctcttcttcacgcacttactcttattaagtttgggaactagaagcctgtgtcatttgcacaggtctcaagttacaagggaaaaagatgctttgcttggtctctggtttgactattccaaagaatctttcctaatctccaattcgtctttgtctcccaccccaccagcctccctccctccttcccttccccctgaaagctaaccatcagaggggtggaatagcctctaattcagcccattcttccctcatccctttccctttca

SEQ ID NO: 76512 - DNA, 601 bp, Human
tgtaatcccagcactttgggaggccaaggcaggcagataggttgaggccaggagtttgagaccagcctagtcaacatggcaaaacttcgtctcttctaaaaaatacaaaaattagccaggcgtggtggcctgcacctgtagtcccagctactggggaggctgaagcaggagaatcacttgaacccaggaggtggaggttgcagtgagcggagatggtgccactacactccagcctgggtgacagagcaagacttcatctcaaaaaaaaaaaaaaaaaaaaaaaaaaaaagaaagaaagaargaaagaaaaaagatgagaattatgcctctcaggggctgtgacaataaattgatctacgtgtgttttaaaatgcctttcacacagaatatgctacataatcactcattcctggtctcctccagaagtccctgcacttggcctctctctctcgggtgtaatggattggtccccattgaaatacatttccttttcagagtcatttatccctcagttagaaagaagtattgaccatggggaagggggactgtgaagccacctgggcatggcagagggggccaggcacagaggagggagcacaaa

SEQ ID NO: 76513 - DNA, 601 bp, Human
ttgctctaaatctatcctcaaaaaatgtacagtcttgaggagctgtttacaatctacatttgtatttagctaagataggaaagatgactatctacataattttaggggacgatccaccagcccccaaaagaaattagccttcttctcttccttgtttattgatgcctaaaattcccccataagacagcagcattacccagtaagaaaaaactgtgccttgggttcaaatggatgtaagttttgaccctggctctgctcctgatgcactgagagaccctggctgcttatatgaaacctgaawgtctatgactgcatgtaaaaaataaagatgagaagctgggcgcggtggctcatgcctgtaatcccagcactttgggaggccaaggcaggcagataggttgaggccaggagtttgagaccagcctagtcaacatggcaaaacttcgtctcttctaaaaaatacaaaaattagccaggcgtggtggcctgcacctgtagtcccagctactggggaggctgaagcaggagaatcacttgaacccaggaggtggaggttgcagtgagcggagatggtgccactacactccagcctgggtgacag

SEQ ID NO: 76514 - DNA, 601 bp, Human
agaaatgaactcagacgaaattgacctcttcagtgaagtcatatctaattccctcaaccctgtacaaagtaatagtacatttattcaacaacatattttcatggagtacctatttagaaaagagacggaatctgggcccagtgttataggattcaaatcccagctctgccattaattgggagtgagcattagcaagttccttcaactcaaagtatctcagtttccccaactataaaatgggaacagtaatagtaacctacctcatggggttattgtgaggaatgaattaatatctataacrgttaaaattgtccttggcacataggaaatgttcagtcagtgcttgctataattattactaggagccagatactgggctaaccatattggggatacaaatgtgatttgctctaaatctatcctcaaaaaatgtacagtcttgaggagctgtttacaatctacatttgtatttagctaagataggaaagatgactatctacataattttaggggacgatccaccagcccccaaaagaaattagccttcttctcttccttgtttattgatgcctaaaattcccccataagacagcagcattac

SEQ ID NO: 76515 - DNA, 601 bp, Human
ctggacatgtgtctattccaaaaaaaactgtcataaactgtatcctcattttgcactcctcccaccagtgtgtcccatggtgccacctggtattgtctgcctgaaagaattctaggagggcttcatttgtctctgaagtcatagatcttcatctaccaatactgggaaaactcccttgctcctcttcctctgcattaggcttgtttttctgagacagaagtggtcagagaaaaaggacactggaatccattcattcatttaaaaatattgaccaagaaatgaactcagacgaaattgaccycttcagtgaagtcatatctaattccctcaaccctgtacaaagtaatagtacatttattcaacaacatattttcatggagtacctatttagaaaagagacggaatctgggcccagtgttataggattcaaatcccagctctgccattaattgggagtgagcattagcaagttccttcaactcaaagtatctcagtttccccaactataaaatgggaacagtaatagtaacctacctcatggggttattgtgaggaatgaattaatatctataacagttaaaattgtccttggcacatagga

SEQ ID NO: 76516 - DNA, 601 bp, Human
tcactgggcaatctggtctcctactgtaaataaaaaccccacctatctccatggggcacatctgccagcctcttcctaggaccctgtaggtgtggcaataaatgtggtccctggaaccagcagcaggggatttggttcctggcatctccacatacgagccacatgctcttggaagttattccaaccctgcctcaagtctctgacttttaaaatgggaaacacttttcaagataaatctgttcatcacaagaaaggatttcttataaatttgaaatatttaaaagagaattctatgcaaacrtatgcacacatacaagtgaatgtgggcccatttctctggacatgtgtctattccaaaaaaaactgtcataaactgtatcctcattttgcactcctcccaccagtgtgtcccatggtgccacctggtattgtctgcctgaaagaattctaggagggcttcatttgtctctgaagtcatagatcttcatctaccaatactgggaaaactcccttgctcctcttcctctgcattaggcttgtttttctgagacagaagtggtcagagaaaaaggacactggaatccattcattcatttaaaaa

SEQ ID NO: 76517 - DNA, 601 bp, Human
atagtaaaaatgttctctatgttgatatggatgacagaccattttacagtggtgcatatctctgtcagaactcactgaatgcaccctcaggatctatgcattttattgcatgtataatatacttattaaaaacattgagatgggctgccatgttagatggtatctccctgtcaacagagatactcaaacagagtctgcttgtaccaatttagggaacactaaagtttcacctgatgcctaaacagagatcatctgctgtaaccctgtaaattccctcccaacttccagtgggcagtatggyatgaaacccctgcaactcagagatggctggtttaattggagaagtgaaggatttgtattcaggctctgccaccagcagctgcacatctgagtaagttatgtaactcctagcctcatttcctcatctccgaaatagggattatgacatctacttcacagacgaactatccagattaaagaaaacgatgtttgcaaagctctgcacagggtctgacactcagcaaattctcctccaaaaatctgccaaagcactagggcccagtcaaactggtctatattctgccatcgaatgccccatcat

SEQ ID NO: 76518 - DNA, 601 bp, Human
aatcatttgtacaaggatgttcataacagctttattcaaaataagccaaagttggaaacaacctaatggccatcaacagggtggtttgataaacaaattgtggtatatcccataatggaatattagcagcaataaaatggaagaaattattaatatatacaacaatatatacaaatatcaaaaaccttattttgaaggaaaggagctagttagaaaagtgaataccctgcatgattccattcatacaaaaattgagagcagacaagactaatctatagtgattgaagccaagatagtgatktttttatgttcaagggaggagagagcagatattgacagaaatgagcataaagaaacattccaggatagtaaaaatgttctctatgttgatatggatgacagaccattttacagtggtgcatatctctgtcagaactcactgaatgcaccctcaggatctatgcattttattgcatgtataatatacttattaaaaacattgagatgggctgccatgttagatggtatctccctgtcaacagagatactcaaacagagtctgcttgtaccaatttagggaacactaaagtttcacctgatg

SEQ ID NO: 76519 - DNA, 601 bp, Human
attagaatggctaaaatttaaaagttgacattatcaagtgttggtgaagaaacaaagcagctggcaccctcacacgttgctagtagaagtgtaaaatggtgtatcttcctttggaaaactggcagtttcttgtaatgttaaacatgcatctatcctatgacccagagactcaatttctaagtatttacccaagaaaaaaaaatatatgtccacaaaatcatttgtacaaggatgttcataacagctttattcaaaataagccaaagttggaaacaacctaatggccatcaacagggtggtytgataaacaaattgtggtatatcccataatggaatattagcagcaataaaatggaagaaattattaatatatacaacaatatatacaaatatcaaaaaccttattttgaaggaaaggagctagttagaaaagtgaataccctgcatgattccattcatacaaaaattgagagcagacaagactaatctatagtgattgaagccaagatagtgatttttttatgttcaagggaggagagagcagatattgacagaaatgagcataaagaaacattccaggatagtaaaaatgttctctatg

SEQ ID NO: 76520 - DNA, 601 bp, Human
ttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaatttttttaggccgagggaacagcatgacgaatatcttgaagagggaagtagatggcctggtcctgacttgaaagaaactcaatgtgtttaaaaagaaattggtgagaaactaactctccaacacctaaagttgtctggaaatgayagacagaactacaggtcctacaaacactaagaggataattttaaagtattaggaataatattatgtctccaaaacttgacaccctgatgaaatgaacaaattcctttaaaaatacaattttctccaactgacacaagaaaaaatagaaaatgtaaacagctacatatctgttaaataaatggaaacttcaatgaaaaacattcccacaaagaaaatttcaggttcaggcagtttccactgcagaattctaccaaatatttatggtggaaataataccaatattacacaaactctttcagg

SEQ ID NO: 76521 - DNA, 601 bp, Human
aaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaatttttttaggccgagggaacagcatgacgaatatcttgaagagggaagtagatggcctggtcctgacttgaaagaaactcaatgtgtttaaaaagaaattggtgrgaaactaactctccaacacctaaagttgtctggaaatgatagacagaactacaggtcctacaaacactaagaggataattttaaagtattaggaataatattatgtctccaaaacttgacaccctgatgaaatgaacaaattcctttaaaaatacaattttctccaactgacacaagaaaaaatagaaaatgtaaacagctacatatctgttaaataaatggaaacttcaatgaaaaacattcccacaaagaaaatttcaggttcaggcagtttccactgcagaattctaccaaatattt

SEQ ID NO: 76522 - DNA, 601 bp, Human
aagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccgggcgtggtggcaggtgcctgtagtcccagctactcaggaggctgaggcaggagaatggcatgaacctgggaggtggagcttgcagtaagccaagatagtgccactgcactccagcctgggtgacagagggagactccatttaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaatttttttaggccgagggaacagcatgacgaatatcttgaagagggaagtagatggcctggtcctgacttgaaagaaactcaatgtgtttaa

SEQ ID NO: 76523 - DNA, 601 bp, Human
tggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccgggcgtggtggcaggtgcctgtagtcccagctactcaggaggctgaggcaggagaatggcatgaaccygggaggtggagcttgcagtaagccaagatagtgccactgcactccagcctgggtgacagagggagactccatttaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaataattctatatcctaatgatatagtagcagacagccaggtaaaaaaattatggtgatggcaattttt

SEQ ID NO: 76524 - DNA, 601 bp, Human
gccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccrggcgtggtggcaggtgcctgtagtcccagctactcaggaggctgaggcaggagaatggcatgaacctgggaggtggagcttgcagtaagccaagatagtgccactgcactccagcctgggtgacagagggagactccatttaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacgcaaaagggcttcacaa

SEQ ID NO: 76525 - DNA, 601 bp, Human
tgagcatctattatgtgccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatamaaaaaaaaattagccgggcgtggtggcaggtgcctgtagtcccagctactcaggaggctgaggcaggagaatggcatgaacctgggaggtggagcttgcagtaagccaagatagtgccactgcactccagcctgggtgacagagggagactccatttaaaaaaaaaaaagaaaagaaaagaaaaaaagaaaacaaaaaagaaaaaggaaaaaccccaagtagttatctgagtatgtgtatgtgtatgttacataaatgtgtatctgagtgaatgtgtatggaaaatgtgacatacatacg

SEQ ID NO: 76526 - DNA, 601 bp, Human
tatccacattccacaagttgttagctgaggctcctcataatttaatccccacctattttttcagacctctagcaaggctaaaattattggtagaattttcaaagcataacatttcttctcaatgtggattagttcattcacctgaccatgatgtattgagcatctattatgtgccaagcgttttgctgggtactgggtatttgctgattaacaggaacaatgcacaagtccagccttggtggcatttatagtataatcagagagtgaaacaatatatcataactgtaattaacaatttggktaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaaaatacaaaaaaaaattagccgggcgtggtggcaggtgcctgtagtcccagctactcaggaggctgaggcaggagaatggcatgaacctgggaggtggagcttgcagtaagccaagatagtgccactgcactccagcctgggtgacagag

SEQ ID NO: 76527 - DNA, 601 bp, Human
atctctgttatttcagccacccagtttttgatatcttgttaaggcagcccagagtgactatgaaagtctcccttcccagggtactgagtgtaaacaaaaatatgacacagacagagagaggggaaacattaaaaatataaacaggaaaatatccacattccacaagttgttagctgaggctcctcataatttaatccccacctattttttcagacctctagcaaggctaaaattattggtagaattttcaaagcataacatttcttctcaatgtggattagttcattcacctgaccatgaygtattgagcatctattatgtgccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcatgcctgtaatcccagcactttgggaggccgaggcaggcggatcacaaggtcaggagatcgagaccattctggctaacacggtgaaaccctgtctctactaaaa

SEQ ID NO: 76528 - DNA, 601 bp, Human
gagggcagccgcctgcaagccagaaagagagccctcaccagaacctgaccatgctggaatgctgatctcagatgtccagctttcagaactgtgagaaaataaatctctgttatttcagccacccagtttttgatatcttgttaaggcagcccagagtgactatgaaagtctcccttcccagggtactgagtgtaaacaaaaatatgacacagacagagagaggggaaacattaaaaatataaacaggaaaatatccacattccacaagttgttagctgaggctcctcataatttaatcccyacctattttttcagacctctagcaaggctaaaattattggtagaattttcaaagcataacatttcttctcaatgtggattagttcattcacctgaccatgatgtattgagcatctattatgtgccaagcgttttgctgggtactgggtatttgctgattaacaggaacaatgcacaagtccagccttggtggcatttatagtataatcagagagtgaaacaatatatcataactgtaattaacaatttggttaaagtgctgtaaagaaaaaccctaagtaggccgggcgcagtggctcat

SEQ ID NO: 76529 - DNA, 601 bp, Human
ctcccaccactaacataacccaaatacgcaaatcctctgctaatcctacatacaggactgaggaagaagagggattctgggctatccagaggaagatgggaggagacactcattagagctccttggcccaccccctgcttctttgtcccattgttttcagcatcttctctcattaccaaccccagccccctcttagttctctgttacaggctacattatggacccccatccctgccaaagtcgtaggttgaagcccaaaccccaatgtgatggtatttggagatgaggtactttagggagygattaggtttagacaagatcatgaggatagggccctcatgatgagattagtgccattataagaagagagaccagagagtttgctctttctccctctctgccatgtcaggacacagtgagagggcagccgcctgcaagccagaaagagagccctcaccagaacctgaccatgctggaatgctgatctcagatgtccagctttcagaactgtgagaaaataaatctctgttatttcagccacccagtttttgatatcttgttaaggcagcccagagtgactatgaaagtctcccttcccagg

SEQ ID NO: 76530 - DNA, 601 bp, Human
aaagagaaaaggctataattcctcaaatcaagtggtatagaatagagtgtgagagaggctgcagtttggggcccactaagtcgtttcttttattttagtaatcctgcttaacaactgaggactcataaggaggattcccttagaggatgtgatgcccaacaagaaagaaaaactgaattgtcctactcctcctgtcgtggccacctcccaccactaacataacccaaatacgcaaatcctctgctaatcctacatacaggactgaggaagaagagggattctgggctatccagaggaagaygggaggagacactcattagagctccttggcccaccccctgcttctttgtcccattgttttcagcatcttctctcattaccaaccccagccccctcttagttctctgttacaggctacattatggacccccatccctgccaaagtcgtaggttgaagcccaaaccccaatgtgatggtatttggagatgaggtactttagggagcgattaggtttagacaagatcatgaggatagggccctcatgatgagattagtgccattataagaagagagaccagagagtttgctctttctccctct

SEQ ID NO: 76531 - DNA, 601 bp, Human
ttactggggatcatggtagaaggagggagatgggctaggctttcggctcccttccattcacttcttgcaggagtcaatgctctggaaagacctggaggagcctgtgttcctctgacccgtgctgcaaacaggtcctcctgtccagcgcagtgtgggtcaccagcatctatgtcctggtggagccaatagacactctctcctccctcaccctccagtccctcttgcaagaaccccggcatgctctgggcactggatgcacgcagccacatcagaaaggcggttaagaggggcgggggaagcrctctgatccacgatgtcctgcgagctgatcaatcagcttcacgctggaaataaccatgtaagctcctttggacatggtttagggggatagaaagagaaaaggctataattcctcaaatcaagtggtatagaatagagtgtgagagaggctgcagtttggggcccactaagtcgtttcttttattttagtaatcctgcttaacaactgaggactcataaggaggattcccttagaggatgtgatgcccaacaagaaagaaaaactgaattgtcctactcctcctgtcgtggccacctccca

SEQ ID NO: 76532 - DNA, 601 bp, Human
agcagttgagaaaagaaaatctgcctagaaaactattcttatgatctctgctgggtaagaataaaaaagtaccacccaagacaggcaagaccacgctcccatggtcaaatgtaaggacagaaaatgagccacaactcgcactgtagcccctgaaaaaaaaattatcgataggtccaaatgcctcttccaaaaatgctgactcactgaaaattattgccatttaataaataggaagcaagctattacatcgtttgccaaactttctcccacatttctgaaatatattctttaatagctcaawaacattcaggagcactagaggccagttaaattcatctaaaaaggaaggacgagatttctgcctcacccagcacatctgcgttgggtgggtatgccaagaaaacaggaatcaaggtggctatcacctctccactagacagttccccaaatccagcctagacggaaagcactttttttcccaggcagcctccaggaatacggaatacttttgggaggagaagagccatggacgggtgagtccttaccccaggatgcacaaacaccacagcaagacaccaatgactgccggaagttcggcggt

SEQ ID NO: 76533 - DNA, 601 bp, Human
agtactgctaactttcctggaaataaaagctatccctccctaagactgacatttttatggccagaaatgtacatttaatctatttgttttaaactgtaatatattatggatgcctaaataaagccaaatgcctatcagaaagcagttgagaaaagaaaatctgcctagaaaactattcttatgatctctgctgggtaagaataaaaaagtaccacccaagacaggcaagaccacgctcccatggtcaaatgtaaggacagaaaatgagccacaactcgcactgtagcccctgaaaaaaaaattatcgataggtccaaatgcctcttccaaaaatgctgactcactgaaaattattgccatttaataaataggaagcaagctattacatcgtttgccaaactttctcccacatttctgaaatatattctttaatagctcaataacattcaggagcactagaggccagttaaattcatctaaaaaggaaggacgagatttctgcctcacccagcacatctgcgttgggtgggtatgccaagaaaacaggaatcaaggtggctatcacctctccactagacagttccccaaatccagcctagac

SEQ ID NO: 76534 - DNA, 601 bp, Human
agaggaaatataacaatctggccagctaattctagggttatagacacagaagcatgaatatttagattccaggcatttcagctgacagaaacattttatatcagttctaatgaaaaggattgactaggtttcacttattgcttgccaactggaattttgttaggcacaattacataatgcagaagtatttgagctgtgcctacccacatcagaatcctaaactaggtttcaaagggactacattccattttaaagaaattcctagtactgctaactttcctggaaataaaagctatccctycctaagactgacatttttatggccagaaatgtacatttaatctatttgttttaaactgtaatatattatggatgcctaaataaagccaaatgcctatcagaaagcagttgagaaaagaaaatctgcctagaaaactattcttatgatctctgctgggtaagaataaaaaagtaccacccaagacaggcaagaccacgctcccatggtcaaatgtaaggacagaaaatgagccacaactcgcactgtagcccctgaaaaaaaaattatcgataggtccaaatgcctcttccaaaaatgctg

SEQ ID NO: 76535 - DNA, 601 bp, Human
ctggagtgcagtggcacgatcacagctcactacagcctcgacctcctgggctcaagtgatcctcccgcctcagccccccaagtagccagccaccatgcccagctaattttttctatttttttagtgacacagtttcaccatgttgccaatcctggctccctaccttaacccagtcctggttcctgttctgatagatgctcaacatcagttgatattcagactgggattgtcgcccattcattcattcattcattcacccacacacatgcacagagtcactgcttccaccaccccttgtggytccagatgctgcagcacaggggtgaggctcctgcttccaggtcttctatttgaatagaggagccagtaagtagagaaacacattttttaaaagtaaacaaataggacttactcactttacctctttactttgttttaaaattattgaattttttaagagacagtgtctcatggtcacccatcctggggtgcatgatcatagctcactggagtcttgacctcatgggctcaaatgatcctctcacctcagcctcccaacatgctgggattataggcataagccattttgcctggtctgact

SEQ ID NO: 76536 - DNA, 601 bp, Human
atggggaggcttcttcagggtggtcccctgcacccttctgccatcacaggtcccacctcccatccccagcttggtcactgtgaggaccacctgcttcttagccccagcacagagtgaatctgagcctctccttcccagctggagaaaaaggactgtctcgcttcctctcaaatgcccctgggcttttgttcccacagtcagaatgtgtgttctataaacagttcttgcttgtctgaccttttcaccatcctttcctttggtaattgttcaggttgttttgctccctacttttttaaaaaawttttttgagacagggtcttactttgtcacccatgctggagtgcagtggcacgatcacagctcactacagcctcgacctcctgggctcaagtgatcctcccgcctcagccccccaagtagccagccaccatgcccagctaattttttctatttttttagtgacacagtttcaccatgttgccaatcctggctccctaccttaacccagtcctggttcctgttctgatagatgctcaacatcagttgatattcagactgggattgtcgcccattcattcattcattcattcacccacacaca

SEQ ID NO: 76537 - DNA, 601 bp, Human
tcccttctcagataaaagcagagttactgtactgacagaaattgagggataaacaggtaaatgataactcattcactgcttcagggttcctgtgatccccagagagaaaagactctggagattcatacatgtgaggtctcgggagaggacaagacagaaaacacaacagcaaacacatccaagcccataccagaaagcctgccagggttttccaatttgctattttccattccctttcactccttaatctttaaatccaaaaagctgaaaggttccaataaacgtctgtcgtttccaatcyctgcagccccacgcaaatcctgaagagcaattatttttgtggtgtctgacaaggtcattgttatctggccttgcagctcagagggatcaaactgagggcaggcatatcagggtaaacagaggatgcccaggagcatggggaggcttcttcagggtggtcccctgcacccttctgccatcacaggtcccacctcccatccccagcttggtcactgtgaggaccacctgcttcttagccccagcacagagtgaatctgagcctctccttcccagctggagaaaaaggactgtctcgcttcct

SEQ ID NO: 76538 - DNA, 601 bp, Human
ttcgattgtggaattataaactgataaaaccttttcagaaagtaattcagcattattaatcaaagtaattccatttctgggaatatagcctaagaaaatataacaaaatatggaaatatgctacagaaacaaagatgctcattgcaaaattgttcattaagcaagaaaaatagaaagcagcttaaaatccaaaaataggtcttacgtctgatacatcttctttataggatattatatatgctcaaagattgtaacaaggaaaatttttgacataatgttaagttaaagaagtagaatgtcraaattaaaatagcgattaccaggagctgaggggagaggaaaaattatttgtttaatgggtttagagtttcaactttgcaagatcaaaaagtactggagctctgttttgcaacaataggatatacttaacattactgaactgtacactaaaaataattaaaatggtaaattttatgttatgtgtttttcaccacaattttttaaaaatagcaaattggaaatgctgaaaaaaaaaaaaaagaagtaaaagatgaagtgcatggtccctatgataaaactatgaaaactataggtatgtgta

SEQ ID NO: 76539 - DNA, 601 bp, Human
caaaatttcagttaaataagagaaataagtttaagatatctactgtataacatggtgactatagttaataaccatatagtattcttgaaaaatgctttaaaaaattaaaagaaatgcaaattaaacaaaaataagtaagcactgtatttattctacttaatagcaacatatttgagcttcacctagtggagatgactctacaatgaaatagtcttataattcgattgtggaattataaactgataaaaccttttcagaaagtaattcagcattattaatcaaagtaattccatttctgggratatagcctaagaaaatataacaaaatatggaaatatgctacagaaacaaagatgctcattgcaaaattgttcattaagcaagaaaaatagaaagcagcttaaaatccaaaaataggtcttacgtctgatacatcttctttataggatattatatatgctcaaagattgtaacaaggaaaatttttgacataatgttaagttaaagaagtagaatgtcgaaattaaaatagcgattaccaggagctgaggggagaggaaaaattatttgtttaatgggtttagagtttcaactttgcaag

SEQ ID NO: 76540 - DNA, 601 bp, Human
aaaacagctgatctcatagaaagaggggctggggcggttggagggaagggtggttgggtagatgttggtcaaaggatacaaaatttcagttaaataagagaaataagtttaagatatctactgtataacatggtgactatagttaataaccatatagtattcttgaaaaatgctttaaaaaattaaaagaaatgcaaattaaacaaaaataagtaagcactgtatttattctacttaatagcaacatatttgagcttcacctagtggagatgactctacaatgaaatagtcttataattcsattgtggaattataaactgataaaaccttttcagaaagtaattcagcattattaatcaaagtaattccatttctgggaatatagcctaagaaaatataacaaaatatggaaatatgctacagaaacaaagatgctcattgcaaaattgttcattaagcaagaaaaatagaaagcagcttaaaatccaaaaataggtcttacgtctgatacatcttctttataggatattatatatgctcaaagattgtaacaaggaaaatttttgacataatgttaagttaaagaagtagaatgtcgaaa

SEQ ID NO: 76541 - DNA, 601 bp, Human
agtgtccatcaacagatgaatgaagaaaatgtgatatatatacacaatggcatattattcagccaagaaaagaataaatcctttcatttgcaacaatgtggatgaacctaaagtttatattaagttaaataagccatgcacagaatgacaaacatcacgtgatctcactcatataaaacagctgatctcatagaaagaggggctggggcggttggagggaagggtggttgggtagatgttggtcaaaggatacaaaatttcagttaaataagagaaataagtttaagatatctactgtatwacatggtgactatagttaataaccatatagtattcttgaaaaatgctttaaaaaattaaaagaaatgcaaattaaacaaaaataagtaagcactgtatttattctacttaatagcaacatatttgagcttcacctagtggagatgactctacaatgaaatagtcttataattcgattgtggaattataaactgataaaaccttttcagaaagtaattcagcattattaatcaaagtaattccatttctgggaatatagcctaagaaaatataacaaaatatggaaatatgctacagaaac

SEQ ID NO: 76542 - DNA, 601 bp, Human
atcaaatatgatacaataaggataaattctttgtaatgtcaaaagcatgtatgtaaaatactttatcattagttgataagtaggcaaaaatcaaacagctacatcatgaagtagataatataactagtgaataatcattaaataaattaattaaatgaaactattttatcttaacttggttcaaataaaaaaaatgcgcaccatatacaaaaaccaactcacaatgaattaatgacttaagatccaaaactgtgaaactactagaagaaagtattgagaaagagccccatgacaacggtcwgggcaataattttttggaaatgacccctaaaacacaggcaataaaagcaaaaatggacaaagaggattacatcaaactaaaaagcttggcccaacaaaagaaagaatcaaccgagtgaagagaggcggggcgcagtggctcacgcctgtaatcccagcactttgggaggccaaggcaggtggatcacaagatcaggagatcgagaccatcctggctaatacggtgaaaccccgtctctactaaaaatataaaaaattagccgggtgtggtggtgggcacctgtagtcccagctactcggc

SEQ ID NO: 76543 - DNA, 601 bp, Human
aggagtcatacaatctttgaaatacaggctctgccaccaccataaaaacgtcaaaattctgcatgtttaaaatcataataaacacaatatccaatgaaaaaataatcaaatatgatacaataaggataaattctttgtaatgtcaaaagcatgtatgtaaaatactttatcattagttgataagtaggcaaaaatcaaacagctacatcatgaagtagataatataactagtgaataatcattaaataaattaattaaatgaaactattttatcttaacttggttcaaataaaaaaaatgygcaccatatacaaaaaccaactcacaatgaattaatgacttaagatccaaaactgtgaaactactagaagaaagtattgagaaagagccccatgacaacggtcagggcaataattttttggaaatgacccctaaaacacaggcaataaaagcaaaaatggacaaagaggattacatcaaactaaaaagcttggcccaacaaaagaaagaatcaaccgagtgaagagaggcggggcgcagtggctcacgcctgtaatcccagcactttgggaggccaaggcaggtggatcacaagatcagg

SEQ ID NO: 76544 - DNA, 601 bp, Human
gaattaaaaattaaatatagataataagggacagaaaaattgaggaaaatataggtatatattattagccctctgaaaagaagaatttctaatttcatgtgtaaaaggagtcatacaatctttgaaatacaggctctgccaccaccataaaaacgtcaaaattctgcatgtttaaaatcataataaacacaatatccaatgaaaaaataatcaaatatgatacaataaggataaattctttgtaatgtcaaaagcatgtatgtaaaatactttatcattagttgataagtaggcaaaaataaaacagctacatcatgaagtagataatataactagtgaataatcattaaataaattaattaaatgaaactattttatcttaacttggttcaaataaaaaaaatgcgcaccatatacaaaaaccaactcacaatgaattaatgacttaagatccaaaactgtgaaactactagaagaaagtattgagaaagagccccatgacaacggtcagggcaataattttttggaaatgacccctaaaacacaggcaataaaagcaaaaatggacaaagaggattacatcaaactaaaaagcttggcc

SEQ ID NO: 76545 - DNA, 601 bp, Human
tgtatctgaatggatgggcagaaagacacacacatatattagtaaactaggaacacacattctttaataacagccatgagcagtctcaaaaactgaccacatattaggccacaaagaaatttcatcaaaatctaaaatgcaaaaatcatctaagtcacatttaccacaaagcaatagaataagaaagtaataagagcatggcaacaatgactaagcagtagagaaatagactctattttatcagaagaattttacagacaataaagaggtcatcacaaatcaaaaggaagacaggcatcaygcaatgatggacctcataccataatggaaataagtttgagatgaattaaaaattaaatatagataataagggacagaaaaattgaggaaaatataggtatatattattagccctctgaaaagaagaatttctaatttcatgtgtaaaaggagtcatacaatctttgaaatacaggctctgccaccaccataaaaacgtcaaaattctgcatgtttaaaatcataataaacacaatatccaatgaaaaaataatcaaatatgatacaataaggataaattctttgtaatgtcaaaagcatg

SEQ ID NO: 76546 - DNA, 601 bp, Human
tgaaggaaatagagaacaggaaacatttaaaataacattaaagtgtcctagaccgaaagaatgacctgtatcctcagattggaaaggtcttttaagtgtccagcaggttaaattttttttttttttttttttgagatggagtctggcactgttgcccaggctggagtgcagtggcgcgatctcggctcactgcaagctccgccccacggccagcagattacattttcaaagacctaaatccaagcatattgtggataaattttataacatcaatgtgaagaaataaatcccttcaaagcarcaagagtcaaattattgtcacaattctcctggcttcactggttgcaagaaaacaaaagaaggatatctttacaattctcaggacagattaatttgaaccaagtaatatatacttagccagttgaaagaaaaataaatccaaaagaagcaagatacaagaagcaacatggaaaagataaaagtaatggattcatttatgtgttgactgagtatgttttaaatgaataaataataacaatgatccaaaattaaaatctctggaaataaatggaagatggaggtgtgaaggagagagggcaat

SEQ ID NO: 76547 - DNA, 601 bp, Human
aaacaggaataaagttttccacatccatgtaattgagctgccagaaggaaaaaatgaaggaaatagagaacaggaaacatttaaaataacattaaagtgtcctagaccgaaagaatgacctgtatcctcagattggaaaggtcttttaagtgtccagcaggttaaattttttttttttttttttttgagatggagtctggcactgttgcccaggctggagtgcagtggcgcgatctcggctcactgcaagctccgccccacggccagcagattacattttcaaagacctaaatccaagcayattgtggataaattttataacatcaatgtgaagaaataaatcccttcaaagcaacaagagtcaaattattgtcacaattctcctggcttcactggttgcaagaaaacaaaagaaggatatctttacaattctcaggacagattaatttgaaccaagtaatatatacttagccagttgaaagaaaaataaatccaaaagaagcaagatacaagaagcaacatggaaaagataaaagtaatggattcatttatgtgttgactgagtatgttttaaatgaataaataataacaatgatccaaa

SEQ ID NO: 76548 - DNA, 601 bp, Human
tataaagagttgtgaaaaactatctcaactcaaaaaatcaactaaatatcttagcaattaaaattttgaacatcaaaatcttaaaaggccagcttaatagaagaatgggcatagccacacagcaaagtagagggctgaactatcacacagccatcttcatacaaaggggcacaggaatgaaaagtgcaaaagaaaaactaagagacccagaaaacaggaataaagttttccacatccatgtaattgagctgccagaaggaaaaaatgaaggaaatagagaacaggaaacatttaaaataayattaaagtgtcctagaccgaaagaatgacctgtatcctcagattggaaaggtcttttaagtgtccagcaggttaaattttttttttttttttttttgagatggagtctggcactgttgcccaggctggagtgcagtggcgcgatctcggctcactgcaagctccgccccacggccagcagattacattttcaaagacctaaatccaagcatattgtggataaattttataacatcaatgtgaagaaataaatcccttcaaagcaacaagagtcaaattattgtcacaattctcctggctt

SEQ ID NO: 76549 - DNA, 601 bp, Human
gttgccaggcacggtggctcatgcctgtaatcctagcactttgggaggctgaggcaggcggatcacttgaggtcaggagttcgagaccagcctggccaatatgatgaaaccccatctctactaaaaattcaaaaattagctgggcatggaggcaggcacctgtaatcccagctacttgggaggctgaggcaggagaatcgcttgaacccgggaggcaggggttgcagtgagctgagatcgcgccactgcactccaacctgggcaacagagcaagactcggtctcaaaaaaaaaaaaaaaaagaaaagaaaagggaagaaaagaactaaagaattgccaaacatttgaggaaaggcaactttccttcaagaaatgcacatattacacttcaggccaactgacccttaaggatacaacattaacaaagcattaaacaaaaaatgctttagaaaaatatttgaaaaatataaagagttgtgaaaaactatctcaactcaaaaaatcaactaaatatcttagcaattaaaattttgaacatcaaaatcttaaaaggccagcttaatagaagaatgggcatagccacacagcaaagtagagggctg

SEQ ID NO: 76550 - DNA, 601 bp, Human
gcaagtgcatacacttgaggtgttaaaatagagcaatatcctgagtaaactgtaactcttggaagaaacacactgtctctacagctgtaagaccagttaccgaatagaaacacacagtagcatatctcagtactccccagacaaactgcaacacacaaagacagcattcacatataggctaacagaagatctcaaatgcaaagataagcacaaaacaggccaagcacggtggctcatgcccgtcatctcagaactttgggaggctgagcaagactccatctccaaacaaaaaaacactgtyaagtacatctacatataaccacatggatgaatcacacaggcgtaacactgagagaacaaggcctgacacagagtcattctatataacccagttatatgaagttcaaaactgggcaaaactgatatatggtcaggagagtggttacctttgtggggtgtagtgactagaaggttgccaggagaagggactagggggtgacaggcaataatgactgtttcttgagctgagcgttggcttctcaaatgcattctcttcgtgaaaatttatccagctgttgccaggcacggtggctcatgcctg

SEQ ID NO: 76551 - DNA, 601 bp, Human
acactaccagtctatttaaatcaattttaaagaacatactggctaactagaagttaaatcaataatacaataagagattatttataaaacaaagcattcagcttaagattttgggggaaaagtagtcttgacaataggagaaagctgattttttagtttagtgtttatgactaaataaccagaaaaccaataaatatgaaaaaaaattttaaaaatctgtagaattttatgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaacttcgaaacttgatacacacaaaaaagaaatccattataggataacaattgagatatacattgaaatatatagtaacagcttcccttacagactctgcacccatatataatttatgattaaattattgcacatacattttattaaaattctaaactgttccataatacaaaacgagatctaaagctactaacttatattataaaataaacataaactgaggaccaaaa

SEQ ID NO: 76552 - DNA, 601 bp, Human
tccaaatagcaaatttccgttaatccgagtaatcacttgagtaatttaaaaccagtaatctaccctctaagcacactaccagtctatttaaatcaattttaaagaacatactggctaactagaagttaaatcaataatacaataagagattatttataaaacaaagcattcagcttaagattttgggggaaaagtagtcttgacaataggagaaagctgattttttagtttagtgtttatgactaaataaccagaaaaccaataaatatgaaaaaaaattttaaaaatctgtagaattttrtgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaacttcgaaacttgatacacacaaaaaagaaatccattataggataacaattgagatatacattgaaatatatagtaacagcttcccttacagactctgcacccatatataatttatgattaaattattgcacatacattttattaaaattctaaact

SEQ ID NO: 76553 - DNA, 601 bp, Human
gttaatccatcaggatgtatttatttattttggctagtagtatgccaaaaggagaatgctttattttttctccaaatagcaaatttccgttaatccgagtaatcacttgagtaatttaaaaccagtaatctaccctctaagcacactaccagtctatttaaatcaattttaaagaacatactggctaactagaagttaaatcaataatacaataagagattatttataaaacaaagcattcagcttaagattttgggggaaaagtagtcttgacaataggagaaagctgattttttagttyagtgtttatgactaaataaccagaaaaccaataaatatgaaaaaaaattttaaaaatctgtagaattttatgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaacttcgaaacttgatacacacaaaaaagaaatccattataggataacaattgagatatacattgaaatatatagtaacagcttccct

SEQ ID NO: 76554 - DNA, 601 bp, Human
ggatgaggatgagtccagtgtacagccaagtttgggaatcactgctttagagtatcttttattttctttttttaacctctaacttgttaatccatcaggatgtatttatttattttggctagtagtatgccaaaaggagaatgctttattttttctccaaatagcaaatttccgttaatccgagtaatcacttgagtaatttaaaaccagtaatctaccctctaagcacactaccagtctatttaaatcaattttaaagaacatactggctaactagaagttaaatcaataatacaataaragattatttataaaacaaagcattcagcttaagattttgggggaaaagtagtcttgacaataggagaaagctgattttttagtttagtgtttatgactaaataaccagaaaaccaataaatatgaaaaaaaattttaaaaatctgtagaattttatgggagcaaacaatggcaacaagaaaacaaacaaaataaagttctggctgatccaataaaaaaagaaaaaaattatccacaatgatattctaataaatctgtgaaaaacctcagtgagagggatgactttctgaaaaatataaac

SEQ ID NO: 76555 - DNA, 601 bp, Human
acacctacggtaaaatttaacttataaattagcacaggaagggattaacaatggcaataataaaatagaacaattatgacaataggtaccagcatcactatacttgcgctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaacmttatgaattgtttatttctagaatttcctatttaatattttcagactacggttgcctggggataactgaaacctcaggaagcaaaaccatagataagaggcactcctgtagaaatacatgctagcaatgtattagccatttagtgtttaatcctgaacattctgtgtgtgcatagatatgcttttatttatggaactaaaaatagaatacaaacaacctgaacttcaaactggatttcttctttttatctttaaacgatggtgtttgtatcgtatatccattgctgattggcagcttgcc

SEQ ID NO: 76556 - DNA, 601 bp, Human
cacacctacggtaaaatttaacttataaattagcacaggaagggattaacaatggcaataataaaatagaacaattatgacaataggtaccagcatcactatacttgcgctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaamcttatgaattgtttatttctagaatttcctatttaatattttcagactacggttgcctggggataactgaaacctcaggaagcaaaaccatagataagaggcactcctgtagaaatacatgctagcaatgtattagccatttagtgtttaatcctgaacattctgtgtgtgcatagatatgcttttatttatggaactaaaaatagaatacaaacaacctgaacttcaaactggatttcttctttttatctttaaacgatggtgtttgtatcgtatatccattgctgattggcagcttgc

SEQ ID NO: 76557 - DNA, 601 bp, Human
cagtatcactgtcgcatattgctgagctaaaacgacaaatgtagaaacgtggagtagaaggcgactggcagttagcactgaaactatgaaagataacaacactcttccatgttccttgagggatacattccaagacctcccagtggatgcctgaaacctcagatagtgccaaatcctatatgcattatatacacacacctacggtaaaatttaacttataaattagcacaggaagggattaacaatggcaataataaaatagaacaattatgacaataggtaccagcatcactatacttgygctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaaccttatgaattgtttatttctagaatttcctatttaatattttcagactacggttgcctggggataactgaaacctcaggaagcaaaaccatagataagaggcactcc

SEQ ID NO: 76558 - DNA, 601 bp, Human
aacctagactgttatctcataccagtatcactgtcgcatattgctgagctaaaacgacaaatgtagaaacgtggagtagaaggcgactggcagttagcactgaaactatgaaagataacaacactcttccatgttccttgagggatacattccaagacctcccagtggatgcctgaaacctcagatagtgccaaatcctatatgcattatatacacacacctacggtaaaatttaacttataaattagcacaggaagggattaacaatggcaataataaaatagaacaattatgacaatakgtaccagcatcactatacttgcgctttggggccgttattaagtaaaataagggttagttgaacacaggtaacatgggttacagcaagacatcggtctgcccactgaagtgccctgagagactaatggccagggagtgcagatggcacggatgtgctggacaaagggaggattcttgtcccagatggaaccaagcaggacagcatgcaacttaaaccttatgaattgtttatttctagaatttcctatttaatattttcagactacggttgcctggggataactgaaacctcaggaagcaa

SEQ ID NO: 76559 - DNA, 601 bp, Human
atacccagtcaagtggttgttcaagaataaaagtaacaaaaaaaatttcaaattctaaggtctcaaaaaatacattgtttgctcagtgtgtgcataaagtttccaaagaggttcacaagacttgctaaatcagaatgggagggggcaagggctggaaattaaatttataacagactctactgctggtcctaaccttccagcccaacctagactgttatctcataccagtatcactgtcgcatattgctgagctaaaacgacaaatgtagaaacgtggagtagaaggcgactggcagttagyactgaaactatgaaagataacaacactcttccatgttccttgagggatacattccaagacctcccagtggatgcctgaaacctcagatagtgccaaatcctatatgcattatatacacacacctacggtaaaatttaacttataaattagcacaggaagggattaacaatggcaataataaaatagaacaattatgacaataggtaccagcatcactatacttgcgctttggggccgttattaagtaaaataagggttagttgaacacaggtaacatgggttacagcaagacatcggtct

SEQ ID NO: 76560 - DNA, 601 bp, Human
cagactttctagaagcattttattaagcaccgccacgtgccaaaggcagtgcgaagccctccagtgcactgagttgacagacaactccacgcccgtgggtggggctttgttctcccacgcccgtgagccagtaaagggcagcctagggcacagtggtgggaaggaatccttactaccttctacttgaatgaggagtacactaactgcacgcaacgtggagctgtttaggtaataagggaaaattaacttaaagttcatggggtgggggaaaatctgtacaaggaaagagggagaaaaggaytggctcaaaaaaataatttctcatctgaaaaggattaaccatcatgaacagaagactttttttgaaaacattctccttctatgctaaataatacttatataacttttattaaataattgcagagatgagacgggatgttgatgaaataaaaaggctcacggccaaaagcacagttgtaactgagctgatgaaaggctgacttagcaccgctgaaaaccgaccacggcgcagagtacaaaactaagaagtcacctcagaaagcagagaaaatatgagaaagggagaaaaaaaaaagatgaa

SEQ ID NO: 76561 - DNA, 601 bp, Human
tcaggtgaaattcatggtcaaaacattcagtcagtcctgggctataataatttggctatcatgcaagggaattacttacaaaatgctggtttgtcaccgctttgagacacattgaatgtcacacccactcccaaggggattttcttttgcagactttctagaagcattttattaagcaccgccacgtgccaaaggcagtgcgaagccctccagtgcactgagttgacagacaactccacgcccgtgggtggggctttgttctcccacgcccgtgagccagtaaagggcagcctagggcaccgtggtgggaaggaatccttactaccttctacttgaatgaggagtacactaactgcacgcaacgtggagctgtttaggtaataagggaaaattaacttaaagttcatggggtgggggaaaatctgtacaaggaaagagggagaaaaggattggctcaaaaaaataatttctcatctgaaaaggattaaccatcatgaacagaagactttttttgaaaacattctccttctatgctaaataatacttatataacttttattaaataattgcagagatgagacgggatgttgatgaaataaaa

SEQ ID NO: 76562 - DNA, 601 bp, Human
gttcaggtgaaattcatggtcaaaacattcagtcagtcctgggctataataatttggctatcatgcaagggaattacttacaaaatgctggtttgtcaccgctttgagacacattgaatgtcacacccactcccaaggggattttcttttgcagactttctagaagcattttattaagcaccgccacgtgccaaaggcagtgcgaagccctccagtgcactgagttgacagacaactccacgcccgtgggtggggctttgttctcccacgcccgtgagccagtaaagggcagcctagggcgcagtggtgggaaggaatccttactaccttctacttgaatgaggagtacactaactgcacgcaacgtggagctgtttaggtaataagggaaaattaacttaaagttcatggggtgggggaaaatctgtacaaggaaagagggagaaaaggattggctcaaaaaaataatttctcatctgaaaaggattaaccatcatgaacagaagactttttttgaaaacattctccttctatgctaaataatacttatataacttttattaaataattgcagagatgagacgggatgttgatgaaataa

SEQ ID NO: 76563 - DNA, 601 bp, Human
tgaataatattacattattgctaataaatagaggactgataaattcttatctcaggataatgaacagtaaaaggcaggaggacatacttttaaagacttcagtgccattggattctctttttcttttcaacttgactaatagaaagtgaatttgacctcacagtcacatagatgagcagtcagagagaggaaaccaatttggaattaaagcaaaataaaataaacaagcaaaaaaaacactaacacccaaggagtaaagccaatcataggttgaatttgttggctgtgtcaggttcattcrggaagctaggtcccagcctgtgttaccaggaaaatgatgctgaatctaatcctcaaaactacagatatattaattacaaatcacaaaatatggaggtgtcctgtttttaatcatttatcaaatgcatgaagggcaaccaaagaggaaatggaacattagaagttagcttcttagagtgtaatttcctagaagagaaatttatggcctgtacttattctccattagagcacgtctaacctcttttattagtttattcatcaagacagccttggtttcaggccagctctgcaagccggcagg

SEQ ID NO: 76564 - DNA, 601 bp, Human
aaaggcagaaatcaaggttattggcaatcagaaaaacatgaagaaatacaatattcactgtatgtgaataatattacattattgctaataaatagaggactgataaattcttatctcaggataatgaacagtaaaaggcaggaggacatacttttaaagacttcagtgccattggattctctttttcttttcaacttgactaatagaaagtgaatttgacctcacagtcacatagatgagcagtcagagagaggaaaccaatttggaattaaagcaaaataaaataaacaagcaaaaaaaacactaacacccaaggagtaaagccaatcataggttgaatttgttggctgtgtcaggttcattcaggaagctaggtcccagcctgtgttaccaggaaaatgatgctgaatctaatcctcaaaactacagatatattaattacaaatcacaaaatatggaggtgtcctgtttttaatcatttatcaaatgcatgaagggcaaccaaagaggaaatggaacattagaagttagcttcttagagtgtaatttcctagaagagaaatttatggcctgtacttattctccattagagcacgtctaa

SEQ ID NO: 76565 - DNA, 601 bp, Human
aaaaaaaaaaagaaaagaaaagaaaagaaaaattagaggaaacaataaggaaattcccattttggaaaaaattgctgagtgatccatgttttagtcatcaatatttaccacagtcaatgagatgtggaattacagcctttaaacacagctgctgactttcctctgacagtagaataagtgttctagcacctgtgtgttagatctccagtttgcagggcaactgagaaactgccaaaacctcagatagtgagagggagtctccttgtctcccctttaattggccgtttcaggctatggagtrttctaggccccctatgggcttgcagtttgggaaagggccctgatgctggtcacataattgtgatttgcccatttcatcccatgcactttaattttccttctgctgcattcttaattctttatcaatctttctgcccaccttatgcttctctgccttatttctttcagctcttggcccagtgaggcagccaaagtactggaaatgaaacagcaactccaaatcattatttcaaattgcattgcaaagcctccatccctgcctaatgccacagattggcaggaattcaccgccaaagagagc

SEQ ID NO: 76566 - DNA, 601 bp, Human
aactctaaatgatggttacagtgatattagtagtgcgttagggagctcttgccatatgcagaacatttaatcattgttgctaaaacagtccatgtttagctctgaaatctgattatttttatgacatcagtattatcacagatccctaggtttaggaatttgctttctaaatgaaactgtatgaccacacatctgaaagctacaagcaaaagatgcaaggttaacccctggtgggcattctccacagtctgaaatgtgaaccttgccaggttaagtagggctccttgggaagaaagagtgrggcacgccaggagcagggctgtgtgctctgcatagcaaaggttatatatctctgtgtggagatagtcatagccttcctggtcaagcccagggatctgggccaaacacgaagctaccagcggttagaatgatttgaaccattcagattctagcctgcttcctaagctttgagggagattatgatcttatcatcaacacctgatccaactaaagtcaatcattctcatgttgcctatacaattcctgagtctccatcccatgagttctaattcacatcgatggacacagtgaatcatgatag

SEQ ID NO: 76567 - DNA, 601 bp, Human
gatctgcccgccttggcctcccaaagtgctaggattacaggtgtgatccaccgcgcccagcccagtttattttttaaataaatgttattgtgtatgtttgaggtttacaacatgatattacctaccatctcacatagttacgtttttgtgtgtgacaagagcagctaaaatctacatatttaacaaaaatcccaaataccatacaattttattagcaatagtcctcatgttgtacattagacctctagacttgatcatcctacatagctccctacttaagtatttctgttaagaatctctkcggggatggcatcacatcaggatatcccagcccaatgactagctccatccatgtggctaaggcagaaatgctaatgtctccactgagaggtgcccatttccctttgtaatgaatatgccaccttgagtgaggccccgagactgcaggaatatcctgctccccaaaaaccttatacctaatagctttagcattcactggtgttccttgagtggatcaactggaccttatgacattttgaggtccctaagagctgaggccttgtctgtctggattccaggagccctgggtccctggagcata

SEQ ID NO: 76568 - DNA, 601 bp, Human
acaattgtgtggttgcttcccatcttcctgtctacaaccgaggtgaagttaatttccagcaagataaattttaggtaataaaatgactcagagagggtcttgttgcaggcaagcgagagcagaagggtcttcaaggttactcaccaaatggatgaacccggctgcagtcagccacgtgctgataaatatggagagcagattcaccagcttgatggaattactgtgcaagagacaacaagcaaaatccccacgttaccaagggaaggccctgctggggctgccttacagggtaacagcaccygcttagcaggagaggctgccacatctaactcccaaccatttctccattataagggaattctggaaggtggaggaagctgctgggatgaaggtcaggacagagcctagaggaacaaatttaactttggtaaaaattaacttttatttaaaaaactcttcaaatctacagaaaagtggaaagaacagtataatgaacacttgtacgctcttcatttagactgaccaattattaacattttaccacgggtgctttatctccctacatgctttttctcttatcccccccgcccttttttcttct

SEQ ID NO: 76569 - DNA, 601 bp, Human
tcctattaactctatgatttcagggacgtagctggcaaacatggcctgagaagataggagacagaagagagactaaaaagacaggccaaagaaaaggggggacctgttcagagggtgggggcactaagatctgaaaacacaaaaggattaggcctgcaaaggtatatattgatatgttggatcataaaaaactaaaagcacgaagagagcaagctcccagaaatacacaagacaaacaaacattggccaccttgacaactaaagaacaaaaaaaaatcacagtcgagaaaaatacaaaggmgacaggaataaataaggtgatatctagttcttcttgctgaagaaaaataggcaagagggggacatgctagtgaaactaaacacacacagacacatgtgtgcatgcacagacacacacagtttcgcaagagaagatcttcctttgtcattaaaattcagaggagaatcaatgcttttatgagtgacaaaagaaaataaacaccaaaagattaaaaactacatttttctattaaaaaaaaaaaaacactgaaaagctcaaaagggaaatttaggaaatcacctgggaggagaagatagcaag

SEQ ID NO: 76570 - DNA, 601 bp, Human
aaacaaaggtgactactccagaaaaagctttaaaaaaataaataaaggatggctgctgccagccccctctcccccatggcattctcctcttgaggttgtaaggtactgccctctacttaggaaaaaaccttggggtctctattgaacctgcacattgatatcgagagtgataaagtgatctgagcacacactaaaatagttcccgagaagaaagcattcacatttgggaagccaaacaaaagatttggcaggaatagcatgtagtaccctaaactaccagaaatatactatttcttgcccrgaaggaatttcagctgagtaatgagtccctttgaggataagatcggtgcctcctggatgaagaggagaactgggttcccagtggccgcagtgcctttgcagtaggccagatgacctggatctgccacccaaggacttctctgccagagtcttatcctgtgttcttgctacacacaaaccaccataggagggcatcatactagtttgagggaccagaattttatcacatagccagatgatggaagaatgaacgagttttgtttacttgttaggggtcagaagagaaaatatgggcccagtt

SEQ ID NO: 76571 - DNA, 601 bp, Human
agctcacccacatttgactaggaaaattatttcattaaaaaaaaaaaatcacctggaatgaaagtcaagaaatattttcaacttagccttcagggcaattgattttattgacttcttggggcagtgattgggaaatgctggcggagacgtcagaagatagggaggccataaagagagccccaggccctcagaatgccttctgctttatggagacctgtccacaccttcaaggcaaaatgaattgagatgctgttttcctcttggcatgggatacatgaccactgggaatctttggacttayttggccttttggatccaaccaatggcccagaaatcagaacagcttggttctaacctcatccagggctgttaagataatattgaggggagggctccattagagggaagatggagggatgtgctgcctcccggaaaagacgccaactggcctcctctggcccactgtcctttgtgcctttgaaaggaaacgggtgtcctgtgggtagttcaagaaaatgagcccttttgtccacctcctcatttcctgtgcagaggcctggacacctgagctcaggaagcactggactcactgaccaaaggg

SEQ ID NO: 76572 - DNA, 601 bp, Human
ggcactctaggcccttgaaatagtgttgatggtgaagaggctttgagaatgctacttgaaatgtttatattatgccaaacacattgattaaaactgaaaatgaaatgccaatgaaatcttcatattctcaaatatcctgaatttgggtgttgtacaaacaaaaccctgatcttctctgcctaaattttgtactttaaataatctttgaatttcaaagttttatgtctctgtagctttagatcatgagttaccttgagttctctgacaagttaatatattgttagagaaatcatttctgaayaaaatatgcacaagtaaacaaatcccttaactatgtatacattctaatttctttctgggcatttatttgattgggtcctggggagcagagaacatgtatgtgtgtgtccatgggcagagcacatggacttatgcatacacaaaaactcagagcacagcacactgttttaagagtctgaactttatctttcaacaaagtttagctgctttccttttgcaaatgcatttaattttatctggaaactttttgacgttagaaatagaacaactgtagtttctcattatgtttgctgccagaatc

SEQ ID NO: 76573 - DNA, 601 bp, Human
agtgtgcgctctcaggaaggaacaaaggttctgagtgagaaggagagtccaaattctgatataaggaaagacacagagtttaaaaataacccaataatcaggaagcagggaagatacgcaggatgccatctcccgataagtcaagcaagcactgctcaggcaggttggggtctgagcgagcaatcagtttttaagacttcctctagtggaggtagaactgaagacctatgtttgcaagtggggcttgcataacctggattttaaaagcaagagtgttagctcccccagcttagtgggtaawgcaagctgggtcaaggtcattgaacaagcgttagttagcatctcctcctctgaggtgtcgcttccttggactactttatccagtgtaactaatccctgtttttctcagttgcagaatcttagtcttttctggttttgcagcacacattaaaaatgtgtaattggcatttgctttagttgtacccttgctcagtgcttgcaacctccttgagactgtaaactccaggaggacaggttccgagggtagtttgttcgccaatgaaccctgagcacccaacaaaacccagcatcatgcctgatg

SEQ ID NO: 76574 - DNA, 601 bp, Human
atttgagagtgaaaatctaggcttgaatacgactttttttttaaggtacacagttcatctcccacctacatttctattcttgttttcagaacaatagctggaacattttgctaagtgtgtggaagggaagagtgacagcaggaaaggaggggagcttcattctatcagtattatcaggaaattgatttaatatgcttccaagtctctttaaatagagcttcaagtttgaaagggactgaagatatggcttagaggaatccaaaacagatgccaagaaagaagtgcccatgtcccacgcccrccaagacccctctcatcaggaagggatacctagcacatcacatcagaagacatggcatctaatgacaagcgctttgggtatctacccctcagcaccacgtttcagaagtagtcaagaggtcatttttccaaagtattagggcaagctcattttttgttttccctgttcccaagaagtttaatgctaatcaaagcagaatgcctaatcagtccaagatgttctgtcaacttgaattatctatttgtcttcttatttactgtatctgtctgtctacagttcttcatatctttgtaaagatcg

SEQ ID NO: 76575 - DNA, 601 bp, Human
tagtctggatggctgcaattgttcctgagattctgaatctacccggcaaggattcacccaatcaaaggagccattgatcagaatcttcagcaattataatttgagaaatcatattcgaattattttttaatggaagaaagaatatttgagagtgaaaatctaggcttgaatacgactttttttttaaggtacacagttcatctcccacctacatttctattcttgttttcagaacaatagctggaacattttgctaagtgtgtggaagggaagagtgacagcaggaaaggaggggagcttyattctatcagtattatcaggaaattgatttaatatgcttccaagtctctttaaatagagcttcaagtttgaaagggactgaagatatggcttagaggaatccaaaacagatgccaagaaagaagtgcccatgtcccacgcccgccaagacccctctcatcaggaagggatacctagcacatcacatcagaagacatggcatctaatgacaagcgctttgggtatctacccctcagcaccacgtttcagaagtagtcaagaggtcatttttccaaagtattagggcaagctcattttttgt

SEQ ID NO: 76576 - DNA, 601 bp, Human
tcactctgtagactcaacatacttgcataggccccagcagacctccagcatctgttagtcacacagggactggaaggagctacaggttagaaggctggcggatcacctgcggtcaggagttcgagaccagcctgaccaacatagagaaaccccgtctctactaaaaatacaaaattagctgggcatggtggcgtacgcctgtaatcccagctactcgaggggctgaggcaggagaattgcttgaatctgggaggtggaggttgtggtgagccaagattgcgccattgcactccagcctggkcaacaagagcaaaactccatctcaaaaaaaaaaaaaaagaaaaggaaaaaagtaaaaagaaggcatgatacgaggcatgacaggccacagcaggacctttgtggggtctggaaaggagtggacctcaggatcacatcagcggattcccaaccctcccaaatctttctgcacccctcttttactgggtctgtaagcttttaggtgaacaaggcaatctgctattacctatgctctccactgttcaatgggtatgttcaacaacgtgaattatcaaatgcttttgggaggcttccctctaat

SEQ ID NO: 76577 - DNA, 601 bp, Human
ctttcctttctttccttccttcctctctggaaggggaattctgcagctttcttcagtaagcaattccacagttgctgaaccctcacaaactgcactgattcctcctatgcctccctccccaacaccctcacccctctgcatcttattcatcccattactttgggcttggtggcctttggccattttaaaataagcaagtcttcccttgacctgaatctcccaatgctagatggttctctgctcttacagagaaatcagggagctgaatggcactttccttttttcagatcaaagcagattygcccgatttcatttttaatgctgcttctgtacaagcagagactgagagaagactaaggcaggcaaaggtcagcctcactcttcagggatgaaggtggaatagagggagaatgagtccaagcaaagaaatggctctgaattttgcccaggagagggttttgatttacaaagcgagccccacctccctccctaacacccctggtgaatcatgtatcatggtccttgagcacatactgttgggactgaccctcccataatgacaaccaacttgacatatctttgccttgttctccagccacac

SEQ ID NO: 76578 - DNA, 601 bp, Human
tggggaattgctcctccccaaattaaatacagtctcccaattatatacagtcttgggacctttagtgaaggttttctgcccaagtgaggccaatgggtactcttaaatcttggatgggctgatgctaatcacagtgggagttgattcaacctgatgacaaaaccctgtaatgactactcccgagtttccacttcctcagtgtcagagctgcatctctggttcttttctgtcctttctgggatcttgctcttcagtttttcattggaatctctaaggtaccctaacctttaaaaaaaaaaaacaaaaaacttttcttcttaagtcagcaaaaaaataagtttctgttgcctgcaaccagagaatcctaactggtagacttgtttacctttactttggtttctcacctaattctcactgttacctagtatgcaagtattaccaccatttaggtttctttctctctcctttcctttctttccttccttcctctctggaaggggaattctgcagctttcttcagtaagcaattccacagttgctgaaccctcacaaactgcactgattcctcctatgcctccctccccaacaccctcacccctct

SEQ ID NO: 76579 - DNA, 601 bp, Human
caaccccaaaccctgactatcaccatttcctgttaaaataatttttttaaaaaaaaggaggttcagcaataagataatttcctatccatggacacatctagtactttgctaatcacaaaggaaggaaatgcattctccctcctagtgaggaagtgaataaagtaatcttcttctccagctgtcaatggagctgttctggatgtggcaggctgtgctgctgtttccctaaatggggcagaagtctgagcaaatagatcccaacagtgcagcaaaggcacctctaaagcagagccccaaggtyagaggacagacaactggcagccccagtggggaataccgggatgtcccacctgggccaaaactttgcatcttatcgcatgcagacagtcagaacctcagctaccctagagggatctgtgtctacacctccaccatcccaaatcacagttagacctccataattagaccgtggtgagaaatgatcacacatattttgtagcttgtagcctacatggagcctcagtccaagtctttaaattctgagaaactcagtgccggggacattggtagattttgcctgtcctgcatacaccctctcttc

SEQ ID NO: 76580 - DNA, 601 bp, Human
ggatctgtaaacaaatatttcttgggcaaaggtaacataaaatagatataagctgacaggtcatggcttagaataaaagatccacctcagaaacacaaggaagcatcttcaatgccaaaatagtatccaacggcactttctggagaggaattattcatccagtgtgagcaagtagtgcctggtgctgggtcagggctccataaatatgggctggtttaactgaaaagggcagtgcggtgggtcacggcattggaggggtaagaatgacttcatgagaagaagtttgatgattatgaacacyattgagggtcaccataaattcgccagttgcttatttcatgtgcatatcttcactaaatatacatgggtgtgcttctcctgccatttaagcatcgctgcctccagaatgaaatcccacaaattcttctcaatccttctactctcttctcagtgatgggccaggaaagcctgcatgcccaagttgagccagaacttcagtttcagagctcaattccacaggtacacaggacaacctaggggaagtgacttaaggcagaaggcagaagaggacaggagggcagtgactgaggcatcaagagag

SEQ ID NO: 76581 - DNA, 601 bp, Human
tatagactgttattgttacggtggtgcacttagcaatcaggcacgcagcggccaccaaggtgagggaagagtgtcaatgagctacttcagaagagatgtcttaacatgatcactttgctctcctgctaggttgatgaaggtcccttagccacccacccaaattttatgcccaaagcccatatgactaaccccctcattagtatatggtgagtagtatgaggctaagacagtgtgacacacagtgtatcagaatacacaatatagattgaacatttggatgatatgcattttatcatatatyttaaaatgtttcttgtggcacatgtacatttacatggacaaaatacttcaaataaatttgcacgttctgaataagatttcagactttgaatttgccaaatatgtttgaagtgaatgagaaacagaattcccctactgacctaacttccttgcaactgacaatagggctactttgccattctaacatcctctgcacatagacttccaagattaggagcaaagccaacatgaatccaatgcgtgggtatctccacaggacagatacgtggctgaggctgttctcatcacttagatgtgaaag

SEQ ID NO: 76582 - DNA, 601 bp, Human
aagggatcatggcttacccaactctggccccatccccagtgccattccccaagacctccactcttacagacattcagggagtccctcgcagggtgtgtggttgggcagagggtctgacagcagtaggaagctcttacttgtgaagaaaaacgatctccacattgacgtcatcccggtccttgtgcagaaagtccttcaggaagttggaaacactctccagagtgatgtgtccgcagaccacaatgtgcctgaacaggagaggccagttagatcaggccaggcaccacggacaggaccctgsatcccaccccctggcaagacagcagaagccaggcagctgcaggggaagcattcatctcctccctccgcctccataaaagcccagctcccatccccagagggcagtgaggcaaagcagcggtgctagcaggtgctgagactcctagacagaaaagccatatggcttctcacctgatgctgcacaaaatcctattaaaagcccaactgtttggccaagtggttttatgcatttaacaataagtgacattatgcttgtgcttaaatgctgcattatcaagtcccttgcagattcatatctctc

SEQ ID NO: 76583 - DNA, 601 bp, Human
gccacattggccaggctggtcttgaactcctggcctcaagtgagccacccaccttgccctcccaaagtgctgggattacaggcatgagccaccatgcctggccatgatgagcattaattcatttaaatctcaaaacaaccctataggcaggtatgttattaacccagagcttcaagaggttaattaactgggccatctactataagtatgacattgatggatgttagggatacaaaggtgaatcctagcaatggaagcatgagcagccagtttttgttttgttttgttttgttttgtttttttttttggagacagggactggagtgcagtggtgccatcttgactcactgcaacctctgcctctcaggatcaagtcatcctcccaccacagcctccagagtagcgagggctacaggcacgtgcccctatgcctggctaatctttctatttttgtatagatggggtctcactgtgttgcccaagctggtcttgaactcctgagctcaagtgatcttcccaccttggcctcccaaagtgctgggattacaagcatgagcaaccacaccttaccagcttgtttattcaaactaaagcagtggat

SEQ ID NO: 76584 - DNA, 601 bp, Human
taaaatgtcgtttgaacagagcttcaagctccaggttgggggagatgctacacagggagagaagaaatcgctattaatttaatggactcgggggtttcagcctccatgggctccttcctctctaatttccacagggagccctggggagaggctgtgacctacagtcacccttttgcttgccataaataaaagactcacactcaagagaagtaaaaccccagcccaactgaaaaccaaaccagtaccatggtaaaagaaagaggttcatgggctttaggaaggccaagacctcaggacaaaygtcttctcttcggtatgaatggaattcctatcttataaatatggaagctgggctgcgccactagtgggatggttcattttatgcggactgtgccagagggtgcccagatccagtgtgatttctgggtgtgtctgggagagtctctggatgagaatggcatttgaatcagtgaattcagtagactaccctcctttgtgggagtgggcatcatccagtcctttgagggtctgaagagaacaataaaacagaggacagaggcgtttgtcccttttgcttctttcctgccggcttgaactgggc

SEQ ID NO: 76585 - DNA, 601 bp, Human
ctgcacccaccccaggcctcacgtgtcctccccacatcaattatggtgctaaagggaggggcagagcgcagatgaatggaaacacgtgggttccagtcacagctattgtactaatgaactgcgcgacctttaggaaaaccctgggctctctgttcctgtttcctcatctggacactgggagcaacagtacctgctttatttacttcacaggcttggtatgagcagcaaatgggagaccagatgtgaaaatgctttgaaatcattaaaagttctctccacgtgtaagttatggtttttgtcmttaccaagtctgtcagaagtgacattgtacatttccttctgtgacaaggaaggctaaagaatggaattccacagaaaggcccacctcctaagcctaatcagaaatgcaagtgcatttattatgaccacccccacaaacttcccacccagcagcgctccccacttcaccccttttagtgcagaaatggagagaaggcagccagggagcagctttatctgaaaagctgcaacgtacgaatttaggaaatggatcacgctaaagcctctcccagcacaaattcaccctgcgtttttgcacttg

SEQ ID NO: 76586 - DNA, 601 bp, Human
gcaggacttgattccagaggcagggctcagataccagacaaaattgaagactagctgaaacagggatggggcagaagcaacttttcactggacaagcccagcagtgtgccctgtcagtttaccattgccatggcaacacccaggaggttccctataacctctaggccctagaacattactattactagatcataggggattgaaatgcttcatatttcaagcccgttgtccaattatgaaatcaactatctcttggaatatgttcatagtgacataactttacaggcacataccaggtccyttcctgaaagcaagttgtaatgcatggatgaattccagtcccagttccatctctcactacatacaatttggggaagccaccatgaggaacaaagaaggccatgaaagaggaaaccctttaatatgattgcctaagtgtctgggtggacagtgagaaagaaagctcaaagaacttgcttctatctgcactgggctcatgggacttgcctttctatggcaatgacccggtgacccagaagttactaccccttccctagaaatttttgcataagctgccccttaatctgcatgcaattaaaag

SEQ ID NO: 76587 - DNA, 601 bp, Human
gccttatgcatggtgtctgacaaaaagatcaattttactgtctccaaatggggtacccatgggactgaggtaggaggcaggacttgattccagaggcagggctcagataccagacaaaattgaagactagctgaaacagggatggggcagaagcaacttttcactggacaagcccagcagtgtgccctgtcagtttaccattgccatggcaacacccaggaggttccctataacctctaggccctagaacattactattactagatcataggggattgaaatgcttcatatttcaagcccrttgtccaattatgaaatcaactatctcttggaatatgttcatagtgacataactttacaggcacataccaggtcctttcctgaaagcaagttgtaatgcatggatgaattccagtcccagttccatctctcactacatacaatttggggaagccaccatgaggaacaaagaaggccatgaaagaggaaaccctttaatatgattgcctaagtgtctgggtggacagtgagaaagaaagctcaaagaacttgcttctatctgcactgggctcatgggacttgcctttctatggcaatgacc

SEQ ID NO: 76588 - DNA, 601 bp, Human
gtgtgtgtgtgtgtgtgtgtgtgtgagcctgtataatgaggaagaagaggctggacctgtggatgggtcttcagacctggagcgggctctcgcactcctaccttgttgtgatactgcagcatttgagtgatgattcttatcttcggatggtagttctttatggagattactctgaaaaagaaagaaccaatgctgagacaggtctgccttatgcatggtgtctgacaaaaagatcaattttactgtctccaaatggggtacccatgggactgaggtaggaggcaggacttgattccagagkcagggctcagataccagacaaaattgaagactagctgaaacagggatggggcagaagcaacttttcactggacaagcccagcagtgtgccctgtcagtttaccattgccatggcaacacccaggaggttccctataacctctaggccctagaacattactattactagatcataggggattgaaatgcttcatatttcaagcccgttgtccaattatgaaatcaactatctcttggaatatgttcatagtgacataactttacaggcacataccaggtcctttcctgaaagcaagttgta

SEQ ID NO: 76589 - DNA, 601 bp, Human
cccccactgtaagctataacacaaggaaaattcctttctctttaatctctggatagcttactattttcctgattcaactctgcaaattctcatctcgactctgggaatgtgtcccacattacactcttacagagcgcattatgcactcactagttcacctggtctcagatagagaaatcctatcactcacttgcctggagcattctacaccttaactgctaaatccccgaggacacaaaatagggcttctccttcactgatattcctgtgggtgtcagggagagtgctaatcacacagtaygtattcaataaatatttactgaataaataaatgactgcagcacatacaaataaaagttgttgtaacttaagtatggatgggatccaagagtaaatcaatagttctgaacctcgggttccaatagacacttcccgaatgaatgaatcagtacatgaaggagcatccttccagtgaccaaatgcaaacacgttgtttggactaaagaaatgggccagaggcgtggtggctcatgcctgtaatcccagcactttgggaggccgaggtgggcagatcacctgaggttgggagttcgagaccatc

SEQ ID NO: 76590 - DNA, 601 bp, Human
attactattactggatcataggggattgaaatgcttcatatttcaagcccgttgtccaattatgaaatcagctatctcttggaatatgttcatagtgacatgactttacaggcacataccaggtcctttcctgaaagcaaattgtaatgcatggagatctctaagcatctaggatgagtgcagcaaaaagtgccaagaaaggcagaaaaaaaatgttgaaagggaagaggaagaaaatgtattgaaagagtaggaaacatctcaggaaacacagcaaaactgtgaagcaaggtgaagaatktccatttgcaattctacaaggaatgaaagacaaacaatgatgagtggacgttttcttctttctctagaagagagatatgaaagaacaacaacaacaaaatgccctgtgtcaaagtcactctattccctgtgtcctgactaatcatccaaggatctgtaagtgattctgcccaaccccaaaactcgaatagtttgggatggttctaaacaaaatgtgttttaagcaaataatcatgaattggttgatatcttcctcactgtttctgaataattacaacacagaggtttgccaaacacattc

SEQ ID NO: 76591 - DNA, 601 bp, Human
tgttgatctaggggccacactttgagaaccactggcctaaaacatcaggtaaatcacagtgtcgacgtttccaatctcttgcaaatggactggtcctattcaacccttatgtcaggccctgagacaagaacccagaggcatgctcatccaattatttttaagtggcatgaagcagagagtcatagaaaatacattggatgaaagaatcaaagttcaaaaggttctccagagttggaaaaatcggcaaaagaccaaactaaaaagatttacaaggctttcatgtcaagtacagcatttaggytaaaaaaaatcaactatataaattcaaaatgagaagacctagcttggcagcaggcaggagagaaataaaagaaaacaaaacacacaaagctaaatttaagtgtgtgggtaactaaaacctcaaattttaggctagccatgtgacattacagagaaagccagtgtttactttttagaagtgctccccagatcaagggaaatgaacatttcattctgttgtgaattggtcagactagttccagagtacttgatccagttttcagtcagatttaaagagggaaaatgatcaactgaataactt

SEQ ID NO: 76592 - DNA, 601 bp, Human
cacccatccctcttattgcaacctaggccatttcctcaaaaccatcaaggaacttggcagtcaattaggtagccacatgacagcaaaaggcaggaggtctcatacctttgattgcagagcttccagcctcctttatggacctcgtgctgactcatgaactttctaaggatgtaatttcccaccttgccagctattaattctgctccttacatagtaagaggcaagatgtaagcccagatccagagctaactgcctcccatgccataacagaaaggctcaagctagacccgttttacacacrggtttgtcaccttgactgcctaatctaagaacagtctaaggatgaggactggagtgactgttatcccaggctccagaagcccccttgctagtggctgggcgatcaatgcaaggctctggaaacacaatcctaacctggcccaccctgggaggacagagtcggttttttttctctccttgcctgcactggtgcagcaggtatggccaccttggggactctggagtgtctgtccagccagctctgacaaggacatgaacacatccagaccgcctgtctctcggtgcaaagggcactgctgcc

SEQ ID NO: 76593 - DNA, 601 bp, Human
gattttttaaatcaaggtatcccttgctatcagtgttgctaaagtgattgaaggagctccaaagcaatttgttcctttatgtggagcaatgttaactatcagttggctacataatgccgatttggcaggtacgaaggataaggacttagaaaaactcctgctctaaataatatcactcataggtgcccaaggtgagcaccaatgcatctgtatcctcatgcttcccacccatccctcttattgcaacctaggccatttcctcaaaaccatcaaggaacttggcagtcaattaggtagccayatgacagcaaaaggcaggaggtctcatacctttgattgcagagcttccagcctcctttatggacctcgtgctgactcatgaactttctaaggatgtaatttcccaccttgccagctattaattctgctccttacatagtaagaggcaagatgtaagcccagatccagagctaactgcctcccatgccataacagaaaggctcaagctagacccgttttacacacgggtttgtcaccttgactgcctaatctaagaacagtctaaggatgaggactggagtgactgttatcccaggctcca

SEQ ID NO: 76594 - DNA, 601 bp, Human
cttcagggtctcgtctctaaacacagctacacagacctccctgccacctccattcagttccacccatgcaggatgagagcagcctggattaaagaagatacctaaaggaatgcaacatctttatttgtaagctggatctgagctcagagttctgctgagctgagacctttggctgcataatgagcataggaggattttttaaatcaaggtatcccttgctatcagtgttgctaaagtgattgaaggagctccaaagcaatttgttcctttatgtggagcaatgttaactatcagttggctrcataatgccgatttggcaggtacgaaggataaggacttagaaaaactcctgctctaaataatatcactcataggtgcccaaggtgagcaccaatgcatctgtatcctcatgcttcccacccatccctcttattgcaacctaggccatttcctcaaaaccatcaaggaacttggcagtcaattaggtagccacatgacagcaaaaggcaggaggtctcatacctttgattgcagagcttccagcctcctttatggacctcgtgctgactcatgaactttctaaggatgtaatttcccacct

SEQ ID NO: 76595 - DNA, 601 bp, Human
gtttctcttattttaacaggggttctgccgcaccaaaaaacagacacgaccggcctaggggaagggagagggtgagctaacactttaccttggcttccagaaatgctaattgttcccaaaggatcaagtgctgccaaagcctcaccccttctttgtccatcctaataggcctgcttgtccccatggaaatattgatgaattctccgtcataggatacggaggtcattggagaaggaagcaatttctgtaaacaataatccatttgtaggtttacttttccacctaccccccacccccaacraaagtaagtgagggctttgtgatccctggaatgggagataatacataaaacatgccaaggagggtgccattatggtgttcaccatgacctaaaggagacgaagatctgggatttggaggtaagtacacaaagatagcaatgtagaatggggagcatgtgaataaggcatctctattttagctgagaaaaatatatgaggggaaggcttgtgatttccaggtcatgtaccttagccaattccaacacaaagaccatctcagtgtcaaaaggtcatattcagagagctacttccaaacaggc

SEQ ID NO: 76596 - DNA, 601 bp, Human
gtggaagtggctcacacctatataatcccagcactttgggaggctgaggcaggaggattgcttgaacccaggagtttgagaccaacctagacaacacagggagactggtctctacaaaaaattaaaataaaattaaaaagcccagtggatagtcactgtgcttctgcctgtgccacatctttgctgttacagtcttgtttctcttattttaacaggggttctgccgcaccaaaaaacagacacgaccggcctaggggaagggagagggtgagctaacactttaccttggcttccagaaatsctaattgttcccaaaggatcaagtgctgccaaagcctcaccccttctttgtccatcctaataggcctgcttgtccccatggaaatattgatgaattctccgtcataggatacggaggtcattggagaaggaagcaatttctgtaaacaataatccatttgtaggtttacttttccacctaccccccacccccaacaaaagtaagtgagggctttgtgatccctggaatgggagataatacataaaacatgccaaggagggtgccattatggtgttcaccatgacctaaaggagacgaaga

SEQ ID NO: 76597 - DNA, 601 bp, Human
aaatgaacagcatgttccagggctggctgatgatgtgaatgcagataagtcacaggcaccaggatgttcgtgcgaactccttaaaggaactcaagggttcaaataagatcctattgcacaaaatgcttaacctgtccttaacagcagctgctgagctggaggatccctggattgccagcttgagtctctttcctaaaggtattagatataaaattagcataagatttgttaaatcctagcactgcagaagctgtagagggcatgccttgaagtttaaatggagtaaattaaggacaaatakccagaaaaaaaatatttagcagtagttagcaaagttaagaaattcattacccccaaagatatgggggtatataaaatataaaaaagattcctaaaaagtttagatcaattcagagatatatccacataggagtgaggttttcagggacaaagacttagggtcctaaggttggtatctttgagagtggcattgatggagagataaagaagcattgctccatatttcttggtacctccaggctgggcctcttttgtaattcctgtatgccagtagtccctctttctttttctttcttttttg

SEQ ID NO: 76598 - DNA, 601 bp, Human
ggcttcatctaacccactgaaggcctgaatagaataaaaaggaggagtaagggagaatttcctccctctgcctgatggtcagtcttaagctgggacatcagtctcctcctgccttcagatctagacttataccattgactttgctggttctcagattttcagactcagacagagactataccatcttctttcctgggtctccagtttatagagcttgggatttcccagccactataaccctgtgggccaattctttataatcaacatctctctctctctctctcacgcatgtgtgtgcacrcacacacagagagacaccattgctctgtttctgtagagaaccctaatatacttactttgtcccagaagcacctacctaagtcatccccagcccttcagctccacttggtttagactccaattagtttcacctcctcaaaacagcagtgtgtgtcaatcccttcttgggagcctagttcattccttaccctgactcagcccagcctagggtaactgttatgatgcagtggcctctgcttttgcagagctgggcagacagaaaggtaaagaagatgcacagaatggagctatgcaaacatgt

SEQ ID NO: 76599 - DNA, 601 bp, Human
acgcaaggttgagttctgcttctggtatgcctccttcaacctggttagcagagcttacacccaccagacaataagaattgcttgctgtgatgattaatgttaacttgactgggtcacagtgtacccagatatttggctaaacattattctgggtgtgtctttgagggtggagggtgtttctgcatgagattaacatttgaatttgtggagtgagtaaagcagattgctcccccaacaaccctcaacccaacccatgtgggtgggcttcatctaacccactgaaggcctgaatagaataaaraggaggagtaagggagaatttcctccctctgcctgatggtcagtcttaagctgggacatcagtctcctcctgccttcagatctagacttataccattgactttgctggttctcagattttcagactcagacagagactataccatcttctttcctgggtctccagtttatagagcttgggatttcccagccactataaccctgtgggccaattctttataatcaacatctctctctctctctctcacgcatgtgtgtgcacacacacacagagagacaccattgctctgtttctgtagag

SEQ ID NO: 76600 - DNA, 601 bp, Human
catgtaacaatcactaacagtggatggcactcaaaaaaccaaagtcaaaaagttggaagagtggggaggcagagtagacccagtctgtggatacccaggtggactcaggaatgcatgcaattaattaaaggccaattatctctgaaagagctcagactgatgcttggccagaggcttgttcaataagatggctcttatttcacatcagtgactatatcctgccagccgagaagggccagggtgagtgtcagcttctactggattttcgcattaagtcctgaccattgccgcttctcgggcyccatcctcgctgggcaccggactctgtgtatatgttatgtaatctttctgtgctgcctttctctttgttcagtccatgccaagacccatataaaagaatccatatgtgattacagctataaaaccaagaggaaaatattagatgaaaatataacattttggggtttctaagtttgctttacctttaatgctaggcagacagtttacacaaatcattttgctgcaaagtaaagaataatgagttaaatgtgttccctgtcaccatcaatcatgtacatttgcttttgattcaccaaacata

SEQ ID NO: 76601 - DNA, 601 bp, Human
tgctgtgcaaacgtaaagtattactataattccaaagttcttaacagaatacccacggtatcaaatcaatggtgcttccttgttttgcacccctagatgtgtagaatagttgcctcaaagttccaaattcctcatcattgttctggacacagattcacacttaaaatcaccttagggcaacgacaaccaatagacttaaggaaatctgatattttattccttatggcttacataggactttgcgattttcatgtaacaatcactaacagtggatggcactcaaaaaaccaaagtcaaaaakttggaagagtggggaggcagagtagacccagtctgtggatacccaggtggactcaggaatgcatgcaattaattaaaggccaattatctctgaaagagctcagactgatgcttggccagaggcttgttcaataagatggctcttatttcacatcagtgactatatcctgccagccgagaagggccagggtgagtgtcagcttctactggattttcgcattaagtcctgaccattgccgcttctcgggctccatcctcgctgggcaccggactctgtgtatatgttatgtaatctttctgt

SEQ ID NO: 76602 - DNA, 601 bp, Human
ccccaaccagccatgcaaccagaagtcatcttccgatttcctcctcccaaagagctatggtgatgggtcctgtggcttactattctacaactgaagaaaggtcagagacattaggttctttgcatttggcatgttttccatatgtatctggtttccttgtgtatctggtcaaataaagaatttaagtgaaaatgtatatctcagccaggcacggtggctcatgctgtaatcccagcactttgggaggctgaggtgggcacatcacttgaggtcaggagtttgagaccagcctgggcaacayggtgaaaccccgtctctactaaaaatacaaaaattagccgggtgtggtggctcgtgcctgcagtcccagctacttgggagactgaggcagcagaatcacttgaacctgggggctgcagcggctgggttgctgggggagaggtgggcggaggttgcagtgagccgagactgcaccaccgcactccagcctgggtgagacagcgaaatctccgtctcaaaaaaaaaaggtatatcacgtaaactgaaaagtgctgtgcaaacgtaaagtattactataattccaaagttcttaacagaatac

SEQ ID NO: 76603 - DNA, 601 bp, Human
aaatggagaagaattttgtcccaggattgatcacacccaaagtctcacccataactgattagatgatgacattgggacatgtgagttgctgatcttcagctctgattttggacttgaattgttttgcagggttgagacttttggggatgggggaatgaggtgaatgtattttgcatgtgggatgaatgtagatttttgcagaagtgattaacgatcttgtgataggaaggttatctaagtgggctctaaatgtaatctctattgtctttttagaggaggtttggctaaagaagaagaaatrggagatgtgacaatggaagcacaatgttggagtgatgcgatgacagggacaagagccaaggaatgtggtcagcctccagaagctagaaaatgcaaggaaacagattctcctctagagcccccagaaggaaccagccccgccaccatgttgactctaactccactgaaactcagtttccaagttttggcctccagaaaaggaaggaaaaaaacttgtgatatttacagcaactaggtttgtagtaatttattgcagtagccataggaaactaatacatagagtttcatttatcttgggtag

SEQ ID NO: 76604 - DNA, 601 bp, Human
agaaacataatgtatatttctacataccaccaatgaacaattggaacccaatttttttaagatgtcatttataatagctccaaaaatgtaaaacttacatataaatctaacaaaacatgtacagaatcttgatgctgaaaactataaaacactgggtaaaacaagttaaagatgacctaaataaatgaagagaccaaattgatggactggaagatacgacatagtaaagatgtcagtgctcccccaaattggtctataggtttaatacaattccaatcaaaacacaggaggaattttttttaggtataggcaagctgattttaaagtatatatggaaagacaaggacactagaatagccaaagcaattttgaaaaagaatacatttggaggactcaaactttgtaatgcccattttaagcaacagaagattgttcctagaccttgaagctcaatggagtttgccatattggaatctgaagttgtttggttccggtacctcctttcatccttccatattctcccttttggaatggcactgtctatagccattatcctatggctgtcctgccattgcatttggggtgcagagtacttgttttc

SEQ ID NO: 76605 - DNA, 601 bp, Human
cttaaccataatggaatcagactacaaatcaataatagaaagataagaggaatatcttcaaatacttggaaattaggcaacacacttctaaataattcatggatcaaagaagtttcatgtgaaattagaaaatattgttaactgaacaaaaatgaaaacacaacatatcaaaatttgtggaatgcagctaaagcagggaccaggaagaaatatatagcacaaaatgtttacaccaaaaaagaagagtctcaaatccaaaatctaagcttcatcttaagaagaaactagagaagaggagcamagtaaatctaaagcaagcagaaaggaaacaaacaaacaaaaaatacaggaaataataaaaccaaagccgattatttaacaaagatcagcaaactttatatctagtaagagtgacaaataagagagaagacacaaataacaaaatcaagaatgaaagagtggttatcactgcccacattaaaaggacaataatgggatactatgaataactctacatacataaattgaaaaactcagataaattagaccaatttttcaaaaactttgaattgtcacaactcacccaagattaactatttaa

SEQ ID NO: 76606 - DNA, 601 bp, Human
aaaaaggaagaccccagggaacctgaaaatattgcagagatcacatagaaagaggacatggggaagtagtcactaaattgtttataaactctggggctcacgctaagctgtgcatggatgaaactgaccctacacagcacatttagattctaagaactaaactacaatatagaccaccacccagtctgagggcaatattggacagatccaaatagcactgccaacgctttgaaaactcaactaacattgaagtcacaacccatagaagccccataagaacctgtagcctaaaatcaagccratcaggccgggcgcagtgcctcgtgtctgtaattccagtatttgggaagccaaggcgagtggatcacctgaagccaagagttcaagaccagcctggccaacatggcaaaaccctgtttctactaaaaatacaaaaattagccaggcgtggtggtgggcacctgtaatcccagctacttgggaggctgaggcaggaaaattgcttgaacccagaaggcagaagttgtagtgagctgagattgcaccactgcactccagcttgggtgacagagtgagactccatctcaaataataataataa

SEQ ID NO: 76607 - DNA, 601 bp, Human
agtattcaaagtaatctcaaactttctgcctcctgagaagagttctgggaagcacacttttctatttcttgttgcatttctagaatgttttaccactcattgtagttcagcatccccagaaaactgacaggcaggccatcaccctgcagttggtataagatggaaagagggagaggacttgctatgatcctgtttgggcaaagagacccctccctgtccccatgctcacctgtcccatgagcaagttcaagtcaataatacatgtctatccactgaggtaactcattgcagcacacagctsttctccttgcagtcaacaccagtgcagagctctccctgggcaaagctgcacttgctggatgggttttcattaacatatgggaaagaatagtcagcaaatcttcactgttgcagaggactgggaaaaaccagacagatgcacctagttctcacctatccatgcagacaaaatcatctagccttagggagtggagggtgaattgccagagacgctgaaggggttgggaaaaccagtgtcatttaggttgatgaacaatgctgctgccctaaaaaatgtattcagtcagaaaattctgctgac

SEQ ID NO: 76608 - DNA, 601 bp, Human
cgctcgccaacccagtcctgttttagtgacagcagattctgggtacttatgtctcctatcgccatacaatatggcctaataaagtcgcgccaaagagactagatttcatttcagagcaaagggttcagtcgtaaactttagctttctggctgaacagagccattccagccgcaagcataaattctgctagttttaggtatcagagtgattgggaagccaaatgggttatttgtgagcctggtagcaaaggcagaagcgccagctttattgtgtattcattgttatctggacaatctcttgycagttagagaatattttcacaggaagttagaagcgatttcagaaattcccctctgcagtttctcagagtggattttaggcctcatcaaaaagacatttggttcagagattgaaagtgggcagcctataaattgctgaggtatttagctgggcttagcagttttcctttgaggaggaaaccatgatcctgagtgctcactgagtacagcagggaagtgcctaagttcacgcagcctctggcttcaaaaaatcccagccttatcatgtgctcctgagccaaggagcataacctctccaagcc

SEQ ID NO: 76609 - DNA, 601 bp, Human
gtaatagctgaatctccattggaatgtgggttgtgtagatacagaagcaatatcatgactatattgaattcaattaaaaataaagtttcagaaaatggccctgatttgcatccctaatttctattcaactttcccattttaggacacagtattgagtgtgaggacgaaaacgctcgccaacccagtcctgttttagtgacagcagattctgggtacttatgtctcctatcgccatacaatatggcctaataaagtcgcgccaaagagactagatttcatttcagagcaaagggttcagtcrtaaactttagctttctggctgaacagagccattccagccgcaagcataaattctgctagttttaggtatcagagtgattgggaagccaaatgggttatttgtgagcctggtagcaaaggcagaagcgccagctttattgtgtattcattgttatctggacaatctcttgtcagttagagaatattttcacaggaagttagaagcgatttcagaaattcccctctgcagtttctcagagtggattttaggcctcatcaaaaagacatttggttcagagattgaaagtgggcagcctataaa

SEQ ID NO: 76610 - DNA, 601 bp, Human
atatattgccaccaatctaactggagttattcctactagctagaagtcctgcctgcattcctctgggagaggaagccccgtccctccccatctcatgcctattctatcttccccatgtgactcagccctccttgtcttctccttgtcttcattttttggattccaaagtaaagtcaaacaacaattcaacaggaagtagactgagcccagggaaggtgatatttggcaagttcattattcctaaattctaaaattgaggccaaaacaacttgatcttttctaaaaaaaaaaaataaaaaamcaaaaaaacaaaaaaaaaactgggagaagaggaagggagttagaaagaacatttgaatccacataggaatggggagcttgcttttgataacacaaaaaactagagagttgcctgtgcctttgaaggatctttactattttagacagtttggtgagaatcccaccagccactgctgttagcaaatgacaaggtctcaccagtggatgtgtctgagggcttacttagtaaaagtcctttgaaatatggagtccagtgctatctatactttgatatgcacgtatgtcacccaagggtcttggc

SEQ ID NO: 76611 - DNA, 601 bp, Human
aactctcaagaactgatatattgccaccaatctaactggagttattcctactagctagaagtcctgcctgcattcctctgggagaggaagccccgtccctccccatctcatgcctattctatcttccccatgtgactcagccctccttgtcttctccttgtcttcattttttggattccaaagtaaagtcaaacaacaattcaacaggaagtagactgagcccagggaaggtgatatttggcaagttcattattcctaaattctaaaattgaggccaaaacaacttgatcttttctaaaataaaaaaataaaaaaacaaaaaaacaaaaaaaaaactgggagaagaggaagggagttagaaagaacatttgaatccacataggaatggggagcttgcttttgataacacaaaaaactagagagttgcctgtgcctttgaaggatctttactattttagacagtttggtgagaatcccaccagccactgctgttagcaaatgacaaggtctcaccagtggatgtgtctgagggcttacttagtaaaagtcctttgaaatatggagtccagtgctatctatactttgatatgcacgtatgtca

SEQ ID NO: 76612 - DNA, 601 bp, Human
tgagattacagacgtgagccaccgcgcccggccagaacatgatatttagtcacagaatcctttatttcaaggagcagcttaagaagatgggaaatgctaatctaaaaacttcctctcctgacttcccaccctgaaatctctgtttcccttgacgcttctatcacaaatatgtctctctatgacctttttcagttgtcaaaatccagtgcttcctgtaactttcaagtcataaactacctcctctctgaggcctttcctcatttcaccaatgtgctgtgctgtccctgccttaatgggaatrgtaactgcacacatctctcaggaggccatgtgggctgaatgagatgatcagtacagaatgtctagaacagtacctggtacttagtaagtgctccatgtgtggtgattagcattaagtaccatcacagcatttgacttctctgacatctgaagagaactacaatgaggtggaattccatttccgtatcgactgtaagctccttaaaggaagagctgtcttactcagctctgtatcttctagaaggagcagcacagtactttgcaaataagaggtgctgggttaatatctgctgagttgaac

SEQ ID NO: 76613 - DNA, 601 bp, Human
ttgtttttttgagatggagtctcgctctgtcacccaggctggagtgcagtggtgcaatcttggctcactgcaagctccccctcgcgggttcatgccattctcccacctcagcctcctgactagctgggactacaagcgcctgccaccacgcccggttaattttgtttttgtatttttagtagagatggggtttcactgtgttagccaagatggtctcgatctcctgacctggagatccacccgcctcggcctcccaaagtgctgagattacagacgtgagccaccgcgcccggccagaacrtgatatttagtcacagaatcctttatttcaaggagcagcttaagaagatgggaaatgctaatctaaaaacttcctctcctgacttcccaccctgaaatctctgtttcccttgacgcttctatcacaaatatgtctctctatgacctttttcagttgtcaaaatccagtgcttcctgtaactttcaagtcataaactacctcctctctgaggcctttcctcatttcaccaatgtgctgtgctgtccctgccttaatgggaatagtaactgcacacatctctcaggaggccatgtgggctga

SEQ ID NO: 76614 - DNA, 601 bp, Human
ataaataaataagaattacaaaaaaatgaaaagacaaatccaatgcaaggtacaaatccaaaatttttatcatagattcacaatccatataaaattaatccatccaattgctttgaaagtttctaagcacttactctcatcttctgtacttaactcgtcacggatgagtatcaaacagctcacagtccccatctatggaccatggaccacacttggaattgtgctggtccacaacatggcaccactctgtcttaaaaatctgacttcccataatttcccctgcttcagaaaagcagaattrttctcaactaatacttcacagaaagaacttgacaaaacttaatagcaggtgttatctgaaacaaaggagaatggggaggggattctgtggtggcccctactagaatgtgggaaatgttgaaggcacagatttttacctgaatctccactgcctggaactgtgcgtggtacatagtcatagctcaataatagtttctgaatgaatgaaataaacttgggaagcacagaatttaacaaagccaacttgttttatttaattttattattttactttcagcacaatactccttagagtatttaa

SEQ ID NO: 76615 - DNA, 601 bp, Human
caatttggcattccacaattatggcctctttcagagagcattttccagaatgtgtgactaggacaaaaagatctcagatttttccaaaggcttcaggacaatgtcaattaaaacaattttggggggatttgatggaatgccagaaaactggttgcttcagccatgaacaaataaataaacaactccaaatattaatttcggaatggacttgagccaaatctcttactcccagaccagtgggctgcagactatcaaatgagatttcttccatcaggcattatgaaaaagaatcaacccacaygaggtgttcagagggcgattaaaagactacaccacatgtaaaagtaccagaatacatggtattttccctcactccattatcccaaccaggtttatttctggaaagacagagtgccagaggaactgaaggtaaaggaagggtaaacagcaagagtgatatgagaactttttaaaataataattgagaaattattttttaaagtgttacatatgtggcaggaaactggtctttttttttttttttttaacacatagaaggttttgccaccctatcctcaattttctctccaatatagaaaag

SEQ ID NO: 76616 - DNA, 601 bp, Human
ttctctgtgccaaactgcatctcagcgctgaacttcttggatgtggactcagttcagctgcctttctgaaagttgcttggatttcagggactccataacaatttggcattccacaattatggcctctttcagagagcattttccagaatgtgtgactaggacaaaaagatctcagatttttccaaaggcttcaggacaatgtcaattaaaacaattttggggggatttgatggaatgccagaaaactggttgcttcagccatgaacaaataaataaacaactccaaatattaatttcggartggacttgagccaaatctcttactcccagaccagtgggctgcagactatcaaatgagatttcttccatcaggcattatgaaaaagaatcaacccacacgaggtgttcagagggcgattaaaagactacaccacatgtaaaagtaccagaatacatggtattttccctcactccattatcccaaccaggtttatttctggaaagacagagtgccagaggaactgaaggtaaaggaagggtaaacagcaagagtgatatgagaactttttaaaataataattgagaaattattttttaaagt

SEQ ID NO: 76617 - DNA, 601 bp, Human
tttcttgctgaaaagtacgatgttaaggccagcaaggtattaagaagacttcatcatgggacttgtcagattctctcctcctctatttccctctatgttccaatgtcaacaaacttgccccagtttttatcaaagggcatgtggttatctccttctctaccccttcttagcctcttcgttcttcagtataattgcaaatcctaaaagcaattcatagaataaacaaaatgaaatgtttgagtcttgttagctgaggtccaaatggtgccagcacagagaatgcctcactgcacagctttcyggggtggagttaactagtgatcaagttgaagccaaaggaagaaagcagaagagaatagtgatttgcaccttttcagaatgtatttcttctctgtgccaaactgcatctcagcgctgaacttcttggatgtggactcagttcagctgcctttctgaaagttgcttggatttcagggactccataacaatttggcattccacaattatggcctctttcagagagcattttccagaatgtgtgactaggacaaaaagatctcagatttttccaaaggcttcaggacaatgtcaattaaaacaa

SEQ ID NO: 76618 - DNA, 601 bp, Human
aaacaggtagtagaaggttagtgtattcacaagaacttactacatttactatttttaaaaagtctatctgaattttcagtaaatattcttcctataaaggatccacagttttaaatcttagaagtgcttaataagaattagagacatttgaatgaatatttatatatatcaattatgcaatacattgtcactgtcctttataataagattgtctgaaacagaatgcagtcatatgaactgactggcatatcttagatgccattaaaacgtatttatcatgaccccacaccccccaagaaarccccacaaaatgtgtcaagtccttgcctacaatactaaacatgaaatcagaattgatgggctctaagttgatgaatgtttgggctggttactaaaatggatggggggtcatttgtatccattcctcaacagcatgctctgtcaaggggaaaagtttaattgaatcttgcgttttctcatttcttgctgaaaagtacgatgttaaggccagcaaggtattaagaagacttcatcatgggacttgtcagattctctcctcctctatttccctctatgttccaatgtcaacaaacttgcccca

SEQ ID NO: 76619 - DNA, 601 bp, Human
atggtttctattatacaaaatggaaacttcctagcctacaacttctttcctaaaatagtacatgctgttccccacatttgtgttgtcaatgtatttttaactgtaatgtgaagacacacttctcagcagaaaaaaatgaaggaatgggaccaaaatgacttagggaaaggtgccagaattaatttgccagccattcagcaatcagtcaaaggcagagcatttcctgaggcagcaatttatcctttggctgtcacatcaaaccccagctgttttagaagagcgcctagcaaagatgagcagrtgatgctctgtgggtccttattcatcaaatacacacgggatcatcagtgagaacaggggactgagccaatgaactagcttgcctacacctctcatttactgtcttatttatctactcttcattatctaatttttcatccagtctagttgaacctcccaagcaaatggtttcacaccaatccacgggcagacagctcccccatcaaatgtaccttccaactggaaacctcagccttggctccacgggaagtcacaccttcctgatcccaggttctgtgtgtgtcactaatggtgggttggt

SEQ ID NO: 76620 - DNA, 601 bp, Human
gtaatcaacctcctgggcagcctcaacctcctgggctcaagcaatccttctaccccagcctctagagtagctaggaccatacgtgtgtgccaccacactcggctaattttccttattttttgtagagataaagtctcactgtgttgcccaggctagtcttgaatgcctagcctcaagtgatcctctcacctcagcttctaaaagtggtgggattgcagacatgaggattctaagtgaggaatctgaggcactgtcatgcctcacggcagacacctggagctcttgaggtcatcccccatargtgaccatctattctacctgcagtggccatggcgggtggctttgatccatcctgctgagccagtggaaagagaagctaagacttgttattattataacatggcagttgtctatgtgggggctcaaggcctccttctgtatatttggttccacatttcctcagcaaagggtgaaaacactttgaatggctttatttcagtagcttctctgttgtctctatgatcagacttgatgggaagacagattaaaattcctttcattgaggggctggcaagatttgttttgccctcttagaatcaga

SEQ ID NO: 76621 - DNA, 601 bp, Human
ctttgctaaggtgtcaggagaataggcttaatgtttcaccaacctcagggagtttgtgttttcagagggcacaaagaccccgttcatcttaaactcaacatctgagattttttattattattattttagagatacaatcactgctatccaggctggaatgcagttgcgtaatcaacctcctgggcagcctcaacctcctgggctcaagcaatccttctaccccagcctctagagtagctaggaccatacgtgtgtgccaccacactcggctaattttccttattttttgtagagataaagyctcactgtgttgcccaggctagtcttgaatgcctagcctcaagtgatcctctcacctcagcttctaaaagtggtgggattgcagacatgaggattctaagtgaggaatctgaggcactgtcatgcctcacggcagacacctggagctcttgaggtcatcccccataggtgaccatctattctacctgcagtggccatggcgggtggctttgatccatcctgctgagccagtggaaagagaagctaagacttgttattattataacatggcagttgtctatgtgggggctcaaggcctcct

SEQ ID NO: 76622 - DNA, 601 bp, Human
cccctcctttgtggtaaagcctgatcagttttgtttcgatgtcttcagacctctcttttggtttgtatgtaggcaggaagtgcaagcaaatggcttttcttcctcagcccagtgagctcccagatacccctgtttcttcccagtgagaagaatccttgtcaaatcctttgctaaggtgtcaggagaataggcttaatgtttcaccaacctcagggagtttgtgttttcagagggcacaaagaccccgttcatcttaaactcaacatctgagattttttattattattattttagagatacmatcactgctatccaggctggaatgcagttgcgtaatcaacctcctgggcagcctcaacctcctgggctcaagcaatccttctaccccagcctctagagtagctaggaccatacgtgtgtgccaccacactcggctaattttccttattttttgtagagataaagtctcactgtgttgcccaggctagtcttgaatgcctagcctcaagtgatcctctcacctcagcttctaaaagtggtgggattgcagacatgaggattctaagtgaggaatctgaggcactgtcatgcctcacggcag

SEQ ID NO: 76623 - DNA, 601 bp, Human
cttgttagatacaaacaccagttaggccagggaaaccctacagccaaggaagggggcttgacggagcccctgctgacaccctcaccaacataagactcccgcaggcgctggcagctctgctatgtgctcagaccaccaccacattagacagccaaggcttcaattgcctttttataaaactagcttctgttaaaaagcctgctttcccccggggctttgtatcctaggcagaccaagctccagggagggggagatcccctgggacagcctcagtgttccaggacccaatgcctctgaatgsttaactcctctcagtggcaggaagagaaatagctctcaaagaaaggcacacatgggagtcacaatagggcatccattttcagaaaataactccttccgaatcaattacctattcacttttccagtccatttagcattaaaactttcgcttagagacagggtgagaaatttcagtaaacagccaaaccattttggattgcttagggtctgggcccagggactgacagagtgcacctgctgtgttcagtgacaggaggctccaggtaaacacgaagccaccaagcgctccgcctccctccct

SEQ ID NO: 76624 - DNA, 601 bp, Human
ggcctggtttaagatatcagggaggagtaactacatgactatactaacccctttgctacatcaaactggagccagttagcattccgaggaaatgcaggtcttgcattgtcacattagattttctaaagaatccagaaatctagtttttacgtgacatactactatttggaaatatcagcaactagttgatacctacgtgagtcaaacatacctagtgactatcccagttagagcctgtagggggagcagtcctgacccttcaagttacccataagaggaacggactcagttcccaagagcrgagtaagagaagggtggaaaagcaagaagggcctgggggttggggagggagcactcttgttagatacaaacaccagttaggccagggaaaccctacagccaaggaagggggcttgacggagcccctgctgacaccctcaccaacataagactcccgcaggcgctggcagctctgctatgtgctcagaccaccaccacattagacagccaaggcttcaattgcctttttataaaactagcttctgttaaaaagcctgctttcccccggggctttgtatcctaggcagaccaagctccaggg

SEQ ID NO: 76625 - DNA, 601 bp, Human
ccagctcttgagctggctgaaggccagtgaagttccacaccacccagtgggtcagggttggcaaactcacacaaccacagggccaggcctgggatttatgtgcaaatctggcctggtttaagatatcagggaggagtaactacatgactatactaacccctttgctacatcaaactggagccagttagcattccgaggaaatgcaggtcttgcattgtcacattagattttctaaagaatccagaaatctagtttttacgtgacatactactatttggaaatatcagcaactagttgatayctacgtgagtcaaacatacctagtgactatcccagttagagcctgtagggggagcagtcctgacccttcaagttacccataagaggaacggactcagttcccaagagcagagtaagagaagggtggaaaagcaagaagggcctgggggttggggagggagcactcttgttagatacaaacaccagttaggccagggaaaccctacagccaaggaagggggcttgacggagcccctgctgacaccctcaccaacataagactcccgcaggcgctggcagctctgctatgtgctcagaccac

SEQ ID NO: 76626 - DNA, 601 bp, Human
ccaggtgcggtggctcacgcctgtaatcccagcactttgggaggccaaggtgggtggatcgcctgagctcaggagttcaagaccacccagggcaacatggtgaaaccccgtatctactaaaaatacaaaaaaattaaccggttgtggtggcacacgtctctagtcccagctacttgggaggctgaggcaggagaatctcttgagccccagaggacaaggttgccgtgagctaagatcacaccactgcactcgagcttgggctacagagtgagactccatctcaaaaaaaaaaaaaaaaaaagagagagatctgagcctctccataaattcacttaaaatgctcatttttgcagccaggctaaagaaatctatcatataacaattgggtctgcctggtttctgctccatgttcaaatttggatgtctttctccaaaaactaatgatttcacagaactgaagttaaactagctacagttttcactgggcaagaggcccagctttcgccgggcggtcttaaattttaaatttccccaagcggcttctttttaaagatctgtctgtgcaaaataacacaggttgagagcatgattttctgaattt

SEQ ID NO: 76627 - DNA, 601 bp, Human
gtgccacaacacagattttcagactcaagcccttcaagattggctgatcttgcccttcctatgcagataacaaactgagcccaaacagaggagagcaactaggtcaaggtcaattgacttttatgtaaaaagccaaaagtggaaatcgagtctttgacgcaatgtgctgcacagatgcttctcatcagaagagaggaaatgaagtggcagtcacaagcccaacaggcagacacattctgtttggtaagtacagtgttttttaaaaaactgtaaatagatgccaacaagtgaattcacataraaactggcttttcagctttccttgcaaaatcagatagggccacattggcaccacattccacatgctaaaagggagtgcagctgtgaagcacttatccctctggatgggatgtttgttctccaatgtgccacagttcccaccactctctattgtctcagatggcctcactcttcattctttcttgctaactgcctgaaccctataggtatctaagtttttaatccctactataataggtatcctctagatattgcaaaatacaaatcaagtataatacaccatgatttacactggaagcaa

SEQ ID NO: 76628 - DNA, 601 bp, Human
aatccataacttcaaaacattcaaatccatacccaagctgattctacaatgccttatagaagccccttttaaaaagtcctttgacccaaaacaagctgtggcccactggccaaaggaaaggagagggatagaatgatgtgaacagagagaacataggcaagccgtgccacaacacagattttcagactcaagcccttcaagattggctgatcttgcccttcctatgcagataacaaactgagcccaaacagaggagagcaactaggtcaaggtcaattgacttttatgtaaaaagccaaargtggaaatcgagtctttgacgcaatgtgctgcacagatgcttctcatcagaagagaggaaatgaagtggcagtcacaagcccaacaggcagacacattctgtttggtaagtacagtgttttttaaaaaactgtaaatagatgccaacaagtgaattcacatagaaactggcttttcagctttccttgcaaaatcagatagggccacattggcaccacattccacatgctaaaagggagtgcagctgtgaagcacttatccctctggatgggatgtttgttctccaatgtgccacagttcc

SEQ ID NO: 76629 - DNA, 601 bp, Human
tatctgggatctcctggtgatttgcaggttttctgattcctgccagcagaatctaatgacctgggctttgtgctgattatgcagcttgctgaaacaccaacacacatatccaactacagctggaaaatgccatccttaatttatgtcccaaagagcactgctaacatgcaccctttatgggactgttacttctggagcttaaattgtttttttaaaaaataagatagcttatgcaatgtttattgaaccaaattaccaaattaagtaaccactttctaatgtaaatagtagctaaatacawaaacatcagggagaaggctgatcttaaacttagtatggatcgtgcaaaggttaatttgctaatatcctatgagcaatgaccagtccactttgggactctggtagttcatgggatcaaagatcttcattgcttttataaacctaatcccgctggtaagaagggaagtaacagttcgtagtaatggtgaattatgtcttcctagctactacagtaccatctaccaactggatataaaaagaaaagagtttcctctacaagaaagtcctaaggtctatgtggccttgtattcattccttaacc

SEQ ID NO: 76630 - DNA, 601 bp, Human
taagactgcagctgagtgagcaaagtcaagcgtgacagtgattaggtcaggaaatgaggggggagcaagatcatgaggtctttgctttccagagcaaggagtctacagcttattataagtggaattgggggattttagttggtttaaaagagaaaagtgacataatcagatgtgctggatagggggatgtgttgctttcaaggaaagtgctgctgaaggcctcatgctctccagggagtgaaaccaattgctcattcctacatgtgaggttgtggtccacagcactgccttcagcagacastcagatgtcaaaggaccacttctatccaggcatatctgggatctcctggtgatttgcaggttttctgattcctgccagcagaatctaatgacctgggctttgtgctgattatgcagcttgctgaaacaccaacacacatatccaactacagctggaaaatgccatccttaatttatgtcccaaagagcactgctaacatgcaccctttatgggactgttacttctggagcttaaattgtttttttaaaaaataagatagcttatgcaatgtttattgaaccaaattaccaaattaagtaa

SEQ ID NO: 76631 - DNA, 601 bp, Human
tagtgcatagtgaatagacccaccgatacagagaagctaaacaaacaaatggtttccacttactgggtttcaagtctaagaaaataacaaaaggtgcagtaaaatgtttatgcttaaagattttcagagtaagtgttatttatatggagtagaaaaatagaaaacaacctaaatgtccaataataaggccataaagtacagtgcaatatggtactagcattctaaatggcttttcaaagaatatttcaagatataagatcaataaataatatcatataaaaagacatgaacatgtaaatasaacaaatatataaaaatacatgaatatgtaaatggcacaatacagttagatgaacctatacacttacatacttacagaataaaagctcacataaacaaaataattacatacatgatgtatgacaagtgtctacaattagcattaccattttgaataatagaatattgattaactgatagactgaacaatgagttgatgcttatttatttagctccagcattgtaagggggataagatactgggtcacagtgtggggaaggcttccttgtgggtcaatttaatcccctcaatatccctaag

SEQ ID NO: 76632 - DNA, 601 bp, Human
ctaccctgtgattttctattctcaaaactctcccagcaccttgtctgtaaccaaatcactgagcctttagtcaattttacactggctgtggtcgctccctattgtttcatgtgtctgaactttgtctccttaaccagagcaacttccttaagagtcctggacttgtttggaattctccatagtgcatagtgaatagacccaccgatacagagaagctaaacaaacaaatggtttccacttactgggtttcaagtctaagaaaataacaaaaggtgcagtaaaatgtttatgcttaaagatkttcagagtaagtgttatttatatggagtagaaaaatagaaaacaacctaaatgtccaataataaggccataaagtacagtgcaatatggtactagcattctaaatggcttttcaaagaatatttcaagatataagatcaataaataatatcatataaaaagacatgaacatgtaaatagaacaaatatataaaaatacatgaatatgtaaatggcacaatacagttagatgaacctatacacttacatacttacagaataaaagctcacataaacaaaataattacatacatgatgtatg

SEQ ID NO: 76633 - DNA, 601 bp, Human
cctgtactctgctcagttattaaggtgtttgttggaggggatctgcactctacatttgggcatctgcaggatcaaaaatatgaactatagaggaatagactgtgggtgtcatttcagagaacaaaagcttgagcatttctcaatgagctctctttcttccaaaactattgacaagaactggggagcaaaaaaatcatctctattttatctgtaaggtgtacagtactccatcagcaaaatttcttgttagcacgatgcttcccacctccagtgtgaactcacatattgactgggatgttayctatttcaaccagacccagtccctcatcagtctgatttgcacataattaagtgtaaaataaataaataaagagagctcctgcctctgagctccactctcctggctcatttacatgaagctgatattctgccacctggattttggttgcaccgggagaagcacatatggtacacaataggctgcttgtaatttggctatcaagagagttggtgtctcccctcacagctctaccccaaggctgctgtaaaggaggccagagtccacctgcttttttgctcacagcagtaaaaaggggtttta

SEQ ID NO: 76634 - DNA, 601 bp, Human
atagcttaacatttgatcagattgactttgtgagcaatctgatctggtagttaaggtaacagaaaacattggattgatctgtttacaatccagtgttttcttttcttttgttttgtcttgtcatagacacagactatacacttgaaagtctggctgtattgggttattcacccagataaggaaaactccttaaatgatgataaaaggaaacgtctagtcttcccctgtactctgctcagttattaaggtgtttgttggaggggatctgcactctacatttgggcatctgcaggatcaaaartatgaactatagaggaatagactgtgggtgtcatttcagagaacaaaagcttgagcatttctcaatgagctctctttcttccaaaactattgacaagaactggggagcaaaaaaatcatctctattttatctgtaaggtgtacagtactccatcagcaaaatttcttgttagcacgatgcttcccacctccagtgtgaactcacatattgactgggatgttatctatttcaaccagacccagtccctcatcagtctgatttgcacataattaagtgtaaaataaataaataaagagagct

SEQ ID NO: 76635 - DNA, 601 bp, Human
ggccaccaaatctaccatttttttcttccttttggttgatttgggttttcaaaatagcttaacatttgatcagattgactttgtgagcaatctgatctggtagttaaggtaacagaaaacattggattgatctgtttacaatccagtgttttcttttcttttgttttgtcttgtcatagacacagactatacacttgaaagtctggctgtattgggttattcacccagataaggaaaactccttaaatgatgataaaaggaaacgtctagtcttcccctgtactctgctcagttattaagktgtttgttggaggggatctgcactctacatttgggcatctgcaggatcaaaaatatgaactatagaggaatagactgtgggtgtcatttcagagaacaaaagcttgagcatttctcaatgagctctctttcttccaaaactattgacaagaactggggagcaaaaaaatcatctctattttatctgtaaggtgtacagtactccatcagcaaaatttcttgttagcacgatgcttcccacctccagtgtgaactcacatattgactgggatgttatctatttcaaccagacccagtccct

SEQ ID NO: 76636 - DNA, 601 bp, Human
aaacacactaggaaaaaaaagccatgagtctgtctcaataaacagtactaactctgtaaatcaagtgtgataatctggcaatttaatagcagtgttctaagactatactgagcactgcccaagaaataaaatattcaaaatgttatcaccaaaataaatgtaaggaaaaatagaagtgtaagggcttggtctctgttttgtggataaaaggacaggaattctgctctatagacaagaaactcgacacagggaggaggaggtcactgggaatgtggaagtggtatgtagacaaaatggcacyagagtgcaatggacatcaagacacgtcaggacaatacagaaacagacacaaagggctggagagaagcatcctcctgttcaactttaatagtatttgttcccattattggtgccatgactgaaaacaggagtgtgcctttcctttcttaggtttcctgcaaagaagttagtgcgtcatccaaaagaaccaacaaatcaaacaggaacagaaataggctacttccaatttatgtactctagttggagaggggtgttcacggtgcgcttctgctcgcgctcgtctgtggctcgctgtcgatgc

SEQ ID NO: 76637 - DNA, 601 bp, Human
tgccctcttattccctgtgaacaggggtgagggggtttaaatcatccccatgtggggtgtaaggcagaaccatttgcagatactaagctaaggctaaggcagccttctgggtgggaatctaaagaatggatccagtccttgaaataatgaaagaaagaaatctagatacataaagatgctcttggcgctgaagcaccagaaactacattactggtttttgtttttgtttttaatattttcgacattaagtcttctatacacattccaaatctagaaagtttaaataaaatgctaatccccrtcttcttcaaaatataaaaagacaaggattctggatagtgataaccttctcccccttttgcctactatctttagaattcgttattgaccttctaataggaacacataaatttttccaaggatctctgatctctttaggagagtatccaatgttaagtttgttttgttctactgactgccaaaagtctctctctctgtgcgccactctgaatcagttctctagctccaactttatataattcactagtttatcagagataaacttcaacatgtgtcatgtgaagaatcaggaaaatctcta

SEQ ID NO: 76638 - DNA, 601 bp, Human
caccctccactttgtccctgctgctaataaatgacccaggaggtgccctattggcattgaaagacttttccactgactgcaaggaaatccaaagcattttatccctgcacaatatctggtgatgggctaatttagactgacttttgtctgcacagtgaagtatcctgtgttccttaaatctatggctgattgtgtaaggaatcgaaagcatctctaattacctcacagatcatgtggattccaggatgccctcttattccctgtgaacaggggtgagggggtttaaatcatccccatgtgrggtgtaaggcagaaccatttgcagatactaagctaaggctaaggcagccttctgggtgggaatctaaagaatggatccagtccttgaaataatgaaagaaagaaatctagatacataaagatgctcttggcgctgaagcaccagaaactacattactggtttttgtttttgtttttaatattttcgacattaagtcttctatacacattccaaatctagaaagtttaaataaaatgctaatccccatcttcttcaaaatataaaaagacaaggattctggatagtgataaccttctcccc

SEQ ID NO: 76639 - DNA, 601 bp, Human
gagcactagataaggagccagttgtcttgttatgttgttctgaatcatcaggaatcaggatgacctcgagcagtcattcagctctctgagcccccattttctccctcacaaaataaatgagcaggtaactaggcttcctagttctaaaattttattattctcattcaaagatgtggaattcactacatgaactggagtccgtggaagtttttcttacaccagttgatggccatagacatgttaaggagttttggggttatggaagcctgcctacttccgtgggtcaaggtgtctacagccrggccagaaagaaagccagttgaaaataaactcttaccttttaacttctttggcatcacttgcgatgaaaaatcctaaagtaccttcttggatcttaagatggtttccaggattaattaatatactgctcagtgaacaaaaacaaacagagaagatacatttgtgaggtcatgttctgaataaaaccttgaaggctacaccatactgttgtgtttatagggggcccactagtctaaagctttccccaaagattttgtccagagtccaatgtccactgccccatacatttagttggataatg

SEQ ID NO: 76640 - DNA, 601 bp, Human
ctctcattctctacaatgcaggaagaatgaccttttcaaaatatacatcagatcagcttaaagccatcaatgacttccattttataacagatccaacctttctataaagtgctttaggagccagcctctgcctctctctaacctcatctcataccactctccccaaatctattccctagccgcactttccttcttggggtccctatccacaatgaacttcttcccagcccatctcttcttcctatctgatccctgcctgatggattatttcccttcatctcaatctctgctcaaataccawcccctctgagaagctttcacttatacccaacccaaatcagtgacccagttgcattaattcttttaccactaattattttttaaaaaactgtaattctttcctgcctagaatatgagccccacgagagttgggacttctccccattgttcatttttcaccactgtttccctggtgccttgtatagagccttctaaatgtaaacgacttatacacatttgatgggcgaatgaatgagtgagtttgagactgcttcccggtattgttgggtctgccaatttttcaggagaaatgagtaataag

SEQ ID NO: 76641 - DNA, 601 bp, Human
gtctgcagagagggaaaaacgaaagccacgagtcagtgggttcctctgtcaaaccccctctggagtttcacagcttattttactccaaagctgactggaccaattcccatgctatccagccctgagaacatgcactaaatgatggttttcttctcactatggagcaaagctcagctgaccactggaagggggtgagtagagcttattgaagcaataggtaggtagaaggagaatgagatgaagcactcaaaaagaaaatcccctaatctgacttgaatgtccataggtgattccacagtgyattagctgtgtcaaagatattctggataagaaaaataagatcattcaagcactatttgaaatcacagtgcctagaacagcacaagaggcctgtgccctttcagtactggggaggtgataaaattcactggaacaaccctacaaccttctggatccaagaactaacaaaatccctggcttgttgcctttaccactcccaacaggaaactgaatgccagctatgaacatggccttttcttgaccagggctgcagaaataaacacaattcttgaccatttgattcttaggttcctttttatgt

SEQ ID NO: 76642 - DNA, 601 bp, Human
ggtggggaagttaaatacaacaccaaaattcccacagtctggtcaaatatatatttgagggggcagaagtatgtcgtttctcagtcaaataaaaatatcaagcttgtcactctgaaagcaccttttctgggcagccaaagggagacagagttgaggaggtctgcagagagggaaaaacgaaagccacgagtcagtgggttcctctgtcaaaccccctctggagtttcacagcttattttactccaaagctgactggaccaattcccatgctatccagccctgagaacatgcactaaatgakggttttcttctcactatggagcaaagctcagctgaccactggaagggggtgagtagagcttattgaagcaataggtaggtagaaggagaatgagatgaagcactcaaaaagaaaatcccctaatctgacttgaatgtccataggtgattccacagtgcattagctgtgtcaaagatattctggataagaaaaataagatcattcaagcactatttgaaatcacagtgcctagaacagcacaagaggcctgtgccctttcagtactggggaggtgataaaattcactggaacaaccctaca

SEQ ID NO: 76643 - DNA, 601 bp, Human
tttagagtctgggggaagaaatgtaaatcattagacaaggtttgttatatagaaaaagaaaatgagtaaatagtagaccctgagaacttgctcctcggccagacagctgaatttgactcttttccttgatagagagctatgaagaaatggaaagaaatgcaaacgttaaactatactatcacaggatttccagaaatggaatgtccgcacctgatatttctccggatgagatgacgtgaaatgttgaaggttactgaatgaaagtgaatgaggagctaggggtggaagtgaaaggggaagrctgggttggggaaggagggttaggaagctatgggtaagggccagtgactgtcatgagctctgccctcatgggatctaccattccagggtgaattattaatacctggactaacacgtttggacagatgagtatgtgggtcagctgtcttctccaacttagagagggaaccaagcaatgtctgttcgaaggcatgggggtccccccagtgtgttattaataatcctagtttcttctaattaaagtttctttgcaactaaaacatcttctccaatttcctcacttgcctgacctacatgggga

SEQ ID NO: 76644 - DNA, 601 bp, Human
tcaagccatgtttaaagggttctgtcgatgaagaaagccacagagtcgattttggcaagactgtgcattgaattgaagaaggtcatcattgtgttttgtttttaaagtgagcaatctataccctccaaacactgatgactaaccaaaatcagatgatcaacttgcctcttttgctgcaaaggaatgaggggactgaatttgaaacatcttctccaaattccagagccattggactgaactgttccacagattgggtctccttttcagtagagccttacaaacatgaataaagacccaaagytcaatgctggccttaaaagctcctcctcaatggccacatcttgttgagtaaaagggcatcctattccttgagtaagttagaggttcagacacttgtattgacttgttcagacttatacattgctcattgctgaaatggaatgttctcctccagtcagcttttctgccttaaacaggtaaagggatcttccaagatgtctgactaacattcataaagcaactgggtgtgtcctactgagtactgactaaaagaaaaactttgttgtaaagcaagggaacttcatagactgcagataataat

SEQ ID NO: 76645 - DNA, 601 bp, Human
ttcacatcataaggttcttgttattggaccagggccatggattctatgaggttatgtggttgctaagaatttgaccctgagtctcaccttcctccgaagacctaggtcctggcagtttcacaatttgagaaaaagcttttatgtgcttttcttcaccacagtgaagtggatattcaaccaacatttccatcataacttcatagtactatttacagagacaaaatagaagtatttccctaatggacatcatcaaaactatttgtttactcttgagtgtttaaaacaaaaaggcttctcagamgtgttcttggacaacttttcctctattctcaaaggccatgatcatgagaccagaaacctgttggaaagtggctggtgaagatgcagctcagttactgctctttccttgagtcaaatggataatcagctgtcaaactcaggttctctgctggctggcctttctgagccaagcctggaatggaaggaagaattggattccatcctatcctcagcaccatctgccacctgcatcagcaaccaaattgtcagccaatttccaatgcagaatcttaatttccagggtggattggaagaggcagga

SEQ ID NO: 76646 - DNA, 601 bp, Human
tctctctcaactctctctggcttcctaacccttcaattttgttacagtgaatcatggatattcagaaccactggtgttttgtttccatttctcagtgactgtttccttttctagagctgatttaggttagaaggttaattttagatatgaagagttccactttaaattcccaaggttaggtctcaaagtgcaactttgaaaatttcaggatttatttcaaacagaagtaagtttcttatctactccctggccacacaaagcatcctctctcctttggtgtttgctaattttctttcttacrtagtcacccattgttcccttcccaaatcccaattctcagacaaggttttccccaggatgtcaatggtaatacaaagtagatctatgaggacatctagtggatcaatgtggaagagcagctagttcatgggcagttggaactagcctttctccaaaaggagcagaaagaggaccctgctgtctctgagaattgaaatatatgcagtgtcatttcaattcaatggcttctcatgatccacagcagatgattaggggtaggggcagtgaaagggtgagaggtcctaggagatgagcctagggt

SEQ ID NO: 76647 - DNA, 601 bp, Human
acagtgacaaaccagtggctctcagggactgtttgcaactgttattgttagccgttctggcgaccatgcattgttctaaaatttcttattgttagcatgcaggaacaggctgaaactggtaatcgaagcagcaaaaaaccatgtgctataagaagattaactgttaattataagcagtcacattccaaagcagcatatgcataaaaaagaaaacatgctattacttgtcattccttcccaatcatttttacactcacaccaaatgcaaaatagaaatctcaaaagacaaacaagtgccacaacacacacacacacacacacacacacacacacacacaaaatcagcaagaacgatcaatgagaggctcaaagacaagacagaaacagttaaaaactattgagccccacatgttgacaaaccttcatgaatcagaatgtctagatcaaggtgccaccaactgggaaggtggctctttttcgctactgctggcatagtccatttccattgactccctgtcaggtatcttcacctagagacttctgggtccactttcttaaaaggtaagacctcccatctggtggagcgattcatcaggcttga

SEQ ID NO: 76648 - DNA, 601 bp, Human
ttcagatcatcatgcagccccagccctgttcaatggtggtatatcattcctttgagctttagcttttaccaaaaaaaaataaaaaataaaaaagttccactatagcatttgaatcagaggaatttagaaggcatggtgtgaatgcccagacatcccaaacaaacagcaacggctgaagtcaagaaagggaaaaaagtcttcaattaaagacatgaacataaatttatcttaaatgcatccggatctggcatacaatctgcagacattcccttgttttctctttcttatttcttttactggwaatattgatttgttatttacacagaagagggaaacaaggatgatttttttgcttcaccgtagataaatcattttgaaaaacaatttttttaatcaaatgctgtagcagaagagaagcccatcaaactctggaatgctatgcttctcattagcaacggtccctggttttcatttccatactgccattttgggtttatgtacaataatagaatctgacacatttgtggagaaagaaagttcttataaatataccgtctttaaggataaggggagggatgatggggatgaaataacttttgaa

SEQ ID NO: 76649 - DNA, 601 bp, Human
ttacagtcaccaggaagaggggtttaaatctctcaaatgggtcaagtcctgttctaagacctttatgacttgccatacagtatatttgtcaagcaagggtaacgttatgattgtgaagaacaggcactgggggagatgaatgagagatctcttcagcagcaactccattcttgtaaacttggctcacatttttagtgacatgttcttttagtgtcctagctagtctgttgttcagatcatcatgcagccccagccctgttcaatggtggtatatcattcctttgagctttagcttttaccaaaaaaaaataaaaaataaaaaagttccactatagcatttgaatcagaggaatttagaaggcatggtgtgaatgcccagacatcccaaacaaacagcaacggctgaagtcaagaaagggaaaaaagtcttcaattaaagacatgaacataaatttatcttaaatgcatccggatctggcatacaatctgcagacattcccttgttttctctttcttatttcttttactggaaatattgatttgttatttacacagaagagggaaacaaggatgatttttttgcttcaccgtagataaatca

SEQ ID NO: 76650 - DNA, 601 bp, Human
aggtaaagcggtgaccacaggaaaagggcatggctgaatacactcgggttctcaaatgggaagaagagcaaattatcgacagcaaaaaacgtaaccaacacttttcccctgatatgattaatacaggaggacaaaatatacacactgccaatcaatgaaattagctgcttatttggtataataaatggtttttgcaagatgcaaaaatatctaatatgtaggctttctaatttccatccatttctgggcattaggcagaggctgggacaagctttcatcaaattagatgtgaaacgattaygtgttaatacagtatctaaggatgcctttgctgaacttcccgagagtgagtttatatgatggctacaggaatttaaatttactcttgacagaacaaatatccaaatctgtccatataagaaatgcagctactcaagactaacgctgcagatttgacattaaaggcagttcacaaataagaaatcaccaaaagcatatgagatgttgctctattggaatgcatttagctactcatgggtgtattttctgcttaaagctgagaggatctgaaaatcgcatctgcctttctctccccaccaaa

SEQ ID NO: 76651 - DNA, 601 bp, Human
taagaaactatctaagctcactaaaagcaattcaatgctagagctggcttgttctcgctacaccctttccttcctccctttgatacaattcaatttacagccatttcaaaaatattaacatgtacacttctgcatatctctgtattaatacagtaggtgatatgctgtcactttaatttccatttatatttatttaaaggagagagaggaaagatatcaccagactgtaatatcacagtcctgcatgctgttacgagaagcgtaagttaagaaaatcagaagggaggccttcctaggcacttacacagagacataggcagctggggcaacatgtcagcacacaggagttcacactgggaagaagacatcagcccgactgactcagaaccacagggcacagcacaagacagggatgataccacagacagcacaaacatggaactacgtgtgttgaggttaaacttacaggcacggaaactggtggagcaatcattaacagagacagaagaaagtgggaaggctctctcaagggtgtccacgttaccacgcacacggcctgacatgcatgagcagtcacgctcagaacgtccgcaatcaaaac

SEQ ID NO: 76652 - DNA, 601 bp, Human
ggttttcttctccctggtctccatcaatggttggattaaattgcacagctgagaaatccctctaattaagatttctcttggatataatggaaattacacacactgggcaccatggggtctacatgggggacacagagtgtgctgtgattggtattgttggccagtgccaagacatgaccaaggggccctagctcagagccagagtggctcctttcttttctccactgagtctaggctaaggttttagagcctcatgattatttgagaacagaagttgtgcattaggcagaagagtaacccrggggcttgtggttactttcaccaccatcagtcaaagagatgtgaccaattcatgccacctcaggccctcctctgctcttcctccccagcacctatctttgaacttggtgtcttgctgcacatcgtagacagacaagttctctgtgcagctgtgccctagcttatctctgtaatggcatgcaaactacagataactcttcaggggaaaataaagtgataaggattcatatggtagcatctaaggattgtaacagaaatctttccaagattttaggcccatatggcagtccacactccctct

SEQ ID NO: 76653 - DNA, 601 bp, Human
ctgattggaatctacttctatatttatgtgcatgtgtatgttgctagacattcattttttacatttaatagtactagaacacagctacttgtgaaaaagccgaggcccataccatcctgatgtcttttgagagagctgggactcttgcccaggaccatctgaagtggaaacaaaaccaagatgatcataaaatgacactctatgcactgattctagcctaccatattgaacatttcagtcttgccagaaataaaatccttttgtgatgaatccttatcggtcacaatttgccttacttttmtgacaccttttattttgatttttgtctttcctaaactagtccttcccctctgaagttcttttggtcaacacagtctggccttccatctcctcctgagttcaacagaagacaactatcataatagcacatgactcaaccgatccacagtaatgggccacacctccatagaggggtgcaccgagcaggcagcccctgttgttagaaggcaggttttcagaactgtgtgagcacttttaatatattaccattcctctgggaaccagctacttctcttcccacttcacaaaacacataatggga

SEQ ID NO: 76654 - DNA, 601 bp, Human
ggtgtgtcctattatagacattttcctagagctgtttccaccccctgcccttgtatctgattttatgtacttcaaaatgccattagttcacttaagtgactttagttctattgacaatgttaattctctgtctgcacaaaccaaaggctactcaggataagctgatttttgtttattatctgacaagactcgatattacactaaactgattttggtacgtctcccttcaacctaatcatattggacttctctcagcttaaccatcggagttgaatgccttcttgtattatatttatacccraaataaaagtcatgtgtaatttaaaattagctacagtagtttgcaaaaggctgcatgtaattgtgcaggtttaaacaattagtaaattgaaaggttggtgtgagcaatcacacatgtactttagctaaagctggttccaagtgcaagtctaaaggtctgcttctcttctaccacaggattaatttgtttgtgccagagttactgatgctttgtgactagaatcatgtcaggcaggtctcagcaggtctgaatcagtatggccctacgttgccactgcatcataattttaattgtcccttt

SEQ ID NO: 76655 - DNA, 601 bp, Human
taaaactgcacataaaaggaatgagataattataggctgttgatttttaaatgtagcttattaaattaactctcctttaacaggcgttggagactgtcaggatagggtgtgtcctattatagacattttcctagagctgtttccaccccctgcccttgtatctgattttatgtacttcaaaatgccattagttcacttaagtgactttagttctattgacaatgttaattctctgtctgcacaaaccaaaggctactcaggataagctgatttttgtttattatctgacaagactcgataytacactaaactgattttggtacgtctcccttcaacctaatcatattggacttctctcagcttaaccatcggagttgaatgccttcttgtattatatttatacccgaaataaaagtcatgtgtaatttaaaattagctacagtagtttgcaaaaggctgcatgtaattgtgcaggtttaaacaattagtaaattgaaaggttggtgtgagcaatcacacatgtactttagctaaagctggttccaagtgcaagtctaaaggtctgcttctcttctaccacaggattaatttgtttgtgcca

SEQ ID NO: 76656 - DNA, 601 bp, Human
cgatgtaaaggatccttctcaaaggcaattttgcccaagcatgatttctgccttacaatgctgatttaagaagctgcccactgcacagagtgagctaaggcccacagtaaggcatatttccagtcaacctatggctcagcgtggctatcacaaaatcaagcaagaggcagtggcttctgtagcctcacctgctaccaataagagtgtcttaagaagccccttccaggcccatcactaggtcttagtcacaggggatgacccagtggctgcctaggccgatctgccactctgtttttacttyctgcaatgaagtacaaagggtcaaatcaagacgcatgggccagggtaactaaagagccaggggacaacccaaaggctctggtagtgtttggtgtgcacatgtgtgatggatattgacacagagagagagagagagcgcactcacatcagcacggcaagcatgggaagatgggagaaaatggagactcagacgaacaggctttaaaactaatacatgaaaaactatgatcacatcgattcgtgcttattatccttggctctcctttttctgtctttttctcactggtagtggtggtggaaa

SEQ ID NO: 76657 - DNA, 601 bp, Human
agaagaacccagtgtgttgggagctcttgacagatgagcgatgtaaaggatccttctcaaaggcaattttgcccaagcatgatttctgccttacaatgctgatttaagaagctgcccactgcacagagtgagctaaggcccacagtaaggcatatttccagtcaacctatggctcagcgtggctatcacaaaatcaagcaagaggcagtggcttctgtagcctcacctgctaccaataagagtgtcttaagaagccccttccaggcccatcactaggtcttagtcacaggggatgacccartggctgcctaggccgatctgccactctgtttttacttcctgcaatgaagtacaaagggtcaaatcaagacgcatgggccagggtaactaaagagccaggggacaacccaaaggctctggtagtgtttggtgtgcacatgtgtgatggatattgacacagagagagagagagagcgcactcacatcagcacggcaagcatgggaagatgggagaaaatggagactcagacgaacaggctttaaaactaatacatgaaaaactatgatcacatcgattcgtgcttattatccttggctctcc

SEQ ID NO: 76658 - DNA, 601 bp, Human
ttgcacttccagaagttggcattctcagcatgcacagcctaccaccatgagggaacccaggactcaagtgcttttccatgcagttttaatgaccccctgaggtcaatggtgtacacaaatgccacaatcacggatgctgacataagtaaggacacagacaaaggtcttatgcacaaagcagtaaaaccgaaaagaaaattgtgcatgatacttagaaatgccacatgacttctttaggactctgtgtggcagtacttcacaggaaatgtgttttgtatttccactcgagaaggttaagtgkttgaaaactacagtggattttcagtgaatgggatgtgaagcactttattattttccccccatcgatgtaaggagacatgctgacttcctgagaaaggaggagaaaagtctccttgccatatacagggatttaaagaataattcccatgagctctaactgaagctaccacctgcagctggaagcaagagcctcagcgctggccagctgtccccactggtggctcccacttgctttgtgtctgctgctcagcctgagccaatacttcacaccagcaggtgagagctgcctgcctgtcacctt

SEQ ID NO: 76659 - DNA, 601 bp, Human
tgccacattgcacttccagaagttggcattctcagcatgcacagcctaccaccatgagggaacccaggactcaagtgcttttccatgcagttttaatgaccccctgaggtcaatggtgtacacaaatgccacaatcacggatgctgacataagtaaggacacagacaaaggtcttatgcacaaagcagtaaaaccgaaaagaaaattgtgcatgatacttagaaatgccacatgacttctttaggactctgtgtggcagtacttcacaggaaatgtgttttgtatttccactcgagaaggwtaagtggttgaaaactacagtggattttcagtgaatgggatgtgaagcactttattattttccccccatcgatgtaaggagacatgctgacttcctgagaaaggaggagaaaagtctccttgccatatacagggatttaaagaataattcccatgagctctaactgaagctaccacctgcagctggaagcaagagcctcagcgctggccagctgtccccactggtggctcccacttgctttgtgtctgctgctcagcctgagccaatacttcacaccagcaggtgagagctgcctgcctg

SEQ ID NO: 76660 - DNA, 601 bp, Human
aggccacttttgttagtcctgctcatctgagctggacatcaaaagaatgtctcctcagaataaaaatctgtgggcatgtgtagcaatctccctccaaagcaggcactatctagctatttacagaaaggcctttgcaattccctctgagatttcaaatgcaagggtctgacaatgctggatttagctctgtccatttagattccctttgggaaaaaggtcagctggggaagcagaacccctgtaagcagatgtggcgatggagggtcccctgactatccaggtaattcaacaagctggtttkggagaaagccccagagagagaaggacaacacacagctggttggcttggtgcattttgccacattgcacttccagaagttggcattctcagcatgcacagcctaccaccatgagggaacccaggactcaagtgcttttccatgcagttttaatgaccccctgaggtcaatggtgtacacaaatgccacaatcacggatgctgacataagtaaggacacagacaaaggtcttatgcacaaagcagtaaaaccgaaaagaaaattgtgcatgatacttagaaatgccacatgacttctttagg

SEQ ID NO: 76661 - DNA, 601 bp, Human
ttgccaatataggaagcccagccaaggatgtcagcatgctacatttttgaccttggagggagggaaggcagcccctgggtcctttcttgactgagtgtgatccaacaggctccagcccagaaagctgacattggccaaaatgaagatcattttaatgcaagcagtcagctcccttcccagaagatagcccatgctctatggtgtgcagatgcccatctatgcactgtcgatacagctggtgcagtgccagctctagggctggagtctttctcacttcatttataagtctctcagtgcagtygatcatccctaatgcagatctgcctcaaaagattccattttctatttgcatagggttttctctgcagctctaggaacatttggtgggactcatcttgcggtattgaaggggctagaatgaaaactttcagatttactagaaaaggctgggggagttttttcttgctgtttcccttgaatatgagagattagctccccctgaggatgaccaaatgagatggtctgagaagaaaggccacttttgttagtcctgctcatctgagctggacatcaaaagaatgtctcctcagaataaaaatct

SEQ ID NO: 76662 - DNA, 601 bp, Human
gccatatgtggaaatttactcatctgcactgaagaaatggccagatcagccttgacaaaatgcagagagcatttcagaaccattcaaaggtaagggaatgcttggtgcagcctgagagagctttgagaacaatcaggaaaactcttccttggcttgagcagaacaaacagaataatggctcctaataggtaatagctatgagacattcagcttttggatacctccacgcgggaggaatcatttgggtgctgctgttgcattcaagctgcctacctcgagtcagagtcaaattaccctgacmgccataaaaggcctcgaatgttgctctacatttgggcaggttgatgtgcccacctgcagatgctgacacctctctagctacaacagactcctttcctcacatgagccctgcccaatgcattggttttatgctgccctgactcacaccaaaataatcaggtttgctgaaattaataaaactgaatgtgaatgtcacaagtccttgattttccagagcaaatgctctatatgtggtagtaaccctgccactcctcattggaagcattggtggatttttgcctatgtggttttttctggtact

SEQ ID NO: 76663 - DNA, 601 bp, Human
gtaacatctgtttagggctttggttttgaagcatccctgctggatatgttctctcagttggatacgttacaggccatatgtggaaatttactcatctgcactgaagaaatggccagatcagccttgacaaaatgcagagagcatttcagaaccattcaaaggtaagggaatgcttggtgcagcctgagagagctttgagaacaatcaggaaaactcttccttggcttgagcagaacaaacagaataatggctcctaataggtaatagctatgagacattcagcttttggatacctccacgygggaggaatcatttgggtgctgctgttgcattcaagctgcctacctcgagtcagagtcaaattaccctgaccgccataaaaggcctcgaatgttgctctacatttgggcaggttgatgtgcccacctgcagatgctgacacctctctagctacaacagactcctttcctcacatgagccctgcccaatgcattggttttatgctgccctgactcacaccaaaataatcaggtttgctgaaattaataaaactgaatgtgaatgtcacaagtccttgattttccagagcaaatgctctata

SEQ ID NO: 76664 - DNA, 601 bp, Human
tatattcactcactgaattcgtgcaaccactctgtgagataggtccttattatctccagtttatagatgaggaagctaaaaaatagtgaagttctggaacttactcaaagtcacatggtagtaggacatgatgtctatgctggggatgcctagatgaaatgagatgatgttggtgccttgagaagcacaaagactcaaacacacataagacattactcttattatagccatgagcatctacttggtgaacatgtcaaagcatgacttcaccaggacttacttccaaagtttccagaaaatkcacagatctcacccttgtatctgcctgctctgacgtttcctagaatttcaggctgtaattgccaacaagatctctcagttcactgcacagtgaggggaatggcatcagaatcccctaacatagagaggaggaaatacaggagatgtctgcctgtttcccatcttcatcttaatagaagatgtttgtgaaggagcagtgtttccagcaaccagccccttgcaaatttcacattcatgccctaacttccagaccctgtgacatgacctgagccccttcctccctgtcttcattcctagcata

SEQ ID NO: 76665 - DNA, 601 bp, Human
ttttgttggcttatttctgttgggacaattattccatgacctagaaattaaacaaattgactccatttaacttttatagtctgttatactaagctgttcaactctcagccactatctgtgggcttctctgcctgtagctgatatgacctcttataaggctagcttgatgacagtcagtcatttgaaaaaaaaaaaaagcactagttatggttaaagtggcttatcattattatttccatcaatactatgggagatggcaagcttctgatctagcagtccactcatccgctatgtgatcttsgtcaagttcatctctgtttctttgttaatttcatatgttaatgaaggatgataaaaataataattcaacatataccaggcaatctttatatatattcactcactgaattcgtgcaaccactctgtgagataggtccttattatctccagtttatagatgaggaagctaaaaaatagtgaagttctggaacttactcaaagtcacatggtagtaggacatgatgtctatgctggggatgcctagatgaaatgagatgatgttggtgccttgagaagcacaaagactcaaacacacataaga

SEQ ID NO: 76666 - DNA, 601 bp, Human
ccagacatggtggtgcacgcctgtagtcttggctacttgggaggctgaggtgagaggattgcttgaacctaaaagttcaaggctgcagtgaactatgatcacaccactgcactccagcctgggtgacagaaggaggtcccatctcaaaaaacaacaataacaacagaaaaagatgagttgagatcaagaccatcatcaaaaaagaaattttgatggaatttgaaaggacaggaatgtcttctttccccatctgttctcctctttttgtgttccaactttccctccctctcccaaaaacacwttgaatttgctgacgatctccagacctattttagggatggacaagccataaagaaggggtttcagggggatgaggaatgatgagacctgaagtcacagttttctaatgatcccaggacctaaggattctaacagctgggctaaaatctaagacacacatttattttcatccatcaaatctgtactattccaactaggaagcctcttttgcctggagatggtgtccccgtttggccctatatgcttcctgctacacgatttcattcctggagacctggcaataacaaaacaaggtgtaaca

SEQ ID NO: 76667 - DNA, 601 bp, Human
agtttacatgttaatcagccatttattgaattcacactgtgtgtcttggttactgtgtgcaatatgctaagaattcaaagaccaattttgacttctacaaaaacctcaacataaaaactgtctaatggggtttacatgaaatgttacaggcttacagaaaagagattcactttttctaatttggtttctgggtgggctagttaagaaggcttcacagagatggcagtacttgagctgtaccttcacagcagaggttggccaactttttccctaaaaggccagatagtaaatattttgagcyttctgggccataccctttttgttacaattactcagctttgcagttgtagcctgaaagcagccatggacactgagcaaatgaatgggagtgactatgttacaaggaaactttacttactacaatggatggcaggccagactgggcccatgggacagtgtgctgacccctgctctgaaggatgggtaagttttaatctgctagaagcagagaggaaaagaatcacagtctcaggaaaaggttccagaaatgtgtaaagtaatgagaataagacgcttctagagaattgttagatgatggatg

SEQ ID NO: 76668 - DNA, 601 bp, Human
tctctagccttgagacttttttttttttttttgcctctggttcagcttctcatgaaagacctttttccttgagatacatgcttaataaactatggaaacatattctcaacagagtttacatgttaatcagccatttattgaattcacactgtgtgtcttggttactgtgtgcaatatgctaagaattcaaagaccaattttgacttctacaaaaacctcaacataaaaactgtctaatggggtttacatgaaatgttacaggcttacagaaaagagattcactttttctaatttggtttcygggtgggctagttaagaaggcttcacagagatggcagtacttgagctgtaccttcacagcagaggttggccaactttttccctaaaaggccagatagtaaatattttgagctttctgggccataccctttttgttacaattactcagctttgcagttgtagcctgaaagcagccatggacactgagcaaatgaatgggagtgactatgttacaaggaaactttacttactacaatggatggcaggccagactgggcccatgggacagtgtgctgacccctgctctgaaggatgggtaagt

SEQ ID NO: 76669 - DNA, 601 bp, Human
atgaacagaagcaatgggtttgccatggcttcctaccccgactcaaatacccaatgacatatggaaggagaaaacatcagcacccccagatccactacagagcccaccatgtgctgtcagcagaaacaacggaacaaatgtgttaccttcagaagaagcagtgatcaatttgagatcaatctattcaagagttgtccagcagtcaaaggaattggctgttggctgttcagaaacaaaggttctgttcaagaaggtataaaggaacaagaaggaagaaaggaagatctctagccttgagacttttttttttttttttgcctctggttcagcttctcatgaaagacctttttccttgagatacatgcttaataaactatggaaacatattctcaacagagtttacatgttaatcagccatttattgaattcacactgtgtgtcttggttactgtgtgcaatatgctaagaattcaaagaccaattttgacttctacaaaaacctcaacataaaaactgtctaatggggtttacatgaaatgttacaggcttacagaaaagagattcactttttctaatttggtttctgggtgggctagttaag

SEQ ID NO: 76670 - DNA, 601 bp, Human
tacaaaggaataccgcagaccataaaaaaaacagtaaaaagatatagctgtgtcttttttaaaaaacggttgaaaaattgggtatgtgtggacaaaataatttttaaaaatagttttgcttgcacatttgatttctctcttcatttatgatgccctagttgatgagctgatcaacttttctgtgaaaagtcttcctaaaaaacagaacaaaacttaacagaaactctgatcctgtttgtcaaaatgtagttctggccccgagagaaaggcaatattctttggatgacttggattctaaagyaactcttttattagtattattatttacttttttttttttgagacggagtctcgctctgtcacccaggctcccaggctggaatgcagtggtgcaatcttggctcactgcaacctctacctcccagttcaagcaactctagtgtctcagcctccaaagtagctgagattataggcacctgactaatgtttgtatttttagtagagacggggtttcaccgtgttggccaggctggtctcaaactcctaacctcaagtgatctgcccgcctcagcctcccaaagttctggggttacagacgtga

SEQ ID NO: 76671 - DNA, 601 bp, Human
aaggagtggcagtagagggtgggaagggcatgccaggtggaggacacagtttgaaccaaggcaaggtggttggaaaatactaaactgtataaactgtaagaaagtcaatttggctagagcaggaaaatgtgtttgagggcacagttggaggtataaagggcagagagtgtaagcgtttacattccaaatgatagaatttgcacaatatttagtaataatctgaagcctctgggaaagctatttttcttctgatttaaatactgaagttcaaagaggatagtgggtgggctttgcatcttgsaaaagtctatcagaaactgcctagctcgctcagcccactttcctttccaaggtaagaaacacacattcatgcatggaaataaagcagggaggcccttggcaactgtccagttccattgaagttctcatttttcttttttttctggagagcttattcaacaggaaaataaagttatctaatgcctcagaaaggggtcccgtgaaactcacaaggcctattcctcacagcccagccaggtaaatttaccctgatttcaggatggctatttcttgtcttcaactactccagctgatcccatcc

SEQ ID NO: 76672 - DNA, 601 bp, Human
tagagagagaattgttcaggaaaaaaaaaaaagaaaggaagaaaaagaagacgacttgaaacaagaataggatgaatagagaggtcccgtatatccccagatggagcacagggcctggcactcagggggcacttgacccatgatgctgaacagactaaggagtggcagtagagggtgggaagggcatgccaggtggaggacacagtttgaaccaaggcaaggtggttggaaaatactaaactgtataaactgtaagaaagtcaatttggctagagcaggaaaatgtgtttgagggcacagytggaggtataaagggcagagagtgtaagcgtttacattccaaatgatagaatttgcacaatatttagtaataatctgaagcctctgggaaagctatttttcttctgatttaaatactgaagttcaaagaggatagtgggtgggctttgcatcttggaaaagtctatcagaaactgcctagctcgctcagcccactttcctttccaaggtaagaaacacacattcatgcatggaaataaagcagggaggcccttggcaactgtccagttccattgaagttctcatttttcttttttttctg

SEQ ID NO: 76673 - DNA, 601 bp, Human
tggggggatgagcattagttaagtatgagacccttctggctctgatttgtaatgactctgagtttaatgtcgggcatacctttttcttgttcttttctttaaaatctttttaaagatgcacaataagagagaaccacaagcctagccagagaaattagataattgcattaaatacgaatatacgaactcataagttacataaatgcaacagtacaaaagatgttgcatgagaatgtcaagggagggctacatgaaatgtcttagacaataagttaagtcctagagagagaattgttcaggaaaaaaaaaaaagaaaggaagaaaaagaagacgacttgaaacaagaataggatgaatagagaggtcccgtatatccccagatggagcacagggcctggcactcagggggcacttgacccatgatgctgaacagactaaggagtggcagtagagggtgggaagggcatgccaggtggaggacacagtttgaaccaaggcaaggtggttggaaaatactaaactgtataaactgtaagaaagtcaatttggctagagcaggaaaatgtgtttgagggcacagttggaggtataaagggcagag

SEQ ID NO: 76674 - DNA, 601 bp, Human
ccttgcatctcattcaactgtcacctttgtcccttgtttcatatggccccaatgaagtgctcaagtcaaataattaggttttgccaaatgtcataaaaacaagaaaagccagaaaacgtttaaacggacctcaattggagaaggctggaaccattcagggcaagaacaaatgaaagacagatggggacagaggaaccccactgtttcctctaaattacaggaaattcacgccgtctgattgtgagggcctcttttctttcccttgaatttctgctgggaggtcatgggattgatcggcgtrtgcagacacatgggagacagaagaaggggcagaggcatggcggggtagagaggcagtgactccttcaccaggctctcccaccatgtcttcctttcacctgactacttgaccacccttgaagggacagcctaggctgcctcctccagggggccttcccagatgattatgacaagatcaattctctcctttctttaaaaaatcccctggcacttctgatctcatgccttgcattattataatttgtgttcaattctaatgtgttctactcccccagctaggcttataagctcctctgttgga

SEQ ID NO: 76675 - DNA, 601 bp, Human
gcactgataatttctttcaaactcagataaaggtaaaatgcatgggtttttagtgcaagccaggtgcccgacgaagaatattctgccagaacactttagaaatacagtatgcttttaaccttgggaggtaaggaccagtgtggattatgactttacactaaacacagcatttagtatatttcttaagggcataatcaccttctatagatgttcttgaactataaaatctttatctgtatgctatcataatttatcctcggacacatcctgtgcaatattttataatgctagtgtatggtgrgcctttctggtcaatgcattggagaacaaggtgtggagtgcaacagaagggctggaagcggcttggggatgctctggcctcaccctcttttgcgtcatagctgcactcatacgcagaccctgacccaggacccaggtcggctgacttctaattcagatcatttgctgccagaattctgcctgtgagtgagaacagcatgaggatatgagcttcttgagtcagtccacctgcccaagtcccagctctgaccctctttagagctctgatctcagaccagttactccatacctcaatgtccta

SEQ ID NO: 76676 - DNA, 601 bp, Human
ttacattctttaaattaatgcttgccccaatgattgtgatatttaaagaccagcctagaatctaattgtgtatatgtgaaactgttttctaaaccataagatgttatataaatacaaaccactattattattaacattattactattggctcatccggaaataccatatcttccattgagccaatggtgtcaagagccccctagaattctaatatatattccagatgggtgcactgataatttctttcaaactcagataaaggtaaaatgcatgggtttttagtgcaagccaggtgcccgmcgaagaatattctgccagaacactttagaaatacagtatgcttttaaccttgggaggtaaggaccagtgtggattatgactttacactaaacacagcatttagtatatttcttaagggcataatcaccttctatagatgttcttgaactataaaatctttatctgtatgctatcataatttatcctcggacacatcctgtgcaatattttataatgctagtgtatggtgagcctttctggtcaatgcattggagaacaaggtgtggagtgcaacagaagggctggaagcggcttggggat

SEQ ID NO: 76677 - DNA, 601 bp, Human
atggaatttatggagcctgtaaaggaactctttttctaagacggtttataatcaaatagatttggatttactgtaggtcaaatcaggtcccccgatgtgtatcaagaaaaaaatgcctgtaagataccaaacactgctcctggcaccctggaagggctcacacccatggctacagctgctagtttcctggtgtcctcattgtttccacccctagtgaattcagtacttaaatgtcagctttgaaatcaatatttatactgtcttcacttaaaattatgacattctgttcatcctggatttyttaaattttgattattttgaaaatattttattttgatagtttgaaaatattgcatgaaactatcatttatcttgattcctgaggttttgggtctcctcttaaatttggtgcccagggcaaaagcttctctcacctcgcccaatttccagccctgaacaccatttctcaaaggtgtttgaggtactggttctgccaccccacagaactggacaaggcaaatctaacacaagacttatttcttttgatcacttcatgctgtttgcatgagattgttaaggaaggcccttgcaacaaacactt

SEQ ID NO: 76678 - DNA, 601 bp, Human
gctgacctttgacagagaaagtttgctgacccctgcagtagtttaatcttctcacatttcccttgctttccagtctccacaaagaacaatgttcttcccaacctgccaagacagccaaataacaaaagaaatacccgtggagcccacctgaagtgcacagatctggggacattgggaggaacagaggtagcttagtgactctactgtccctaccacccaacctgctattagccctgctggtccgctcgtgtttgaggtcatgagtcaggtgagtttcacattttccaactcaagctaagtyagattcatccacccagtactttggaaagcaaggcgaaccacatctaccgtgagcaattcctcgaagctgtcagcgtgtgctgccagtccaccctgcgagagccccgtacaagacaacagattaaccattagactagatatgttgaaaatatacagcttcaacctttccccagctagctcagagcgatatatagatgattatttcaaccgtcagctgccgcatagatttaaacctctgcacaataactcctggattcatctgccccttgtcaaacttgcacagctttagttggaggataca

SEQ ID NO: 76679 - DNA, 601 bp, Human
tttctcatctttctcaagttcaggggtcagcaaactgtagcctgccacctgtttttgtacatcacatgagctaagagtgtgtttacatttttaagtcattggggaaacaaaatctaagaataataatatttggtaacccactaaaaagatatgaaatttggtggctataaataaaattttatcagaccatagccacagttgttggtttaccagccatccctggctgcttccatctctaacgacaaagttgaggacttgccatagagaccatatgggttgcaaagactaagatattaactcrctgacctttgacagagaaagtttgctgacccctgcagtagtttaatcttctcacatttcccttgctttccagtctccacaaagaacaatgttcttcccaacctgccaagacagccaaataacaaaagaaatacccgtggagcccacctgaagtgcacagatctggggacattgggaggaacagaggtagcttagtgactctactgtccctaccacccaacctgctattagccctgctggtccgctcgtgtttgaggtcatgagtcaggtgagtttcacattttccaactcaagctaagtt

SEQ ID NO: 76680 - DNA, 601 bp, Human
aataggaaacacatttacttggaaaacctaatgggtatcagtttttaaaaaatctatcgttatgcagaataagaatttcaaaaaatgtctaagtgacctgtactgccctaggacaggcatagggagtgcccaccccatggtaggctgccagggcagggaagggaggcttgttggagcttttgcatttctggcttttgtggagctaataggaaaatggggagggagactttaaggaacaataggttatgtagaagttaatcacagggtgtatttctggctctattcactgcctaggaaaccygaattgtgtaagtttgagtccatcaacacagagtaatgaaagaattcagctcctccataggagagagaaaaaaaatactatataaatatatgaacagaatccacatgacatggaatgcagtgttctctacaaaatactgcgggcctaatggatcctctagaatccaattgggtaaattagatgtgcccatgctacccatgccataggccctcaaccccaatctcaaactatgttctgtatgcatcctgagaggaactcagcatgtaccaaagccccccatatctagaatcgcagctcata

SEQ ID NO: 76681 - DNA, 601 bp, Human
aacaaccacaaaaataataatacatgccagctgaacaacccatactgtgaatttggtagtatgattcctgtaaaggagcacttgactgctgtttcgggatggatcccgtggtggggaatgccatgtgtccatcgacgaggctgagctattaagcacagctaggatcaggcaagccaggcaatggagccaagttctacgcccagagagtagtgggcagtatcagggtgcaggggagttaaagtgggtgatgtccttggaatgagagtttcttgcctgacaaccttgaatagcacatatcacyaagaagtttgataagcactgcagtattcttcataaaaatcaactataaatctattttttgaaagatcgtggctaatattttctttttctgagacaaggggtctttgttgcccaggctggtgtgcagtggtgttatcttagttcactgcaacctctgacatcacggctaacattaatccacagattaggaaaagaagaaagatgctgccccttaaaagcaaccccaacgatcataatatctcaaacatatacacctctctaaaatcaaacaaccacattatcatatacattattctggcag

SEQ ID NO: 76682 - DNA, 601 bp, Human
gctgacctaagctctctctgatatgactgtttaagactttcaccagaaagtttgtgcaagttaactctcaaagtcttacggcatggccacaagagcgcagtctctggattggaggatggaatggtgcctggctgtttctcacacgaaccagacgggtaagagggtgtggttgtttccttaagcgatgatgggaaaacaaccacaaaaataataatacatgccagctgaacaacccatactgtgaatttggtagtatgattcctgtaaaggagcacttgactgctgtttcgggatggatccygtggtggggaatgccatgtgtccatcgacgaggctgagctattaagcacagctaggatcaggcaagccaggcaatggagccaagttctacgcccagagagtagtgggcagtatcagggtgcaggggagttaaagtgggtgatgtccttggaatgagagtttcttgcctgacaaccttgaatagcacatatcactaagaagtttgataagcactgcagtattcttcataaaaatcaactataaatctattttttgaaagatcgtggctaatattttctttttctgagacaaggggtctttg

SEQ ID NO: 76683 - DNA, 601 bp, Human
ttccttcggccgtcagcgacaccagtgaaaagtgggtgtttcaaatgttgttttactaaaatgaagggtatggagtgatggtaaaattcctggaattttacaacagtcgtgttgcaaaatgtaattcaccatgaacaaaactcccaagctgacctaagctctctctgatatgactgtttaagactttcaccagaaagtttgtgcaagttaactctcaaagtcttacggcatggccacaagagcgcagtctctggattggaggatggaatggtgcctggctgtttctcacacgaaccagackggtaagagggtgtggttgtttccttaagcgatgatgggaaaacaaccacaaaaataataatacatgccagctgaacaacccatactgtgaatttggtagtatgattcctgtaaaggagcacttgactgctgtttcgggatggatcccgtggtggggaatgccatgtgtccatcgacgaggctgagctattaagcacagctaggatcaggcaagccaggcaatggagccaagttctacgcccagagagtagtgggcagtatcagggtgcaggggagttaaagtgggtgatgtccttggaat

SEQ ID NO: 76684 - DNA, 601 bp, Human
taatccatagtgaaatttcttttagaaaagttccaaacaattttaacattgaatagctttgaatcaaactggaagtttctccctcacagctgaattgccatttttttccctttcttttaccctgatgacttcctgcaattctttttgccgtcttattgtcatctgtatcagtagggataatacttctggaaattcagaagacaatcttcttggtataatttccaaaaatatactgagttccccgtcaccccacaacatgtacagacaccgaaaactcagtttagcagcaggatcagacccrttctttcctgaagtctgctaaaacaaattctactgaataatcattatattccgagtcatcaatccttggtgataaacttttgctgtctgtctcgaactgccggcttggtcagcccccttagttgtggtatcagtgcctaacattaaatgccgtgagtttgccactcctcagaaagacagatccacggcatttccttcggccgtcagcgacaccagtgaaaagtgggtgtttcaaatgttgttttactaaaatgaagggtatggagtgatggtaaaattcctggaattttacaacagtcgt

SEQ ID NO: 76685 - DNA, 601 bp, Human
aaaatgggaatgggtcccagtcttccttcacctggctcggtcacaagccgagaattgggagtctccttcttgaactcaaatggatctttggaatagcgtgatctagctgcaaccttgactgccaaacaataaggagaaaagaaaatggaaattaatccatagtgaaatttcttttagaaaagttccaaacaattttaacattgaatagctttgaatcaaactggaagtttctccctcacagctgaattgccatttttttccctttcttttaccctgatgacttcctgcaattctttttgcygtcttattgtcatctgtatcagtagggataatacttctggaaattcagaagacaatcttcttggtataatttccaaaaatatactgagttccccgtcaccccacaacatgtacagacaccgaaaactcagtttagcagcaggatcagacccattctttcctgaagtctgctaaaacaaattctactgaataatcattatattccgagtcatcaatccttggtgataaacttttgctgtctgtctcgaactgccggcttggtcagcccccttagttgtggtatcagtgcctaacattaaat

SEQ ID NO: 76686 - DNA, 601 bp, Human
gcatggtaaagtagaatgttgagggctgcagggtagttattaaaaatgggaatgggtcccagtcttccttcacctggctcggtcacaagccgagaattgggagtctccttcttgaactcaaatggatctttggaatagcgtgatctagctgcaaccttgactgccaaacaataaggagaaaagaaaatggaaattaatccatagtgaaatttcttttagaaaagttccaaacaattttaacattgaatagctttgaatcaaactggaagtttctccctcacagctgaattgccattttttyccctttcttttaccctgatgacttcctgcaattctttttgccgtcttattgtcatctgtatcagtagggataatacttctggaaattcagaagacaatcttcttggtataatttccaaaaatatactgagttccccgtcaccccacaacatgtacagacaccgaaaactcagtttagcagcaggatcagacccattctttcctgaagtctgctaaaacaaattctactgaataatcattatattccgagtcatcaatccttggtgataaacttttgctgtctgtctcgaactgccggctt

SEQ ID NO: 76687 - DNA, 601 bp, Human
ctaaagaggattcgttatttcaatgacataacctccagacaatgttctgagaattgatttaagatgtggtggtaattccaacagccttaatgcagagttgaacatctgtaacaacattttactcgacttttcatcagcattctgttttcaagcaaaagcaacgtcttccagaaacactggccagaactctgggcttacttcaaaatgattacatatttcactagatttttaaaaaaagaaatatcttcctttatcagccgcgccagactgcaaacactgtgtcagggtttaccaagcctctttatggtccttggagtgaaatggggcaatgattgcaactcccagccttccctaattcagtctaatgcctgcattagatggacctgatgctcagctctagcctggggcacattccctctgccctgtttccccagtgagatttaaggggatgatgccctttaagatttaaaggtgagtttattggctggagttaaaaaacagttcaaagcaaataaactcagaaacgtaataaaaggcaaacaactcataaacatgagtcaaccgctatctccattatgttattaatcaccacatctggaga

SEQ ID NO: 76688 - DNA, 601 bp, Human
tgtgtttgtgtgagtgcatgtgagtcactctagtcggggtgcaagttctgtttttctcatcttaaggttataattcagttagacttcttaaggttataatcccacatccaaaggtttttatctaacctagtctaccacggctagcatttttcaaggtcaccagatgctaccatggttgtgtccagttacacaatgaatctagatgagttaagacctgaacagaagtcatcctccctagcatgcctgtgggattattttgctgagcattggcttccctttttgcattgggcctataacaaakaatcctctttggttaagtggccattatctttacaccttgttgctacactgatcttcagatgggagagttgcaagttaatacctgttagccagctcaagggagacacctcattctggtagtaaagttatgcctcttctatgcaaagaaactatttattttcattgcaactcagaaagatcatccatcgtaatcatactgcatttaaagtgggatttgttctccaaaatgaaacttgtgtttaaaggtttcctcctgcactcacagcctaaaaatgcagatctgttccctgaagagatgggg

SEQ ID NO: 76689 - DNA, 601 bp, Human
caaacagggacagggaatttggctccaaaggtttcagatttttcagacttctctttatttatttatttgcttctctaaatttaggtgaaggaaagtggctgggcttttctctactttaaatgggaataactattagaattagataaggtgattacctaaaggtgagtaaataggaaatgaatgctagcatgacactggcatcataaaaacgaaaagcttggcagttggcacattttattcctcctcataaactgtaaacaagcatgcaaatcagccaaacccaaggaaggctgggtgaagyggaaggcagagaacttttaaggaaacatttaacaggaatagatggtgatatggaaaaggagttgggcagggtgagtcttccacggaaaacctgtgtcctcaaccacatgaagaaagactgcccttgcctattttccagaaaggtggatgtggagggccaggaacatgcaaatgttattgaatatggggagtggaaatcaccactattctatttcaaaaatcaaagccggtggccatgaaaagacaaaactaatgtcaagatggcaggcatttccagagcagaaaccacatagggtgagca

SEQ ID NO: 76690 - DNA, 601 bp, Human
agcaagatccactttgaaaattctcccccatcatgcaaactgacacaggcatgcttttcaaaaacccacagccaatctgttgatcattacttatttacaaaggccttcgggcagaaagtcctgtaaaaaccatacttgatacgatatacactagctttttctgcttgtggaaaaaaagtccccccaaggctacctcaaaccatcactttctattgcacataaaatgtagcgtgtaacactaaagtatttaatatatatggtataatatatctacaggaaaggcatttgtgtagaagtatgytaccctggatttggtaatttgatgttttgctgaaggctacgacttaaaaaagcctccacctcatacagaagacctgtcatcttggtacccaagagccaacagaataaagaagtacccttaagcagcaaaactttgacacagctttgaagcatatgaaaacagtataactcctcagaattattattactcaagatcaaagaaatgagccatactttacatagcaaacagggacagggaatttggctccaaaggtttcagatttttcagacttctctttatttatttatttgcttctctaaa

SEQ ID NO: 76691 - DNA, 601 bp, Human
gacctgaaagtcccatttactggagagtagaaagcaggtgtcggaagaggcgggggcaactggaaaagccacagggagctgggagagcccttgttttctgccaatcaacaaagggggtttagcaaaaatggacccatgacttcattgccagtgccagatattcaaatgtaaaacaaagggccctgaggtctttctgtaaactggaagtcaagggatatggagagagggctcaggaggggtccatctttgctcccaggtcagatggagaatgtggagcacctgggacatagaaagacgtggyaagggaggagtgtctaagactttctcacttgtcatgggatggcccattccagctgggctgcgaagggagaccatggtgggctggtgggataagacatcccagcgacaggaactgaggccttagcagcagcccaaaggcaaccaacatgagaagcccgagttctgtagcttggcaagtttccactcaccacctgacccacgtttagcaattttgatgtaccatgaaacagacagctccagcccaggatgactgcctccctcagcccctctccagcaacgaatgaaagcaagatccactttg

SEQ ID NO: 76692 - DNA, 601 bp, Human
acaagaacaaagggaaggaaaagaccattagtgcagagtccccgttgcatctcctgctggcagatgatttggaaggagccttcacgcaggagtctgttttatttgcagaagccacagtggtaaattacagcccatcctagcccattctgggttctccagttcctcttggagctattcctgtcactgcccataggccactaaaacctgcccgcattcagaatgattgattctgctcaaactgcaagtcacaaactcatgtcgaaaaatccacttcaaataagtcattagcttcctttatggrtttttcaggtcatgaggaataggacctgaaagtcccatttactggagagtagaaagcaggtgtcggaagaggcgggggcaactggaaaagccacagggagctgggagagcccttgttttctgccaatcaacaaagggggtttagcaaaaatggacccatgacttcattgccagtgccagatattcaaatgtaaaacaaagggccctgaggtctttctgtaaactggaagtcaagggatatggagagagggctcaggaggggtccatctttgctcccaggtcagatggagaatgtggagca

SEQ ID NO: 76693 - DNA, 601 bp, Human
aagtcatttgggtgctagactttagattccttaaagaacttccatgacaacttgcacacagtaggctctcgctaaatatttgctggatgggagctaatctgagaaaaagattaaaagcaggcagccgaagtgcacagactttttggattccatgtgaggattcagtgtgagaacccaggtgtttactccataccacctacccattggagaaatctcatcaaccaaaaagcatttgtacgtgcaactatgtggaggtggctctggaataaactgaatgtgattgtaaccagggatcctgaawggagatttcaggaatccattaacctgcttcaactgtggtaaaaggggatcaagtgtactttttattttttcctagaaagacttcctagagagttttcattgaaggttcatagggttggtaaggcccccaaattaagaactcttgacttagctatttagagacaaactttgtgcccccctaggactttacaaatgaggaaagacgtggctatccttacaaggcaccaccccactaagtagggagaattgggcaacgggtgcttggtaattttagaggaaaactacgggaggctccttcaat

SEQ ID NO: 76694 - DNA, 601 bp, Human
attcaggaaactaatgtctaatattttctgggtctcctgacatgaaactctcctcaaaatgttcaatttcttttttctgggtgttgtcaattatccttgccagcccagctgggtgctatctgtgtaaactgtccacctgatacatcctatgtaaatcctaactttcactgaagttttcattgaaagtttatagggttggtaaggcccccaaattaagaactcttgacctagctatttagagacaaagtctgtgctccccaggactttacaaatgaggaaagatgtagctatccttacaagscaccaccccactaagtagggagaattgggccacgggtgcttgatgattttagaggaaaactaggatgattttagaggaaaactctaggtctcaggactgatgtcaggaattacgtgtgtccttgggaaaactatgtatcccagtcctggtctactattctacagcagaccctgaatggcttagcacacaaacggccttggcagaggctggggttgagtgggccttctatttcacacctctgtgcttatgtagtgtgtgtctcagaaatctcctgatggaggactcccaacccttctctct

SEQ ID NO: 76695 - DNA, 601 bp, Human
tcattcttgggtgccttggctcctgggtgattactatttcctgatacttcctgaggctttgcagagcaaatcctggctcctgccttaacacatccttcaacagggcttccactcttctgataatgatcatcacccccgagacaccactgcccaccaccctctccccatctcccacttgacggccatccctggagccacactgacaaaactctcaggccaggctgtagccaccctggcagaactagggtccttttcaatttctctgcatctatctacttgcattattttccctgctgccacytaagatgttatctagtgttaggcagccagcattctcagaagaaggaaatggttgcctttatgtttgggagacagcctgggagaaccaacacgttcatcagtcctacaggaggttgtacaagatgctcttgacacaagagggcaaggtcatgaccatctgctgagcatgaacttgtccagggacctgtgtggtccacccaagcctcagtaccatgacaccaactacttttttcttctccagtcctgggggaggcctgtcatatgctatcagtttgtgcattaagagatgaatttacttagc

SEQ ID NO: 76696 - DNA, 601 bp, Human
tcactaagaccttgagcacaatgttcaagaatatcaggccacacgggtctgtctgagcctgtatcagacacagaaggctggattaggccttaggtggtctcctcaaaaggaatcatagttgggtgttcagcaccataaatggttccaactggatctgcctcattcttgggtgccttggctcctgggtgattactatttcctgatacttcctgaggctttgcagagcaaatcctggctcctgccttaacacatccttcaacagggcttccactcttctgataatgatcatcacccccgagayaccactgcccaccaccctctccccatctcccacttgacggccatccctggagccacactgacaaaactctcaggccaggctgtagccaccctggcagaactagggtccttttcaatttctctgcatctatctacttgcattattttccctgctgccacctaagatgttatctagtgttaggcagccagcattctcagaagaaggaaatggttgcctttatgtttgggagacagcctgggagaaccaacacgttcatcagtcctacaggaggttgtacaagatgctcttgacacaagaggg

SEQ ID NO: 76697 - DNA, 601 bp, Human
ccaggactacagctagacaagagggtgcctagggtgcaaaattgaaggaggcgcctcacattctgggtgcctactctgattctctgtgactctgtggaactcgaggcattgtgtcaacacttgattcttgatggggatttactgactagatgctgcactaatgactctctcttgctgacttctcttcccatgagctaatcagcaaataaatttaaacaagcaaattaaatactagtcctcgcaaagtgcaatacttacaattcagtgttctacccttctttaacaacatggtatctagtcrctaagaccttgagcacaatgttcaagaatatcaggccacacgggtctgtctgagcctgtatcagacacagaaggctggattaggccttaggtggtctcctcaaaaggaatcatagttgggtgttcagcaccataaatggttccaactggatctgcctcattcttgggtgccttggctcctgggtgattactatttcctgatacttcctgaggctttgcagagcaaatcctggctcctgccttaacacatccttcaacagggcttccactcttctgataatgatcatcacccccgagacac

SEQ ID NO: 76698 - DNA, 601 bp, Human
ctcactgataacgcacccaattattcaagagctctgatggagatgtataagatgaatgttgtttccatacctgctagaacaactaccattctgtagcccatggatcaaggggtaattttgactttcaagacttattacttaagaaatatatttaataagctatcactgccatagtgattcctttgatgaatctgggcaaaataaattgaaaaacttctgaaaaagaatcgccattctagatgctaataagaacattcgtgattcatgggaggaggtgaaaatatcaacaggagtttggaasaagtgaattccaaccctcatggatgactttgagggctttaagacttcagtggaggaagtaacagcagatgtggtggaaaaagtaagagaaatagaattagaagtggagcctgaacatgtgactgaattgctgcaaactcatgatcaaacttgaacatatgaggagttgcttcttacgggttagcaaagaaagtggtctcttgagatggaagctactcctagtgaagattctgtgagcattgttgaaatgacaacaaaggatttagaatagtacataaacttagttgatgaagcagcagca

SEQ ID NO: 76699 - DNA, 601 bp, Human
atgattagcagaaattcaccccataacccttgcatctcagctcaccctccagtgtccacagctagaaattcagtgtgcctaaagtctaataaggaacacaggcatggccaagtatggtggctcatgcctgtaatctcagcattttggagggctgaggtgggcagatcacctgagctcaggagtttgagaccggcctaggcaacatggtaaaaccccatctctacaaaaaatataaaaattagccaggcagatggtgcacgcctgcagtcccaggtactcaggaggctgaggcacgagaatyacttgaacccaggaggttgaggctgccagtgagccgagatcacactactgcactccagcccagcaacagggccagaccctgtctaaaaaaaaaagaagaagaacataggcatacctcatgttattcaactttgctgtattgcactttgcagatattatggttttgttttttttttttttttttttttttttttacaaattgaaggtttatttttccattgctagagcacaggcagagtagatttcacataattcttaatgcctatgggattttcagaatgttaaatgagctttgacttca

SEQ ID NO: 76700 - DNA, 601 bp, Human
tatgtgaatgattagcagaaattcaccccataacccttgcatctcagctcaccctccagtgtccacagctagaaattcagtgtgcctaaagtctaataaggaacacaggcatggccaagtatggtggctcatgcctgtaatctcagcattttggagggctgaggtgggcagatcacctgagctcaggagtttgagaccggcctaggcaacatggtaaaaccccatctctacaaaaaatataaaaattagccaggcagatggtgcacgcctgcagtcccaggtactcaggaggctgaggcaygagaattacttgaacccaggaggttgaggctgccagtgagccgagatcacactactgcactccagcccagcaacagggccagaccctgtctaaaaaaaaaagaagaagaacataggcatacctcatgttattcaactttgctgtattgcactttgcagatattatggttttgttttttttttttttttttttttttttttacaaattgaaggtttatttttccattgctagagcacaggcagagtagatttcacataattcttaatgcctatgggattttcagaatgttaaatgagcttt

SEQ ID NO: 76701 - DNA, 601 bp, Human
tatgtaatacccagtatctcctctaaaggttttcggccaatatccctcccctctccaaccaccttctctaccccaccaccaacatacaggcatgttagatctgctctgccagagtggtaacttctctccgtctttaacttagacatgcatttgaggatcaatgccaatgaaagcccagcttaaagcaaagaggaagcctgaacactagccagctaatttgagcagtctgacttatagagtccatctccaaatggagtgttcaggggttgataccactaagggcaggaaaccacctatttcyttagtgacagtataccatagtggttaagcgccctggctccagagccaaaatgtctgtcttcaaggcttggctcacctattacttgctaagttgtacattgccttagtttcttcatctgtaaaatgggaatgttaatcattagcattattcaatggattccatttgaggattacatgagtaaagatatttcatgccctgaatacagcatctgacctagagcatgtcctcaagaagtgttaactagtcttatggttatcatcctttatactttgcttaggacccactcatgtattactagct

SEQ ID NO: 76702 - DNA, 601 bp, Human
ctgaaggcccccggctgcccttcttgaatcttaagtttttcttgtccatttaagggggggaaaaaagcatcccgccattatttcaggaatacatagacatatatatgtaatacccagtatctcctctaaaggttttcggccaatatccctcccctctccaaccaccttctctaccccaccaccaacatacaggcatgttagatctgctctgccagagtggtaacttctctccgtctttaacttagacatgcatttgaggatcaatgccaatgaaagcccagcttaaagcaaagaggaagcytgaacactagccagctaatttgagcagtctgacttatagagtccatctccaaatggagtgttcaggggttgataccactaagggcaggaaaccacctatttccttagtgacagtataccatagtggttaagcgccctggctccagagccaaaatgtctgtcttcaaggcttggctcacctattacttgctaagttgtacattgccttagtttcttcatctgtaaaatgggaatgttaatcattagcattattcaatggattccatttgaggattacatgagtaaagatatttcatgccct

SEQ ID NO: 76703 - DNA, 601 bp, Human
actttcatctcagacttctagccaccagaactgtgagaagctctgttgtttaagacactgggtctgtgatacttgattacagcattcctagaaaattaacacaatagcccaccttgaagaaaaacaggcacaatatatcagatatcccttagctgaaggcccccggctgcccttcttgaatcttaagtttttcttgtccatttaagggggggaaaaaagcatcccgccattatttcaggaatacatagacatatatatgtaatacccagtatctcctctaaaggttttcggccaatatccytcccctctccaaccaccttctctaccccaccaccaacatacaggcatgttagatctgctctgccagagtggtaacttctctccgtctttaacttagacatgcatttgaggatcaatgccaatgaaagcccagcttaaagcaaagaggaagcctgaacactagccagctaatttgagcagtctgacttatagagtccatctccaaatggagtgttcaggggttgataccactaagggcaggaaaccacctatttccttagtgacagtataccatagtggttaagcgccctggctccagagc

SEQ ID NO: 76704 - DNA, 601 bp, Human
gatttcacagtctgggagtaagctgggaacacaattcgttccagcaacaatagagtctgtaactgtttctggccagacagtataaatttctttactatggctgttgctgtagtaatttcaagtgccttaggctggcctgtgctgcagagagatctctggaacaggtggagagtgtacagtcagttgtccacagggactaaatcaaagtttctaaagcttctattgctagaagaaagtccaagcatttgccattgagcacaccaatcaacactgctgtgatccagggagacccagaggaatkgggccgtttgttgtatggaaaggaggatcatgagaaatctccctgaacaagggatcccaacatcttcagtttgcaaggtgatagagacccacttccaaagcctctcccacaactcctcaaagaccagttagttgaaatcaaggaccaggattagatattgtctttcacatcataatgacattacctaagtcttccactcacaaagtaattttcaatttccctaaaaggcaccataattaattcaaggctcacttgtcacttgcgacttagccaatgtacatgccctattttagggtaata

SEQ ID NO: 76705 - DNA, 601 bp, Human
taccttgtggcaagtgttacagcaaagtacaaggtgatacaagaataccaagaaaaaagctgttcatatcctggtatttgggtagcattaaggaaggttttgcaaagaaagtagcatttgggccgggcgtggtggctcaggcctgtaatcccagcactttgggaggccaaggtgggcggatcatgaggtcaggagatcgtgtccatcctggctaacacggtgaaaccccatctctattaaaaatacaaaaaaattagccaggcatggtggtgggtgcctgtagtcccagctactctactcrggaggctgaggcaggagaatggggtgaacccaggaggtggagcttgcagtgagccgagatcacgccactacattccagcctgggcaacagagcgagactctgtctcaaaaaaaaaaaaaaaaaaaaaaaaattagcatttgatctgaaccatgagaaatgaagaggaatctcagcatgttgcagtgttgatccactaatagccagtaggacccacccagagaattgaggcccaaatgaaaagggccaaataatggcacctaaaaccatggctgaagatgccccataccataccacctaac

SEQ ID NO: 76706 - DNA, 601 bp, Human
cttggggaagaggagatacattttggtttggtatacttgattctttctgggaaggagtcagacgttgttaacagtggcctacaactttcatccagaaaagcaaataagcaagcctgatgatcgatcgcccttcaataaaaagaaaaaagacagctaatgtcaagcttcattaactggggtagtggtttccagaaaccaggcataatttcacactggagctcaagccatggtttgcaatggaacatccagaggcatccaggaagtcttagaggtatgccacactacactctactccccacayatctctcatcctggcctggaccatttaaatataaacaatccaggatttcccccaagagactgacctgaggaacatcaaaaacctcccggaacaaagacattaccctctctgaccagcatggtacctggaattctaactttggtttattgaatcagtaaagcaaccaattgaatcagtaaagcaatcaataagaatcccctattctgagcatggaatggaggctacagtaatgattaagataaagtccctagtcaaagagaggtccacaagatagcaggaaaaaaatatatatacaccaat

SEQ ID NO: 76707 - DNA, 601 bp, Human
aagaacaatcccactccgagtagcatctcagtgtctggattgttgagaggtcttgaggtatgtaaaccaccaggccatcttccaaatactgaacttagtcaaagatgttaagataaaaaggctgataagaactatttacagatcagggtgagagcacattttgagggatgtttttgtccttgaagagtctttaacagttgcatagatatctattaatattatctggaataggtaggtagacaaaagccatcatggagaagaggtttgagaaaatgaacaaaattaactctttccagcccaygaagaacatatttcagttgcaagaggatattagcagacttgccctgaagatatagagccaggttcaaattctcttgccctgtttactggttggagagaaagtattacctcaggatgacctgagacctgcccctagtgcatttaggatttaaaagatactcagaactatgttcccataatatcagcaagcaagcaaatgaaacagcaagctgacaaaaaacacttttagaaaatgtgtgccttggggaagaggagatacattttggtttggtatacttgattctttctgggaaggagtcag

SEQ ID NO: 76708 - DNA, 601 bp, Human
tagcacaataaataagctcctgcaccttgaatcatagtcaatgtccatgcttttatctctgatagtgattcagcacctcgggtttgggaagtcattgttccttcctgcaaaactggccatataattaggacattgtcccagctatacttaaccactcttgaaatggagctatcttttctgagtaatattgtcaacacaagacagaaaatatacatcgggtcacattccataaattgtaaagtgattttaccttttgaaattctatatttcaacatcagagggtgacttttttcttttttctttttttttttttttagacagagtctcgctctgcagaggctgacttttatttactttttactatttgtccttctgaaatgtctccgatacttcccacttatatgtcaagagtacagagtgggacagcaatctcttccatggcccaaaaacctaggattaagcttttgaataactaccacgaccctccaatatgctccccactcccacataaggtgagaaaactttctcactgcctttatttatgcctgagaatttgcttttagactacaccaaatgacaaatactatgtgaagccaacttg

SEQ ID NO: 76709 - DNA, 601 bp, Human
tataagaatacaaaacattgctataaaccaataacaatacaggcagcattcagctttcctcacagcatttaataatagtaagaataagaggtaactttactgagtcatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcgccatggccacaggaattatgttcataccacctcccaccatgsctttcccacagcaagtgctcacctactcttatgaggagccaatatattcagagattgaaaaatctgaatattgcttatgttctgatcagaggtctagctgcttcaatctatgctcagaatttcactcatcaaaaataattaggaccagggacagtattatcccactgtccaactagggaaaccccattcctagcaaatgtggtttggggcagaagcgggcaacatcagatgcacagtccctcactcaccaggatgactttctctatctccttgggtgcacaccagtgaaacatcccagta

SEQ ID NO: 76710 - DNA, 601 bp, Human
aacatgcactaagaaagctcacagatgcacaaggctattatctataagaatacaaaacattgctataaaccaataacaatacaggcagcattcagctttcctcacagcatttaataatagtaagaataagaggtaactttactgagtcatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcrccatggccacaggaattatgttcataccacctcccaccatggctttcccacagcaagtgctcacctactcttatgaggagccaatatattcagagattgaaaaatctgaatattgcttatgttctgatcagaggtctagctgcttcaatctatgctcagaatttcactcatcaaaaataattaggaccagggacagtattatcccactgtccaactagggaaaccccattcctagcaaatgtggtttggggcagaagcgggcaacatcagatgcacagtccctcactcaccaggatgact

SEQ ID NO: 76711 - DNA, 601 bp, Human
attcctgggagagactgggtgagcccactgctgctatgaagatgttcacaagccttccacgaaatagggctctgagccccagcctccccaaggggactgtagttcattattgtcatcattatgtcatgcatcatcatgcatttccctgtctacaacatgcactaagaaagctcacagatgcacaaggctattatctataagaatacaaaacattgctataaaccaataacaatacaggcagcattcagctttcctcacagcatttaataatagtaagaataagaggtaactttactgagtyatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcgccatggccacaggaattatgttcataccacctcccaccatggctttcccacagcaagtgctcacctactcttatgaggagccaatatattcagagattgaaaaatctgaatattgcttatgttctgatcagaggtctagctgcttca

SEQ ID NO: 76712 - DNA, 601 bp, Human
agaatggattgttacctatgctgacattcctgggagagactgggtgagcccactgctgctatgaagatgttcacaagccttccacgaaatagggctctgagccccagcctccccaaggggactgtagttcattattgtcatcattatgtcatgcatcatcatgcatttccctgtctacaacatgcactaagaaagctcacagatgcacaaggctattatctataagaatacaaaacattgctataaaccaataacaatacaggcagcattcagctttcctcacagcatttaataatagtargaataagaggtaactttactgagtcatctgttggattttaatcttcactacagccctatgagttagggtcattctcatctcatctttttacagataagaaaaccgaagtgcaaaaagtcaaatgaattacccaagccatgcagctaataattggtacaggcaggctctgacaccagcgccatggccacaggaattatgttcataccacctcccaccatggctttcccacagcaagtgctcacctactcttatgaggagccaatatattcagagattgaaaaatctgaatattgcttatgt

SEQ ID NO: 76713 - DNA, 601 bp, Human
gagctcaagaaatcgagaccatcctggccaatatggtgaaaccctgtctctactaaaaatacaaaaaaataactgggtatggtggcgcgaacctatagtcccagctactcgggaggctgaggcaggagaatcgcttgaatctgggaggcagatgtttcagtgagctgatagggctctgcactccagcctggcgacagagcgagactctgtctcaaaaaaacaaaacaaaacaaaaagaatgtacatacgtgaagcagctttgcgagtagaacaatttgcactcctggtcagttggacaacrgctgtttgctaagaattctgactttctgtgctcttgcctgcaactttcccacctctgagacagcctccagcttgatactgtattggctgttaatgctcatttataattaagctgagaacacacatacacatagataaagcataggggaaagtccagtgtgttagcatacaaagccattccgaggacccagaacagtccttgtttaggaagggtggtcctgacatcagaaatgataggattttcctggctgacaaaaaggaacagacccataccaatctggggattagaggcccaagggag

SEQ ID NO: 76714 - DNA, 601 bp, Human
gtctacctagagataactcctcttcccccagccccaccctgctagaacacaaagagataactcctcttcccccagccccaccctgctagaacacaagctctgtgagagcagtcgttgtcagggattgcatctccagtaactagaatggtgtgtggcacatagtaggcctcctggagatgttttgttaaatgatgttatttttcataggatagaagtagtaactcacctccttaaacttttttatgctggcaggagatgttgattgaatatcagttggcatgcatactacaccaatatccaggcaagtcattaaaaccctaggtcccagatacggcatccagcctgtgacctgccacaagtggtaacatcaggctaaatttaggccaccagggcaaaagtgccatgaatacatcagaatgtacatatatggctgggtgcagtgactcacgcctgtaatcccagcactttgggaggccaaggttggcggatcatgagctcaagaaatcgagaccatcctggccaatatggtgaaaccctgtctctactaaaaatacaaaaaaataactgggtatggtggcgcgaacctatagtcccagctact

SEQ ID NO: 76715 - DNA, 601 bp, Human
cggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaatatttgctgagagcttactatgtgctattatttttatttcatcaatgttatatacatgccatatagagctataatttgagcacgtgtatatgtatyatatttttgtaataaatctgtccaaatgtatagccatacacattgctaccttctttgacaaaagatttaagaaaggtatgccataaatatgtgtgagcagaccttcataataattttcaggaggtaaaataaaaaggaaaaggaatatttatgctatttggaaagagaagtcttagtttccatgaaattgttgattaaatgagctgccttttctggcttgcttgctgagatgatgataaaatggtcagatgcctgcactgggctcagtgggagaaatttgactttagaattctagactta

SEQ ID NO: 76716 - DNA, 601 bp, Human
aaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtgcaaagaatcaagcaaatatttgctgagagcttactatgtgctattatttttatttcatcaatgttatatacatgccatatagagctataatttgagcaygtgtatatgtattatatttttgtaataaatctgtccaaatgtatagccatacacattgctaccttctttgacaaaagatttaagaaaggtatgccataaatatgtgtgagcagaccttcataataattttcaggaggtaaaataaaaaggaaaaggaatatttatgctatttggaaagagaagtcttagtttccatgaaattgttgattaaatgagctgccttttctggcttgcttgctgagatgatgataaaatggtcagatgcctgcactgggctcagtgggagaaatttgactttag

SEQ ID NO: 76717 - DNA, 601 bp, Human
caatatggacactttggggaagttatgaagcgtctcccattcccgcttgaggtactcaatagagcccacaaacacaatgtgcttgagctcatggtaatgaaagttgctggcacggagcggcatcaccaggttccggaggccgatcagggctgagctgacgtcgccaaagatgcagaccacgacatggccactcaggacggtcatggcagcttcacttcgagtctacaacagggagaagtgggtaagagtcagagagaagactgcatagggctgttgtaaggagtgaaataaatcatttgtrcaaagaatcaagcaaatatttgctgagagcttactatgtgctattatttttatttcatcaatgttatatacatgccatatagagctataatttgagcacgtgtatatgtattatatttttgtaataaatctgtccaaatgtatagccatacacattgctaccttctttgacaaaagatttaagaaaggtatgccataaatatgtgtgagcagaccttcataataattttcaggaggtaaaataaaaaggaaaaggaatatttatgctatttggaaagagaagtcttagtttccatgaaat

SEQ ID NO: 76718 - DNA, 601 bp, Human
gtccgatctttttctcactcctttaaatatttattgagtccctattgtgtcaggcattatgtaaaggcacatggtggcatctaatgagtaacatgtactgcttgtggatagattcttgtgtgttctttaatgaattatattacttggctctttttccccccatttctgaggttttggaagctgataacagaaataatacattttagctttgtaagtgggggaaaacccagacttcttaacatgtagagaaatccatgttcctcagtttttgtttttgtttttgtttttgtttgaggcaggstcttgttctgttgcccaggctggagtgcagtggtgctttcacagcccactgcagcctccacctctcaggctcaagtgatcctcccaactcagcctctcaagtagctggaactacaagcacacgccaccacatcaggctaatttttttaactttttgtagagaagaggtctcaccatgttgcccaggctgctcatgaactcctgagcttaagtggtcctcccgcctcagcatcccaaaatgcagggattacagggattagccactgcacctggcccctgtttctcagtttcagggatgtga

SEQ ID NO: 76719 - DNA, 601 bp, Human
agcacatgacagaaagataaccatggaatcatataatcaaatcgaccatatttctggaatgagcaaagcatatatatgcttatgctctcctctgtgtatgactgtttgtctataggtgactattttcaactgcctgtgctcactaaggcagtgggtttttggcccagcatccaaaagataactgtccgatctttttctcactcctttaaatatttattgagtccctattgtgtcaggcattatgtaaaggcacatggtggcatctaatgagtaacatgtactgcttgtggatagattcttrtgtgttctttaatgaattatattacttggctctttttccccccatttctgaggttttggaagctgataacagaaataatacattttagctttgtaagtgggggaaaacccagacttcttaacatgtagagaaatccatgttcctcagtttttgtttttgtttttgtttttgtttgaggcaggctcttgttctgttgcccaggctggagtgcagtggtgctttcacagcccactgcagcctccacctctcaggctcaagtgatcctcccaactcagcctctcaagtagctggaactacaag

SEQ ID NO: 76720 - DNA, 601 bp, Human
gtttgaaatgacctgcaaagatgacagctcattcatatacatgaagaaagatgagtgaacgtgtacaagggcacacagagccgggcgcggtggctgatgcctgtaatcccagcactttgggaggccgaggtgggtggatcacctgaggtcaggagtttgcaaccatcctggccaacatggtgaaaccctgtctctactgaaaatacaaaaaaagtagccaggcatggtggtgcatgcctgtaaacccagctactcaggagactgaggcaggagaatcgcttgaacccaggaggtgaaggtygcagtgagccgagatcgtgccattgcactccagcctgggcagcaagagtgaaacttggactcaaaacaaacaaacaaacaaaaacaaacaaacaaaaaaggtcacacaggaggaaacatacacaaacacacaaaacacacacacaaataccaaatatcacacatatacccatctctctccacacacatacacacacagactcatgtatcctggtaaaataataaaccctttacaaagacactttcagaggtcaggggactatgtggaggagcacatgacagaaagataaccatggaatca

SEQ ID NO: 76721 - DNA, 601 bp, Human
ttgagtatgttaaattttggagggtttgaaatgacctgcaaagatgacagctcattcatatacatgaagaaagatgagtgaacgtgtacaagggcacacagagccgggcgcggtggctgatgcctgtaatcccagcactttgggaggccgaggtgggtggatcacctgaggtcaggagtttgcaaccatcctggccaacatggtgaaaccctgtctctactgaaaatacaaaaaaagtagccaggcatggtggtgcatgcctgtaaacccagctactcaggagactgaggcaggagaatcrcttgaacccaggaggtgaaggttgcagtgagccgagatcgtgccattgcactccagcctgggcagcaagagtgaaacttggactcaaaacaaacaaacaaacaaaaacaaacaaacaaaaaaggtcacacaggaggaaacatacacaaacacacaaaacacacacacaaataccaaatatcacacatatacccatctctctccacacacatacacacacagactcatgtatcctggtaaaataataaaccctttacaaagacactttcagaggtcaggggactatgtggaggagcacatg

SEQ ID NO: 76722 - DNA, 601 bp, Human
ctgtttaaccaataaactctgtgaagacataggtgaaggcccattttgtgaaaatctattgtgcttgagtatgttaaattttggagggtttgaaatgacctgcaaagatgacagctcattcatatacatgaagaaagatgagtgaacgtgtacaagggcacacagagccgggcgcggtggctgatgcctgtaatcccagcactttgggaggccgaggtgggtggatcacctgaggtcaggagtttgcaaccatcctggccaacatggtgaaaccctgtctctactgaaaatacaaaaaaartagccaggcatggtggtgcatgcctgtaaacccagctactcaggagactgaggcaggagaatcgcttgaacccaggaggtgaaggttgcagtgagccgagatcgtgccattgcactccagcctgggcagcaagagtgaaacttggactcaaaacaaacaaacaaacaaaaacaaacaaacaaaaaaggtcacacaggaggaaacatacacaaacacacaaaacacacacacaaataccaaatatcacacatatacccatctctctccacacacatacacacacagactcatgtatcctgg

SEQ ID NO: 76723 - DNA, 601 bp, Human
attaatgtgtgcaatgcaaaagagatatggaaaggagttaagcttcagatcatataattttattgcatattttcagcaagaaaaaaatacacagggaaatgacctaattgtccaacaacataggaatggagaaatatacttttggacatgcacacagtgaaaatgtatgcaggaggtaaagaggcagagctggctctccatgcaggcattggtttagaagcctaagatagagggggaagtgaaaaaaaaagttctacagcagttaaaaaaaagtatagtttcatttatgtaaaaaaaaaamcccacaaaataaaattacatatatataaatgtatgtaaatttggaaggaaagcacaggaaaaatagccattacactaataatggtaattccctctgggaagggaaataggattcgtgggggtgaggggaaagtttgcttttcactttatatacttctatattgcttgaatattttataacaagaacatatttgtatattacaggtacatttaaaaaataaataagccagtaaacagattttttaacataaaaaataacaacaaaagacagtggaaaaatcccagatccaggaagtaacaa

SEQ ID NO: 76724 - DNA, 601 bp, Human
gaacagactgctggctagtgagagacagatgctcctctccactgctgaccaggggtctacgagaatcactgctgagcatagaaacacatcctttgccttcttctgtcatttgtgcggtcttagtccatttgggctcctgtaacaaacaccataatctgggtggctgatagacaacagatatttatttcccacagttctggagaacggaaagttcaaggtcaaggcgctggcatgttcagtctctggtgaggactttctcgcagtgtcctcacatgacagaagggacgaggggtctctctcrggcttcttttactttatttatttgtttgttggtttattttattttgttttagacagagtcttgctctgtcacccaggctggaatgcaatggtgccatctcggctcactgtaacctccacctcccgggttcaagtgattctcctgcctcagcctcccgagtagctgggattataggcacccgccaccatgcctggctaacttttttgtatttttagtagagattgggtttcgccatgttggccaagtggtctcaaactcctgacctcaggtgatccacccgccttagcctcccaaggcgtg

SEQ ID NO: 76725 - DNA, 601 bp, Human
tctgagctgatgtttgctgaccagcaagaagcagcttcatctgctttatataattgtcactgcagttttgcctgctgtatattaaaactgcatctcatagacccaactgtcacatcggatataccatctggcttgggatatgccaccttttctgtaattgtttttgacaacaagccatcacatcttgggtcttttcagaaagtgtctggtccagaatccctaggctgggtcagttctgacaccatgtgggctagaaaagtgacatcaaaagggagtgtgaaaagagaacagaagagaaaaragaggctttgttagtctaggagccctaataacatgcagtggcagctgtccaatgaaggctctactttctcaatgtgaatgcacatttttcatgctaaattatatcatcttaggacagctttccatagggttgcatgcatattctggcccaagagcatgacatttgtcctgagtccacatttctacccagtgaggttctagagacatggagacagttcttcagacaatgcagagcatgaggttccataaaggaccatagaatacataagagggaaagcaaggtgtcagtggccagaaatct

SEQ ID NO: 76726 - DNA, 601 bp, Human
ttcctataaatctttgatgactcccccaaatccaaacccttagcaagacaagtctacactctaggactgcaccatccaatatggtagccactggctatggatcactttaaatttttatatttgttaaaattaaattaaaaggaaaaatttaattcctaaatttcaagtgctccatagccacatgcattcaagtcatccacagatgccacctcttcttttttttttttttttttttttttttttgagatggagtcttgctctgtcgcccaggctggagtgcagtggcatgattttggctcamtgcaagctccgcctcctgggttcaaatgattctcctgccttagcctcccaagtagctgggactacaggggcgtgccaccaggccttgctaattttttgtatttttagtacagacggggtttcactgtgttagccaggatggtctcgatctcctgaccttgtgatccacctgccttggcctcccagagtgctgggattacaggcgtaagccaccgtgcctggccgatgccacctcttcttgaaagccttctcaattcctcaaaatacctaaaccaaggatccctttgtgttcctctatttc

SEQ ID NO: 76727 - DNA, 601 bp, Human
tctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattctctacttgaggctcttaacctttgttgaaatgtggagaaaggagggtgtccgcttatacgtggatgttcatttagtgtaactatagcttcaggtcaaagagggcgggaggaaagctgtgtgtgtgtgtgcgtatgtgtgtgtgtgtttttgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttcctctaccctctctttctgagatggtatacttctgtcctgcaattctcttgcctctctccctctctctgaggctctcctttgctcctagagcatgagcaatgggccagattgctagaagcaaacttttcctggattaaggacttcattt

SEQ ID NO: 76728 - DNA, 601 bp, Human
aatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattctctacttgaggctcttaacctttgttgaaatgtggagaaaggagggtgtccgcttatacgtggatgttcatttagtgtaactatagcttcaggtcaaagagggcgggaggaaagctgtgtgtgwgtgtgcgtatgtgtgtgtgtgtttgtgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttcctctaccctctctttctgagatggtatacttctgtcctgcaattctcttgcctctctccctctctctgaggctctcctttgctcctagagcatgagcaatgggccagattgctagaagcaaac

SEQ ID NO: 76729 - DNA, 601 bp, Human
tgtggatttgatcccagagttccactttaggaaggcccttttcgttctgctttttgtcatccagtaatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattctctacttgaggctcttaacctttgttgaaatgtggagaaaggagggtgtccgcttataygtggatgttcatttagtgtaactatagcttcaggtcaaagagggcgggaggaaagctgtgtgtgtgtgtgcgtatgtgtgtgtgtgtttgtgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttcctctaccctctctttctgagatggtatacttctgtcctgcaattctcttgcctctctc

SEQ ID NO: 76730 - DNA, 601 bp, Human
cctgtctttactgatcatttgaaaattaacatgcagaggtcctcaatgcattctgtcctgtggatttgatcccagagttccactttaggaaggcccttttcgttctgctttttgtcatccagtaatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattcyctacttgaggctcttaacctttgttgaaatgtggagaaaggagggtgtccgcttatacgtggatgttcatttagtgtaactatagcttcaggtcaaagagggcgggaggaaagctgtgtgtgtgtgtgcgtatgtgtgtgtgtgtttgtgtgtgtgtgtgtgtctgtgtgtctataaagcataaaatatggaaaaaaggcagtggacatatgtcttgggtttgagatcttggctcctccctcccctgggacattcgggacaggctcagcttttggttctccggcttctaccaaagttttc

SEQ ID NO: 76731 - DNA, 601 bp, Human
ccaatggagcagaagattaaatggccctttaagcctgctggctttgttctcttaaccacttggcaagtgacatgttgtccaggcactgccccattctggccgtcctctttacaacatttttctgtttgtttgtcaaatttctgcttcaaatcttcacagctcttgacacattccctcctatcccaacaaagatgaaacagtcactgctcaaaagaaatgatgcttttatcaccaaggtttatctagcctgtctttactgatcatttgaaaattaacatgcagaggtcctcaatgcattctrtcctgtggatttgatcccagagttccactttaggaaggcccttttcgttctgctttttgtcatccagtaatttagagatcctaatccacactgtctcacacaaagataaaagagaaatcacattttcttctttggaacagtaaaagacatctcagactttaggatagggaaggtgtaccctatgcccccaattaatgctatctctccaaggactgctgccatacttccaaagaaaaatgtcattctctacttgaggctcttaacctttgttgaaatgtggagaaaggagggtgtccgctt

SEQ ID NO: 76732 - DNA, 601 bp, Human
tgtgtgaggatacatgtataggtgcgtctgcaagaaacagtgagcagcctgggggtcaggaaagccaggcttgtagaagtgggagaaggcagagccctgggaaaaaggcaggtgtggaagggtggtgtggaagttgaagatggggtggtctgtccaattaatggaaaagccagatctgcagctgctcaccccaatgccgtccgctccccatctttgaacacaaagacagtgccgttcaggaaggacatgaatgcttccactaaaagactcatgaccccaatcctgacaaacaccatagctstccctctggagttacaatgcaaatcatataaaacacagatccctatgtaataaaaatcaagaacatgctggatatccttagttataaaggaccacagaactcatctctctaccaatctccctcccatcacaaagagcgtgtcagtaactctcctttagcaaagagacagtcagggataggaggctcgctgcatttgcaggctgtccatgctgttctggaaatatcttccttatgttgggctaaaatcctgttctccttaattattaaccattggccctggtttttgtccaatggagcaga

SEQ ID NO: 76733 - DNA, 601 bp, Human
catttagaaaacagctgcaattgctgctttgctgaaatacatctgcacctgagattcttgtgatgagattcatcttgggatgtccacggaagaaatgtaacagggcaggcccctttctgtacttgagatctgctcagagccctaagccagattttctttattgtttagtaagctcttttaatgaaatgtactactcttattatagaggactcaagataagatctaaatcacaaaccaataaaagaaaattattggggtagatatctaaagttactacctagaggctactccagtgtggtawttataaatctctaaacagttaagtataattgtctttctggtttttgggacggaagccaacagcagtttcagttacaatggaagaaaaatattttagcgctgagctttgttcgtttagtgggtataaagagaaatggcttctcccctatcaccatttcagaattgagagagaatattgtggtaatgaaatgttatatgggagcagctgaaaaaattcttctctgacttcaaggaggggaaatgtgtgtgaggatacatgtataggtgcgtctgcaagaaacagtgagcagcctgggggtca

SEQ ID NO: 76734 - DNA, 601 bp, Human
ccgggcacagcctgagtggggacatgaatctgctctgcatccatttggaaggaaaagatgattctgtctgtttttactttttcttctgcacatccactctccaagaaagtctttcatgcatggagggcataaaaccctccatgagttcaaaaagtagtccaagtttctcagtctcttattatagctgctgctgttgtttttccttgtttctcttgctaggaatacattactagaatagtaaatggcagggttaaagaggatctctcatgtgatgaaatatgctatataggaaaaattctcytaagttgaagtcatttagaaaacagctgcaattgctgctttgctgaaatacatctgcacctgagattcttgtgatgagattcatcttgggatgtccacggaagaaatgtaacagggcaggcccctttctgtacttgagatctgctcagagccctaagccagattttctttattgtttagtaagctcttttaatgaaatgtactactcttattatagaggactcaagataagatctaaatcacaaaccaataaaagaaaattattggggtagatatctaaagttactacctagaggctact

SEQ ID NO: 76735 - DNA, 601 bp, Human
acataggaatgtgtctggtgtatggctcacctgaaaaaaaaattacattttcttaaaaaaggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtggggacatgaatctgctctgcatccatttggaaggaaaagatgattctgtctgtttttactttttcttctgcacwtccactctccaagaaagtctttcatgcatggagggcataaaaccctccatgagttcaaaaagtagtccaagtttctcagtctcttattatagctgctgctgttgtttttccttgtttctcttgctaggaatacattactagaatagtaaatggcagggttaaagaggatctctcatgtgatgaaatatgctatataggaaaaattctcttaagttgaagtcatttagaaaacagctgcaattgctgctttgctgaaatacatctgcacctgagattcttgtgatgagattcatcttggga

SEQ ID NO: 76736 - DNA, 601 bp, Human
gtggtaactctccctcagcaggttgtcagggagattaaataagatattacataggaatgtgtctggtgtatggctcacctgaaaaaaaaattacattttcttaaaaaaggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtggggacatgaatctgctctgcatccayttggaaggaaaagatgattctgtctgtttttactttttcttctgcacatccactctccaagaaagtctttcatgcatggagggcataaaaccctccatgagttcaaaaagtagtccaagtttctcagtctcttattatagctgctgctgttgtttttccttgtttctcttgctaggaatacattactagaatagtaaatggcagggttaaagaggatctctcatgtgatgaaatatgctatataggaaaaattctcttaagttgaagtcatttagaaaacagctgcaattgctgctttgc

SEQ ID NO: 76737 - DNA, 601 bp, Human
gagaaaagcatagactttgaaatcagatgtttggagatcaactccatgtgcccttgactagctataaggctatgggaaaggtacctaattcccctgaatctctgctttctcaactgtaaaatgaaggtggtaactctccctcagcaggttgtcagggagattaaataagatattacataggaatgtgtctggtgtatggctcacctgaaaaaaaaattacattttcttaaaaaaggcattaaccaggcacacaaattttgaggagtaaactggcatgtgagagccagatgctaaaaccatragttcagtccaaccccaagaccacccaaaatctgctttctgtctctgaagctaagatttcccttcacgacagttgtcacaagccgggcacagcctgagtggggacatgaatctgctctgcatccatttggaaggaaaagatgattctgtctgtttttactttttcttctgcacatccactctccaagaaagtctttcatgcatggagggcataaaaccctccatgagttcaaaaagtagtccaagtttctcagtctcttattatagctgctgctgttgtttttccttgtttctcttgcta

SEQ ID NO: 76738 - DNA, 601 bp, Human
acatgtatagcttcaggcccattctcatcaggataacacttgccttttaagagacaggctgatgtgccgagaaaagcatagactttgaaatcagatgtttggagatcaactccatgtgcccttgactagctataaggctatgggaaaggtacctaattcccctgaatctctgctttctcaactgtaaaatgaaggtggtaactctccctcagcaggttgtcagggagattaaataagatattacataggaatgtgtctggtgtatggctcacctgaaaaaaaaattacattttcttaaaaraggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtggggacatgaatctgctctgcatccatttggaaggaaaagatgattctgtctgtttttactttttcttctgcacatccactctccaagaaagtctttcatgcatggagggcataaaaccctccatgagttcaa

SEQ ID NO: 76739 - DNA, 601 bp, Human
agaaccgttgaaaacaaacttcagccccttaggtgcaaggaccagtttagaagtgaggctggcacaccttgagcactttcatccccttgagtgtttgtcctgggggtgcccccatgacccttgaaagtacatgtatagcttcaggcccattctcatcaggataacacttgccttttaagagacaggctgatgtgccgagaaaagcatagactttgaaatcagatgtttggagatcaactccatgtgcccttgactagctataaggctatgggaaaggtacctaattcccctgaatctctgytttctcaactgtaaaatgaaggtggtaactctccctcagcaggttgtcagggagattaaataagatattacataggaatgtgtctggtgtatggctcacctgaaaaaaaaattacattttcttaaaaaaggcattaaccaggcacacaaattttgaggagtaaactggcatgtgagagccagatgctaaaaccataagttcagtccaaccccaagaccacccaaaatctgctttctgtctctgaagctaagatttcccttcacgacagttgtcacaagccgggcacagcctgagtgggga

SEQ ID NO: 76740 - DNA, 601 bp, Human
agactatggagacaacaggggcactaacctcatgcataggatgcaaaccaaactgacatgcaggatagggtagttgacctatccttatccagaatttcatgaggtgtcttagagggtccatgggattacaagacttcctttacttctctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaamatgttatttaagtgtcttcacaaagaaagtaacagctaggtctcaaatattccactctcttccttacagctccgaagtcccatctatattcacaagaaaaacggaaaagaaagactccaacagtcatactgttcacagagacaggctaagcacagtgcttcacattgcccccagatttactcatttgtccagtggtagtagcaagaaagactgaagccaacagaatcctagtatctctcattgttggaacagctagggtcaaggggctcaaaaaatggggattcacagagacaagaaccg

SEQ ID NO: 76741 - DNA, 601 bp, Human
tgtattgaatgaaatggctcacactctgcacaaggaatacactgaaatgttccaagccctgtatccttaagtatgtgtgtcaaagtcattccatacaacttattttatgtttctgtcccttttgcctgtagaccccattacttctatgacagcatagactatggagacaacaggggcactaacctcatgcataggatgcaaaccaaactgacatgcaggatagggtagttgacctatccttatccagaatttcatgaggtgtcttagagggtccatgggattacaagacttcctttacttytctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaacatgttatttaagtgtcttcacaaagaaagtaacagctaggtctcaaatattccactctcttccttacagctccgaagtcccatctatattcacaagaaaaacggaaaagaaagactccaacagtcatactgttcacagagacagg

SEQ ID NO: 76742 - DNA, 601 bp, Human
ggtgaagacaaaaatgcactgaatagctggctagatttatctgccagcttgaggcatgtgtgctatcttcacagcaggtgtattgaatgaaatggctcacactctgcacaaggaatacactgaaatgttccaagccctgtatccttaagtatgtgtgtcaaagtcattccatacaacttattttatgtttctgtcccttttgcctgtagaccccattacttctatgacagcatagactatggagacaacaggggcactaacctcatgcataggatgcaaaccaaactgacatgcaggatarggtagttgacctatccttatccagaatttcatgaggtgtcttagagggtccatgggattacaagacttcctttacttctctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaacatgttatttaagtgtcttcacaaagaaagtaacagctaggtctcaaatattccactctcttccttac

SEQ ID NO: 76743 - DNA, 601 bp, Human
gagaataggtgaagacaaaaatgcactgaatagctggctagatttatctgccagcttgaggcatgtgtgctatcttcacagcaggtgtattgaatgaaatggctcacactctgcacaaggaatacactgaaatgttccaagccctgtatccttaagtatgtgtgtcaaagtcattccatacaacttattttatgtttctgtcccttttgcctgtagaccccattacttctatgacagcatagactatggagacaacaggggcactaacctcatgcataggatgcaaaccaaactgacatgmaggatagggtagttgacctatccttatccagaatttcatgaggtgtcttagagggtccatgggattacaagacttcctttacttctctctgattctacagctgtggtttccccactataagacaatttctctggaccattttctgagcctaggctttgggcgctacagtggtctcttcattctcatctgctgtcacggaaacttccgcttgagcatggaaggagtaaataaaacctgaacatgttatttaagtgtcttcacaaagaaagtaacagctaggtctcaaatattccactctct

SEQ ID NO: 76744 - DNA, 601 bp, Human
ctgccctttgttgaactttggaggtctcagtcctacagccttgggccctgggttggtactgtgtaatagtacattcagcgaggccagtcaaaggttgagggccaggagctattagtaaaggttaagggaatagtacagtttatattagagacaacctggccatctgataaaggctcctccagacaagtgcaacatctttgatctctgtaaaccttgtccagtgcccagttgtcaaatgaagggagactaaatcctggagggaaagtgtaggtttttaatacaggtatttggctgctttatstcatttgagggcacgttaagagagaacaggctgcaaacaacagatagcaggattaaatcatgtattcatgtatccatcccctccacaaacctctactgagtgtctactaggtgtgaggtactgtgctaagcatttagaaagatttctggcagttggcgagcatgaagaggtcagcaaaacaatagaacaggctcttctttggaggatctactcaggttaacagtgcacccacctacaagcatttcctttgacatagtgagccctttaagtaccttggttataccattagtacacaaatag

SEQ ID NO: 76745 - DNA, 601 bp, Human
taccgctgagaggaatgttcatttctacatggccagggaagctctcaggaagcattcacagctccctggagcagaaagcagagatattttctgccctttgttgaactttggaggtctcagtcctacagccttgggccctgggttggtactgtgtaatagtacattcagcgaggccagtcaaaggttgagggccaggagctattagtaaaggttaagggaatagtacagtttatattagagacaacctggccatctgataaaggctcctccagacaagtgcaacatctttgatctctgtaamccttgtccagtgcccagttgtcaaatgaagggagactaaatcctggagggaaagtgtaggtttttaatacaggtatttggctgctttatgtcatttgagggcacgttaagagagaacaggctgcaaacaacagatagcaggattaaatcatgtattcatgtatccatcccctccacaaacctctactgagtgtctactaggtgtgaggtactgtgctaagcatttagaaagatttctggcagttggcgagcatgaagaggtcagcaaaacaatagaacaggctcttctttggaggatcta

SEQ ID NO: 76746 - DNA, 601 bp, Human
ccattcattcagggttgccatgtatggttgtgaaggttgggcactacacagtagctaatctaagtgggtaccactcatatcaataggcattgtatatttgcatatttatgacaatattttttcccagcagatgacagaaaagtgtattgttcaaacatattagtagattatcaccatttttttcagcagatgaaaataaggtgtcttgagaaaagagtgactttttctggcttacttaaaggtactgtatggacaatagaaagtcctgtatctcattgaattctcatagtcatttgataarccaggtgcatttagtattcttagtgagaaaattgagataaaaagaggtaaagtaattttcccaggcctagtaagtggcagatctgggcttcaaacccaagctgtcattccagacccatgtgtgccatgactgaacttgactgcaaagtgctatttctacagcctttgatgtttaataacctttctgcagccattatgtctttgtattcatacactgatccctcggtgttttggggtggggtcatttaatatatagatatatagatgaggaaatgaaatctggaatctttattatgtcaaa

SEQ ID NO: 76747 - DNA, 601 bp, Human
ccaatctactgaacgggagaaaatattttaaaaccacctagccaataaagggttaatatcccatctatataaagaactcatatactcagtagcaagaaaataaataacctgattaagaaatgggcaaaggaacctaatagacatctttataaagaagatatacaaatggccaacaagtagatatgaaaaggtgctcaatatcactaatcatcagaaaaatgcaaatcacaataagatatcacctcatacctgttaagattgctattattgaaaagacaagtgataacaagtgttggtgagrttggagagaaaagtgaacccttgtacactgctggtgggaatgtaaattggtacagccctatagaagacagtatgaagtttctataaaaaattaaaaatagaaccaccacatgatttagcaatcccacttctgggtatatatccaacagaaatgaaatcagtatctcaaagagacatctgcacctccatgtttattggagcactattcacaatagccaagatatagaaaccactggtgtccattgacagatgagtagataaagaaaatatggtctgtgttgtgtatgtacctgcacatata

SEQ ID NO: 76748 - DNA, 601 bp, Human
acagctccaagaggggcttcaaagtactgctgtatttatctctgggacatgagggaacaggaagcattttgatttaatatttcataagatagagacaattgcttccttgcatggtatatacttaatgctcacagaaatgagttttttttaaaaaagtttcaatatcttaaatgcaaataaataaataaataaggagacacacctgcataataggaagggcttcctttggaaatatggaatagacccatataatcccaataaagagaaagccaccacgaatttataatcacctaggggcctrttaaaagtagttttatagattaagtgtgaaacctcaaccctgatgttattattatttaccttccttgcttgcctttaggcccatggcctgattgattttcaaaattcttccatttcctatgctgattaggtattcaaagaattgtttgtgcccacctgccttgacctctcaaatggacaccccctggtttattttcccagctcccactagctccctgctgggaaccatgtggaagtttgtgaatttctcatgtatcttgcattttcacaatgcccattatatgctttccaaatctcctag

SEQ ID NO: 76749 - DNA, 601 bp, Human
ttggagatgggaggacgggaaaattgcaaactttatctttattgctcttacttatgttatttgaattaatctccttgaaacagaagaaaggagatataaaattttctttttgaaatgctacgggacttaaataagcaccagaattatttattcagaaaaatacacacacacacacacacacacacgaacacgcgcgcgcacacacacacacacacacacacatacacacacatatttagacctaaagagagaagaaatatattccagggaagagacttcctgcctccatgcttcctaataraatcttccccacattggaactcagaccccgcccccaacactggccaatgcttggtgtgttgtcagggagtagaatggtatcttattctttaaatggaacttttggaacataaaacacattccaataaatgtgagcagaaaattatgaattcattaaactactttggtatcttgtgctatatataatatttatattccgactactgtaaaatatgctttaatatctttaggcaactataaggacttaaatatttataaaatggctaaagataaagtatggccctcttattcctacatacag

SEQ ID NO: 76750 - DNA, 601 bp, Human
aaatgtaaccactttttcattataaacagtttctttatgttcttggtgctatgggctttgtttttcagcatttgtcatgtagttcaaatgtccttttacatttaaaacaccaaatgccaaatgggccccagttgtttggtttagtatgaattgatggccagcacagcagaaaccagaactccaaaatcacgagcaaagtataacatccatatcttaagcacacagaaaattaagtagctgtaaaagatgggtttgccaagtgatccaaggccttgccatgaaattcaggaaagcagaatcrcatcaacaactttcagccagctatctctgaatggttctagagacaagacgcctggcccaagatagcaccaaggttccaaacagttgatggttctttaaaagaaagaatctttttttcttaagtgttgaagtgtttcctgtacatacgtttatgctggcagatgaataggaaactgggatcttggatcttggggtcaggcattcccacatacatacacacacgaatcttcactagatgagggtttgatgctggtttgactctgagcatctctctgtacagcgtggtcaataacttttgacc

SEQ ID NO: 76751 - DNA, 601 bp, Human
catctttaattcttctgttttatcttcatatacccactggacttcccaatttcaatatggcacagcttatgctaacctttctttattgtttttatttattcttaattcctgttctgggaccctccctctttgctgccaccacaagaggacaaaggctgttttgccactaacatgggatctcctctttcatgatggatcacatttccagtaaactagaggcttactatgccagggaaaaggcagatatatacattacaagacaatgatatcaaggggatactaataaaacacacagacatcycccctcatgctgccaagactatataccattttgtttccattacatcaatttttttctccccttttgcaagcattaatcaaagaaacgtgaagagctcattaaagtgatagattgactgaaaatgtaaccactttttcattataaacagtttctttatgttcttggtgctatgggctttgtttttcagcatttgtcatgtagttcaaatgtccttttacatttaaaacaccaaatgccaaatgggccccagttgtttggtttagtatgaattgatggccagcacagcagaaaccagaactc

SEQ ID NO: 76752 - DNA, 601 bp, Human
taatgtttaaatgttgttaagcatctttaattcttctgttttatcttcatatacccactggacttcccaatttcaatatggcacagcttatgctaacctttctttattgtttttatttattcttaattcctgttctgggaccctccctctttgctgccaccacaagaggacaaaggctgttttgccactaacatgggatctcctctttcatgatggatcacatttccagtaaactagaggcttactatgccagggaaaaggcagatatatacattacaagacaatgatatcaaggggataytaataaaacacacagacatcccccctcatgctgccaagactatataccattttgtttccattacatcaatttttttctccccttttgcaagcattaatcaaagaaacgtgaagagctcattaaagtgatagattgactgaaaatgtaaccactttttcattataaacagtttctttatgttcttggtgctatgggctttgtttttcagcatttgtcatgtagttcaaatgtccttttacatttaaaacaccaaatgccaaatgggccccagttgtttggtttagtatgaattgatggcca

SEQ ID NO: 76753 - DNA, 601 bp, Human
tgaagttctgagatggaagtgatcaggccaaggttacaaagcaaaggggctttaaaagaacagggcccagagagagttttcaggcttcctagttctctgttatttcagcctcccaccatcttgtaagagctactcaatctcagagcagaggccatttacataaagcacacatgggcagtgaagagcccaagaaacccacaatgccccatgcacataggggaagggaggagcagtcagagctggtttccaacacagagggaaagtggcacctgctgatgcccatccctgctcccaccagccytacccacttcagaaacgctgttccccctcttccctcccaacccagctcctgtcgtttctttacctcttccaggacgtctgccttgaataacttctcacatttagttactttatgaagatgttttcctctgcctttttttccatcccctttattcgttattttaaaatgtatgaattattactaaatatatacaaattactacatattaatgtttaaatgttgttaagcatctttaattcttctgttttatcttcatatacccactggacttcccaatttcaatatggcacagcttatgct

SEQ ID NO: 76754 - DNA, 601 bp, Human
aaagcaaattaaaccaaccaaacaaacaaaacttctctatagttatttgcccattaagattcgtaaaatatattcagctcttagacaagtctcacacacatgaaacaaatatatttacaggacttgtctctccaagcagacagtctctttccttagaattaacttaaagatgtagtcccagctatttgggaggctgaggcaggaaaatggcctgaacccgggaggcagagcttgcagtgagctgagattgcaccactgcactccagcctgggcaacaaagcgagactccgtctcaaaaaaraaaaaaaaaagaaaaaaagaattcgcttaaagagcttactgtgtaagatgtttctcagaagggttggttaaggggaggaaggaagaaaaagacaaagctagtaacaactcaaacacacctaaaactacagatttggagagaaacctaatattcacccggtctaatgtctccgtttacccaagagctcatggtatcattgctttctccacaacatctcaacttctcagttttaccttatcttaattcatcttacaatttaaaaataaggccagatgcagtggctcatgcctgtaatcccag

SEQ ID NO: 76755 - DNA, 601 bp, Human
gcggtacatttttttagagactgtctttgattagcacctttgcaagttgactccacccactgaataaagtgccccatcctttttagagtttacattttgggtccaacccaaaccaaagcaaattaaaccaaccaaacaaacaaaacttctctatagttatttgcccattaagattcgtaaaatatattcagctcttagacaagtctcacacacatgaaacaaatatatttacaggacttgtctctccaagcagacagtctctttccttagaattaacttaaagatgtagtcccagctattygggaggctgaggcaggaaaatggcctgaacccgggaggcagagcttgcagtgagctgagattgcaccactgcactccagcctgggcaacaaagcgagactccgtctcaaaaaaaaaaaaaaaaagaaaaaaagaattcgcttaaagagcttactgtgtaagatgtttctcagaagggttggttaaggggaggaaggaagaaaaagacaaagctagtaacaactcaaacacacctaaaactacagatttggagagaaacctaatattcacccggtctaatgtctccgtttacccaagagct

SEQ ID NO: 76756 - DNA, 601 bp, Human
aactactacagccactatggaaaacagtgtggagattcctcaaagaactaaaagtagatctaccattttatccagcaatcccaccactggttatctacccagaggaaaagaagtcattattcgaaaaagatacttgcacacgaatgtttatagcagcacaattcacaattgcaaaaccatggaactaacccaaatgcccattaatcaatgagaggataaagaaactgtgagatatatatatatatacacacacacatatatatatcacatcacacacacacacacacacacacacacacayatatatgtgagtgaatactacacagccatacaaaggaattaattaacagcatttgcagtgacctggatgagactggagactattattctaagtgatgtaactcaggaatggaaaaccaaacatcatatgttctcactggtatgtgggagctatgctatggagatgcaaaggcataagaatgatacaacagacttcagggacttaggggttaagagtgggagggagacgagggataaaagactacaaatatggggcagtgtatactgcttgggtgaaggatgcaccaaaatctcacagatc

SEQ ID NO: 76757 - DNA, 601 bp, Human
atgttggcatggatgcggtgaacagagaacacctctacactgctggcggcaatgtaaactactacagccactatggaaaacagtgtggagattcctcaaagaactaaaagtagatctaccattttatccagcaatcccaccactggttatctacccagaggaaaagaagtcattattcgaaaaagatacttgcacacgaatgtttatagcagcacaattcacaattgcaaaaccatggaactaacccaaatgcccattaatcaatgagaggataaagaaactgtgagatatatatatatayacacacacacatatatatatcacatcacacacacacacacacacacacacacacatatatatgtgagtgaatactacacagccatacaaaggaattaattaacagcatttgcagtgacctggatgagactggagactattattctaagtgatgtaactcaggaatggaaaaccaaacatcatatgttctcactggtatgtgggagctatgctatggagatgcaaaggcataagaatgatacaacagacttcagggacttaggggttaagagtgggagggagacgagggataaaagactac

SEQ ID NO: 76758 - DNA, 601 bp, Human
cgtcccactgtttttttcctgattgactgataccaaaggcaacttgcccggtttagctaattggatacagcatttaagggttggggaaagggagtggaggaaagtacagaaaaagaagagagtgagggaataacagaggaaacattctcaagtaaagggaccccggaccacaggtagtttgcatttgtcttgggggaagaggccactctacagttttgcacactcactaatggtaacagggagtgccatggccaggttagaagttagattctattgtccaaccaacatggccctcaaaacyccatcattttgggggccagaatggcatttgctgaaaatggcttttggctgagatattcaactacgatacgttaaatgtcaagttattacacattagcccagggcttctaccttgttcccaaaatgggtttggcttagatccgaggctttgtatatcagtggaggactcagattgtaggagctgtccagacagaatgctcaaaagaggttcttacagtaaaaatcaccagaaagaatccgtgaactaagcctttcctcctttcctctccattcccaattgaatgccccaatcgcaaatcca

SEQ ID NO: 76759 - DNA, 601 bp, Human
ataaagaaaaataaacagctggagggaaagtgccatcttaggtttcttatcttaaaattttgatattctcctttgacttcctctaagagctgtgaagacatgtcattcaaactgacagtatgttggaagaggagtagaagggagaaggcgggagagcggggtgacaaaaaaaagtggggaaaaaaggctcaggccagagaaaatgaattagagcaaagatgctttggaaacaactgccaggtcagatgggtgtgatcaaaggtttactgatgctgtgtggggaaaaaatcattaagaaagkccagaacaagacagtcgattccaaccagagccacaaataaaacacattcaaagcagtgccatggggtagcctttctgttacagccggtgaaataaaaacaagctgatgatagttggaaacaccaacaacagaacaaaaggagatactgatgtgaaggaaaacagtgcttcttacccagttcagttatcattagaatgtgcgtcccactgtttttttcctgattgactgataccaaaggcaacttgcccggtttagctaattggatacagcatttaagggttggggaaagggagtggagga

SEQ ID NO: 76760 - DNA, 601 bp, Human
ggattctgaaatgctgctgtaggtttgtgagatggagatgtttggattaattttccaaccagaggcgtggaccacatgagccctgggtctcttattgccctccagttctgaggagagcaatccagaaacctagggcttttaaacaactacactaaacatgaaaaagatacccctcctatggttggaaacagaaaatagtgtgatactccctgacctgagtgaatttgtcctgataaatagctatacctacaataatgcactgctgagtggtggacaatttattccttggtttctagacatstcgcaagcaagattactgtgttgaaagcctgctcccttattttgaaatatatttttgggccaagaaaatggggtgttcatttcatttgtgagtcatgtgaaggcaggtgctcccacctctctatccacccctctgctgagcagcacttttgctgtctctatttagaagatcaatccccagttctgagacttgctgctgatgggtgcccttcatggagttattaaccaagtcacggggaagtggggaagaacctaacaaatgcagtcacgactggaggcctttatcgtccacctgagtcca

SEQ ID NO: 76761 - DNA, 601 bp, Human
aaagcatatgtggtcaaatacaattggaatagtcaggtgaaacagctgtaacacagtcctttcttgtgagactctgaggagcctttgccatgctaacatcaattgagagtctccaagtagatgaaaagtggaatgtgctacacagctttgaaagcttgtgtggccttggtgccctctgtgtctcttaaaattcattatactggcctggcataatgcagaacacatctcagaacatgtagataaataagaagtatttgtgggggatgtgggaggtgaagtggtctgaggagggtggtatagyggctagagaaataggtttcaaggcagaagacaagggtggtgtgagcacctgaaagattctctgaacacaaggaagaaatctggtgtgggacaaaggcttcaggagagtcaatgatgctaatcaaataccagaattgttgccttaggtttggggcaccaagcttttccttttctcgtctactaatgacaaattaagatatcctagttagtcagcggcacgtgaattccaaatagaaaatgaaattcccggcagtgaggattctgaaatgctgctgtaggtttgtgagatggagatgtttgg

SEQ ID NO: 76762 - DNA, 601 bp, Human
tggaaacactgaaggtcttgctcaggggtctttcaagaggtagcttttcctcacctcccttcacttgtccaaagggatgttgtaggccactgtttagtctttctgttttgtgaatcagaaaatgtaaactggagacgacatatggaagaatgtggttttagttacttgtaatagccaccaatggtgtgtgtggcaatgctccgaaaagcacagcatctgttacctcttatcaggaagatggggaagggttggtaccagatatggaggtgaagtgactccaagtagggggaggggactcccrattgccagtgagctagacatctggggtcataggaaaagcgctccaagagaccagccagggtccagtgaataccttgtataccgttctgaaatacccagtctcagaaggagagcaagcaatgctactcaaggcctatttcacagaacagtaattatgtgggtgctaagaggtacccacgtaatcaccccaaagcatatgtggtcaaatacaattggaatagtcaggtgaaacagctgtaacacagtcctttcttgtgagactctgaggagcctttgccatgctaacatcaattgagagtct

SEQ ID NO: 76763 - DNA, 601 bp, Human
tgattagttgtgtcactcagatgtctttaacttattaaaaattaaatgacaaattaatttccattcccatcttggctttggaaattatcagttttgcagagcaagtaataggggaaaagtcggtggggggatgggagaagggggcactcaaaatttctgaaataattattgtgattttaggaagagaacagatgaggtttcctttccctgattcctttctaaatgtatcaacagctaattcttttttctagagtgattgttttaatttttaagcaactttcttgataactcttcttttttwaaaaaaaaaaacttttgtttactgtatgaagcagaataaatgatactagcatgaaaggctaggcatggaattagtattttaaaatgacatcatcttgtttccccagagaaaaattctaatggggaaaatctttgctctgttcttccaaaattggtcacatttgggtccccattgtttaagcagcaattgaattgcaggctagtggtgaaagtccaaaatccaggctctgacaactgggcttcagtccagcctgtgctgccaacttccttgggcaaagcatttcatcattctataccttag

SEQ ID NO: 76764 - DNA, 601 bp, Human
atttccatctgaggattcctcaaggactcctcccgcatgtacgtgcaggctgattagttgtgtcactcagatgtctttaacttattaaaaattaaatgacaaattaatttccattcccatcttggctttggaaattatcagttttgcagagcaagtaataggggaaaagtcggtggggggatgggagaagggggcactcaaaatttctgaaataattattgtgattttaggaagagaacagatgaggtttcctttccctgattcctttctaaatgtatcaacagctaattcttttttctasagtgattgttttaatttttaagcaactttcttgataactcttcttttttaaaaaaaaaaaacttttgtttactgtatgaagcagaataaatgatactagcatgaaaggctaggcatggaattagtattttaaaatgacatcatcttgtttccccagagaaaaattctaatggggaaaatctttgctctgttcttccaaaattggtcacatttgggtccccattgtttaagcagcaattgaattgcaggctagtggtgaaagtccaaaatccaggctctgacaactgggcttcagtccagc

SEQ ID NO: 76765 - DNA, 601 bp, Human
cactgggattggcctgggtagttcccggggtcccaggccctaaatctaggtccacacccaataggccctgtttaatacacaggaaaccccaggtgggatggatgcctggctgtctcctgctgcttgctgacaaggacttgctctgaattttgagttgcatggggacgcccacgttctccctttcccatcctaaacagctcaatcttttatatgcttgcattcaagcagatgcagcattggatgctgtatttcatttccatctgaggattcctcaaggactcctcccgcatgtacgtgcagrctgattagttgtgtcactcagatgtctttaacttattaaaaattaaatgacaaattaatttccattcccatcttggctttggaaattatcagttttgcagagcaagtaataggggaaaagtcggtggggggatgggagaagggggcactcaaaatttctgaaataattattgtgattttaggaagagaacagatgaggtttcctttccctgattcctttctaaatgtatcaacagctaattcttttttctagagtgattgttttaatttttaagcaactttcttgataactcttcttttt

SEQ ID NO: 76766 - DNA, 601 bp, Human
agattcctgatacccttttatcctaggctagaatgcagaagacatgctgctcccatactattgcatccaaacatgccttagtcacactatcccaaacatttttgtgtgcatttcaaaggagatgagagatggcttgtttaaaaatttcaaatcaattcactttgaattctcatttgaatttccaagaactgactacctactgatgatatagatgcttgtgcaactcaaatccagatgggcccccacctccaccctgtggctaccatatgcccctttggctgtgttgaaaagaagttctccrgtgctcaaaccgattttattccttggaaccagggctggtttcatgggtgttcagcctatgtggttgcacagggctgtactcagacacatctctgttgttttattttattttattttattttttgagacagggtctcattctgtcacccaggctggagtgcagtggcgctatatcatctcacagcaacctccacctcccaggctcaagcgattctcaggcctcagcctcccaagtagctgggattacaggtgcacaccaccacacccagctaatttttttatatttttagtagagacaggg

SEQ ID NO: 76767 - DNA, 601 bp, Human
ttactgatataacttcgtttctggcaaacaggccagctctctgatattaaagatgagaacatggaatcatatcttctgggtaccccaactcatctacccactaagctcccaaatattatttaagatgtgtgttcatgaaagagagaaagagagaggataagtgcacacaaacacataaatatatatacatatatgtacatgcatatataccaaaaaaatctgcttctttgtaattacatgtgatcttaagaaatacgtatctgctctgtgaaagatttttatatgcctttgccattctccrattagcagaaagtcataaggagtaacatcattcccatttaacagtagaaaaaatgtgcaagggctgccggtgagccaggaccagaagctacaagtcctaattcatggcccagtttccctcctccaagtcactgcctttgttctgaaaatatgaatgcactggacatgcaaactcctgccctgggcattgtggtgcagtgggcagagcaaagacacacctgccttaactggctcacattgaaatttctctctagctcctgggggatcctgcgcatgggtctctccataggctggcattcac

SEQ ID NO: 76768 - DNA, 601 bp, Human
cataacaccaggttcaagggtttggcccttaatgaaagtacaggaaagacagtaaatcatgtgaacccacattccagacggtcacaccctccagtcttactgatataacttcgtttctggcaaacaggccagctctctgatattaaagatgagaacatggaatcatatcttctgggtaccccaactcatctacccactaagctcccaaatattatttaagatgtgtgttcatgaaagagagaaagagagaggataagtgcacacaaacacataaatatatatacatatatgtacatgcatrtataccaaaaaaatctgcttctttgtaattacatgtgatcttaagaaatacgtatctgctctgtgaaagatttttatatgcctttgccattctccgattagcagaaagtcataaggagtaacatcattcccatttaacagtagaaaaaatgtgcaagggctgccggtgagccaggaccagaagctacaagtcctaattcatggcccagtttccctcctccaagtcactgcctttgttctgaaaatatgaatgcactggacatgcaaactcctgccctgggcattgtggtgcagtgggcag

SEQ ID NO: 76769 - DNA, 601 bp, Human
agggttatggagcaataaattgtttatgtaactaaaatcacatggcattaggttagcttggactgatagagaactcaggcctctccataacaccaggttcaagggtttggcccttaatgaaagtacaggaaagacagtaaatcatgtgaacccacattccagacggtcacaccctccagtcttactgatataacttcgtttctggcaaacaggccagctctctgatattaaagatgagaacatggaatcatatcttctgggtaccccaactcatctacccactaagctcccaaatattatytaagatgtgtgttcatgaaagagagaaagagagaggataagtgcacacaaacacataaatatatatacatatatgtacatgcatatataccaaaaaaatctgcttctttgtaattacatgtgatcttaagaaatacgtatctgctctgtgaaagatttttatatgcctttgccattctccgattagcagaaagtcataaggagtaacatcattcccatttaacagtagaaaaaatgtgcaagggctgccggtgagccaggaccagaagctacaagtcctaattcatggcccagtttccct

SEQ ID NO: 76770 - DNA, 601 bp, Human
atttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacagggaaacctgagcccacagcgccatctagcccgcttggcccacgcccygctgtgcctgcaagtgtaacccgcccaagcatcctcctctttttatttttttaaagtataattaccggagcttatgtttcacagttaatgctgtcaagccttttaaactaattggtcttttatagaaaatttaactgaaaattaacacatcttttaataacattgccttaactttaatggctctctgcctttcgtttataattgctctaaaattgtcattttccatgtcatagctgccattttttatatttgctagttttcatggtgtagatttttatttttagtatttttctttcgtga

SEQ ID NO: 76771 - DNA, 601 bp, Human
aaacaaaacaaaacaaaaatttatagattagagttaaatgagaggatttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacaggraaacctgagcccacagcgccatctagcccgcttggcccacgccccgctgtgcctgcaagtgtaacccgcccaagcatcctcctctttttatttttttaaagtataattaccggagcttatgtttcacagttaatgctgtcaagccttttaaactaattggtcttttatagaaaatttaactgaaaattaacacatcttttaataacattgccttaactttaatggctctctgcctttcgtttataattgctctaaaattgtcattttccatgtcatagctgccattttttatatttgcta

SEQ ID NO: 76772 - DNA, 601 bp, Human
tgagttagggtcctgttcagagcctgggatcagggaacccgcatagtctaaggaatacaggagtccctcttcccactgccaaggacaagtttgcaaacctgactagcgaagcccttcttctgattaaggcaacgtggccccctggttatgagtacagatttccaaatccaattagtgtggcttttaatacctgctttgctatccaataggcacaacaatgaaaaagttgcctaacttttctctgccttgaattcctcatccatataacagagatgaaaaaacaaaacaaaacaaaaatttrtagattagagttaaatgagaggatttgtgaaacttctgatagacaaagcatactcaaaaaatgggagtttataaaaagaaccatcaactagcaatgcaaccaatttagacaattccctctccgggtgtctcggcgttctgattctaatctctgagagctggctcagaacacaagggtggcccgcttggcctctaaagtttgatgattctcaggtcctgtaaaaggacactgaggaaaccatgaaatgccaggggagggaccaaggcactgtaacagggaaacctgagcccacagcgccat

SEQ ID NO: 76773 - DNA, 601 bp, Human
tattggctagggaaattaactttttctgtatttaaaatttaattttaagagtacccacttttaaatattgaatctttatggtactgggttttaagttttaatattacttttaattggctttttcatactaatgattccttttaatgttttcaattatcatatgtttataaaatgtagagatcatttttattattaaactttataatgtacactgtttcataatataacaaatcatgcacttattactttttgaattattttttaaatataaatcttcaatgtttaatggaaagttatcagaaaatgatatcctgtttattattatggtcactcatttatttctaccataaagtattacaaaaagtacataatgctctgatttggggacttccagagggaaaaataatgcatacctgaactgatagacgtatttatgtgaaagtaactgtaagtagtacacaaaatttctacttagtagttaattcttggttttagaatttggggtttttttcctataattttattttatatattttctgctgtgaaaatacatttattttaaatttctgtaaaaaagaaagtaaatgttactaaatagtta

SEQ ID NO: 76774 - DNA, 601 bp, Human
caaactctgatatctttaaaagagaaaaagggaagaaaaaaagtatagcttcaaagaaaaattttaaactattatgttagataagttaattttatattcatagttgacacaataaagctataattttttatggacaaatattataactgaaatatagaaagcaaaactaattagaattacactagaataaatctggactaagggtaatacgtgaaatattcccactatcactgtttttagcttttacaggccaaatagatcaaaagataagaaaattgaggatataatcaggttgatttastgtatttttactaaactttgtaacaacgattacaaaaaaaaaaatcaatggccaaaaccatcaaatctcaatacatataacaaagtataagctgtataacctacattttaaaaattaaatacaatgtaatagaggcaaaagtaaatattccagaacatcaaaaaaattttgttaagtatcctataactactaggtcaagatggaaatcaaacttagaatatgaaatattttaaaattaaagaatatttgagaatgacatataaaaatatcatgtcttgaggccaatgctatagagacaaa

SEQ ID NO: 76775 - DNA, 601 bp, Human
gcaactccataaggcagacacccccagagcagccattttagaggctcctcctgggaatgcattcttttcccagggttgttaattattaatattccttactggggaaagaattcagcaatatttctcttacctgttttcagtaataagagaaacatggctctgttccacccagcccacaggcagccagactttaaggttatctcccttgttccctgaaaattgctgttatcctgttcttaaggtgcccagatttcatattgttcaaacacacatgctttagaaaaaatttgtgcagttaacrgaatcatcacagggtcctgaggcgacatacatcctcagcttacaaagatgatgggattaagagattaaagacagacataggaaattattaagagtactgattggggaagtgataaatgtccatgaaatcttcataatttatgttcttctgccaaggcttcagccagtccctccgtttggggtctctgacttcctgcaacaagagtctatttatataaaatatccagaaaaggcatgtctacagaaataatgagtagatcagtggtggcttagggttggtgggttgatgggtggagttgta

SEQ ID NO: 76776 - DNA, 601 bp, Human
acaaaccacctctgataattcaatgtacattcgtttctatttccttaagtgtcggccagtctgagaaataaagggaaagagtacaaaagggagaaattttaaagctgggtgtctgggggagacatcacatgtcggcgggttccatgatgccccctgagccgcaaaaccagcaagtttttattagcaattttcaaaggggagggagtgtatgaatagggtgtgggtcacagagatcacatgcttcaagggcaacaaaaggtcacaaggcaaaaggtcagggcgagatcacaaggtcagggcraaactagaattattaaggaacttccatgtcctgctgtgcaggcgttgtcattgataatcatcttaacagggttcaagagcagagaaccggtctgactagaatttgccgggctggaatttcctaatcctagcaagcctgggggcgctgcaggaggccagggagtgtttcatcccttatctgcaactccataaggcagacacccccagagcagccattttagaggctcctcctgggaatgcattcttttcccagggttgttaattattaatattccttactggggaaagaattcagcaatat

SEQ ID NO: 76777 - DNA, 601 bp, Human
atttccattagctaatgaatgcatgcacaaaatgtattatatccgtgcaatgagtattatttggccgtaaaaaagagtgatgcaatgatacatgctacaacatggatgaaccttgaacacattgtactgagagtctatcagacaaaccacctctgataattcaatgtacattcgtttctatttccttaagtgtcggccagtctgagaaataaagggaaagagtacaaaagggagaaattttaaagctgggtgtctgggggagacatcacatgtcggcgggttccatgatgccccctgagcygcaaaaccagcaagtttttattagcaattttcaaaggggagggagtgtatgaatagggtgtgggtcacagagatcacatgcttcaagggcaacaaaaggtcacaaggcaaaaggtcagggcgagatcacaaggtcagggcaaaactagaattattaaggaacttccatgtcctgctgtgcaggcgttgtcattgataatcatcttaacagggttcaagagcagagaaccggtctgactagaatttgccgggctggaatttcctaatcctagcaagcctgggggcgctgcaggaggccagg

SEQ ID NO: 76778 - DNA, 601 bp, Human
ctaattaccggtgcatgccgcccctagtcacgtaccccctgcttgctcaatcgatcacaaccctctcacacgcacccccttagagttgtgagcccttaaaagggacaggaattgctcacttgggatactcggctcttgagacaggagtcttgccaatgccgctggccgaataaacctcttccttctttaactcggtgtctgaggagttttgtctgcagctcgtcctgctacacagtcactttggaaaacagctaggcagttcctcatatgtttgaacattgtgttgctatatgacccagamattccactcttacagtatatacccaagataaataaaaatatatgtccatatgaaaacgtgtacacagatgtttatagcagcattattggtaatacccaaaaggtgaaaataacccaaatttccattagctaatgaatgcatgcacaaaatgtattatatccgtgcaatgagtattatttggccgtaaaaaagagtgatgcaatgatacatgctacaacatggatgaaccttgaacacattgtactgagagtctatcagacaaaccacctctgataattcaatgtacattcgtttctattt

SEQ ID NO: 76779 - DNA, 601 bp, Human
aggagaaactggaactctcacacactgctggtgggaatgtaaagtggtgcagttaagggaggagaccacccctcacattgtgttatgcccaatttctgcctccaaagaaagaaaaagtaaacattaaaaggcagaaatgaaacccacaagcagatagcccggtgccacaccctgggcctggtagttaaagactgacccggacttaatcggttatgttatctatagattacagacattgtatagaaaagcactgtgaaaatccctatccttttttgttccaatctaattaccggtgcatgcmgcccctagtcacgtaccccctgcttgctcaatcgatcacaaccctctcacacgcacccccttagagttgtgagcccttaaaagggacaggaattgctcacttgggatactcggctcttgagacaggagtcttgccaatgccgctggccgaataaacctcttccttctttaactcggtgtctgaggagttttgtctgcagctcgtcctgctacacagtcactttggaaaacagctaggcagttcctcatatgtttgaacattgtgttgctatatgacccagacattccactcttacagtat

SEQ ID NO: 76780 - DNA, 601 bp, Human
atcagagaaatgcaaatcaaaaccacaatgagatattttacacctactagaatagctgtaataaaaaagactgatgataataacaagaattggtaagaataaggagaaactggaactctcacacactgctggtgggaatgtaaagtggtgcagttaagggaggagaccacccctcacattgtgttatgcccaatttctgcctccaaagaaagaaaaagtaaacattaaaaggcagaaatgaaacccacaagcagatagcccggtgccacaccctgggcctggtagttaaagactgacccgsacttaatcggttatgttatctatagattacagacattgtatagaaaagcactgtgaaaatccctatccttttttgttccaatctaattaccggtgcatgccgcccctagtcacgtaccccctgcttgctcaatcgatcacaaccctctcacacgcacccccttagagttgtgagcccttaaaagggacaggaattgctcacttgggatactcggctcttgagacaggagtcttgccaatgccgctggccgaataaacctcttccttctttaactcggtgtctgaggagttttgtctgcag

SEQ ID NO: 76781 - DNA, 601 bp, Human
tagtcattctggactttgatttttctcgtctgtaaaataacagtggtcattaaaaccaaatttatattcacataattccatgaggacttctgaattaagatgatagttactagcggggctggattcacaatcctcattgaaatacttacaaaaacacccattgtgatacaaaattccaactgcaaaagaatttaggaatgttatccatagcctgccagaccctaaaggaaatttatgctcagagttaagatatgcccttaggcacagaagcagaaaaaggatacttaaagtaggatatgtktctggagaggttatgggatccagggatccagagctgggctgaggggtttaatgctgacttcacctctcagaagctgtgtgaccttggaaagttatttaacatttttgtgcctccgtttcatgatctgtaaaatgtaataatagaaggctgtggggctctatgacctacccatgaagcacttagaaacatgcttggtgcacaggaagcactgataaacattttggcctcatatcagagacatgaggcctttgccaagtagaggaacagtcagctccattctcaactttcctttgaattttt

SEQ ID NO: 76782 - DNA, 601 bp, Human
cataggtcccagtccatgatcaaactaaaatatggggaaagtatgcagcactgtttcagaaaaaacagagacagaccctttccttggctccttttccactatttagtctttctgggcgacaccattgtttgtgtaacaggtttatcagtttctgtgacttatggctgcatctcttaaatgcatctgtggggttgggctgggaataagggcaaagacagcacacttctgtcacagtgcctacactaggcagatacatggaatcagaagggagacgctggccacttccgtcacagggaggacrtgagggaacgtgactgggtccactctcagaaattacaaggtctaggttttgatttacaggcattaaaggatccacataagattcggtttgtttggccggtggttctggatacatctgactactgactaccctggtgctttgaaaaccaccagtgcctgggtcctattcacatataaaaactaagaaacctgcaggctgaggctggccacctccatgtgctattaatgtatagttgggttgagtatccctaagctacgctaagagcctgtggaaatatttcccaaccttggctgcatgctg

SEQ ID NO: 76783 - DNA, 601 bp, Human
aacagatcaccataacaaccaccatcctgggagacagcaaaagaacagagagaaacatcctttttatttgcctgaaaatcaagggacagcagggaaacgggtcttttcatcaaagcttgttttggtgtctcccaagttggagggtccatgtgccaagggacggcagtggaagaagtcaacatgtttaacagactacacccaatatgtgtgatttttagggatcaggtaacaatggggttttcctctggtgtctctccagttttccacctgtcgcagtggggtttgaaagctctaaggagaytatgcttctccctcactttaagtcaaagtgtaaagcttgatggtctcagatgtatgctcagctgaggagatgaacccttctctgcaaaatggtgattatgttcagtcccagctcagctgtaaccgctgtgataggctcgtgttgtcaaaactgtctgagtgataatgaaaaccaccgcaaggaggaggaccccaccaggtcctatggtgacagactctttcaggaggtaaggaccctgtgaaaagcacaatttacagacctcagagatggcaagggtgcaagagaatgtgtttccctagg

SEQ ID NO: 76784 - DNA, 601 bp, Human
ttgcatgttgaggagatgtatacagacctttgcctttacagtaggggacaggaaaggatattaatatttctgtgattaggtgggagggcagagttgaaaccaatactcacctctttgtgcactgactgggggtgctgaggtgagcatctctcagccggtaaattccaaaacaaagcatattatatgttttcagagctttgcagaacagatcaccataacaaccaccatcctgggagacagcaaaagaacagagagaaacatcctttttatttgcctgaaaatcaagggacagcagggaaaygggtcttttcatcaaagcttgttttggtgtctcccaagttggagggtccatgtgccaagggacggcagtggaagaagtcaacatgtttaacagactacacccaatatgtgtgatttttagggatcaggtaacaatggggttttcctctggtgtctctccagttttccacctgtcgcagtggggtttgaaagctctaaggagattatgcttctccctcactttaagtcaaagtgtaaagcttgatggtctcagatgtatgctcagctgaggagatgaacccttctctgcaaaatggtgatt

SEQ ID NO: 76785 - DNA, 601 bp, Human
aagaaccacttatcttagggccgggtgtggtggctcacacctgtaagcccagcactttgggaggccgaggtgggtggatcacttgaggtcaggagttcgagaccagcctggccaacaagccttctctctactaaaaacacaaaaattggctgggtgtggtggtgtgtgcctataatcccagctactcaggaggctaaggcaagagaatcactggaacccaggaggcagaggttgcagtgagccaagattgtgccactgcactccagcctgggcaacagagcaacactccatctcaaaaaaaaaacaaacaaaaaacaaaaaaacaaaaaaacttatcttaaacactagcaatgtaaaatatctctatattaggtaccaacagatgttatcctagtagctagagtttgggagagatgtttgtgtattcagacttttgtaattaggtgatggaattattctattaatacaaaacttgaattcttaccaaaatgtctttacatctactattagtaattatagaaaaatgcttcccatcacctccaaactcagtgttggatttaatatgggcagagtaatttgcatgttgaggagatgtatacag

SEQ ID NO: 76786 - DNA, 601 bp, Human
agcagatgtgactaagaaaatcacgctgtttcacttagagcagtggtcaccaagtgtggtccttaggccacacaggtcagcatcacctaggaactaggaaatgcaagttcttaagcaatcccacccagacctactgaattggaagtgctgaggatggggtccagcaatctgtggttgaacaagctctgcaggtgagtctcatgatggctaaattttgagaacccactggtctatagcaattgttctcaattctggctatacactataatccctggttattatatataaaatgtttacatawtttaaaatatatatatgatgttttcttccttccagaccagttaagttagagtaatcagaatattttttaaaagctccccaggtgattctactatgcaagcagggatgagaaacgcttgtctctgcagcactgttgcctagggtatattatgcaaactcactgatcttggtaattctaggatgtacttttaatttttgcctgctatgaatttattttaatgcatatgagaaaaatataattggcacatctaaactgttatttctctgcttaaggtgataatatataattgtctcaaaaata

SEQ ID NO: 76787 - DNA, 601 bp, Human
gagtgtctccttagactattctcgctctttaccttttaaaatctactttggtgagagaatttggaatttggaattcaccacatggaagaatctaagaaacctgcctacttatcagcactactttgttgttcttcacaattagttggagctttctttggtcaacagcagatgtgactaagaaaatcacgctgtttcacttagagcagtggtcaccaagtgtggtccttaggccacacaggtcagcatcacctaggaactaggaaatgcaagttcttaagcaatcccacccagacctactgawttggaagtgctgaggatggggtccagcaatctgtggttgaacaagctctgcaggtgagtctcatgatggctaaattttgagaacccactggtctatagcaattgttctcaattctggctatacactataatccctggttattatatataaaatgtttacataatttaaaatatatatatgatgttttcttccttccagaccagttaagttagagtaatcagaatattttttaaaagctccccaggtgattctactatgcaagcagggatgagaaacgcttgtctctgcagcactgttgcc

SEQ ID NO: 76788 - DNA, 601 bp, Human
atggaattgggtggacagggtgctgcctcagcaggctgggatgtgctgggctgtcagaaagtgctcataaatagcatgccccttgcgaagacaggcgagtctgcagacggccgtggctcctctgttcttcccgaggctacagcaacaggttcattctgggatgggttgggggtggggaggcaaaagccaccctggcaggcccggaccttttgtagtttctgtgggacgcgcatggctgaccgcctgcaaagaaaaacagcgcctcccttaagggtcaggtcccagtgagaggaccctgacrgcccagctgggggtggaacgagggacccttgtctgcagtggccagggtccaagcccctggacatgtgcttagggcaggggaccttccaaaacagctcctctgagggaggggagtgggcacacatggtacctgccaagtcccccgagagtcccctgtgagctggaccaagccctgtttcctgctgaggctaggagagacagaaccgacagcccgcaggctgtgcatggttaggcccacatccagagtatgtgggctgtgcagctgtgcatgctggggtggccgtgctgggagccgtgggtg

SEQ ID NO: 76789 - DNA, 601 bp, Human
ggggaaaagggcacgggctttggagccaggcccgacccaggccacttcctcactgtgtgcttgaggaagtggcctcactttgctgagcctcagagttcccctctgtacaatggggctcctgatcccactgtctcagtccacgtggcccatggcaggtgctcaatggatgtttgctgaatgactgaatgtcgatcataagttacagccacgccccatgggcagcaaggctctgtagctcatcctggactccagtcacatcaacacctggcttctcccgggtggatccagtgaaccattttcytttggtttgaagccagaggtgttcctggggagatggcggaacagcacggagcacccgaacaggctgcagctggcaagagccatggagaccttgggggcagctacaaggtactgggcagggagggggtcagagggcccaggctactcctgggcctcagggtcatcttcccagccaagcagcacctctgcaggaaggaagagccatccttccaaccacccaggccaggacaaaacgctccgggtgggtcctctcactgccaccctcccgttagaaacttgcttcatgactttgctgcatctt

SEQ ID NO: 76790 - DNA, 601 bp, Human
cctcaacagccccatgtttgaaatgaggatggtgcccagatattgtgcccagagttggtgtaaaggctgaaagacatgagtgaagccagctagcagagggaggcacactagaaatctgagagaaggtttgaatgtgttggctctgccctttccaaaccatctccggggtctttttgggaaactattccagacagagtctaaggatgggtcgaatcccagtgcctcctcttaacttgctgtgcagcccgaggcaagtatcttaccctttctgagcttctttgatcccttctgtaaaatgackagaacagatgttccctggggatcttctacaaagtcagtttgtgtttccaggtgggtgagagaggcaaaaccttggtctgcctttgcagcccttctcttcctaggcttggggcaggcagaggtcttccccgagactgcaaacaggtgttttcatttttttaagggggaaatttcctattaaggaaaatacagatttctgacctctcttgaaaaaattggaactgggacctcattccctcatcgccagaagcagcttcatttccccaccgacctctcgggttatttcagtccgctggactcc

SEQ ID NO: 76791 - DNA, 601 bp, Human
ttttgagttgcagtctcgctctgtcacccaggctggagtgcagtggcatgatctctgctcactgcaacctctgcctcctgggttcaagtgattctcctgcctcagcctcctgagtagctgggactgaaggcacatgccaccacgctgggctaatttttgtatttttagtagaggtggcgttttgccatgttggcaaagctggtcttgaacttctggcctcaagtgatctgcctgcctcggcctcccaaagtactgggattacaggcctgagccaccacgcccggcccacagtgacactttraacaccacccttctccctcccctgcttcactcacaccccgcagctgctccagccctttctctttgtcacataactgagtcctccttagagggcagtggaagaggggaaactgggaagattaaaccggcatctggttaggaaagagggaaagctcatatgttgatacttttgatctctgtccaccctctcctggcctcagtttctctatcatttaaatgatgggattgaacaagatctggaaattccttttcagttttataatctacggctctaggttcctaaatcaaccagctttggagg

SEQ ID NO: 76792 - DNA, 601 bp, Human
cttgttcttcttaacaaggggcccaggatgtatgcagttattgagatgtgacacaagttgtacagaggagagcaggcttatcacctccctctttctaggcttaatatcaccgttgatgcagtcttaggatcacctgctttttgtaggtggttacatctcacttgtgggcttgtaatctggggttgggccttgagaggtgccacctatccctgataataatttattcaacaattttttactgaacatctactatatgctggtgtgctgatacagagaacaacaagaatggcacatcctctggccctcaaaaaatttgcgtagtctggggctcacgcctgtaatcccagcactttgggaggccgaagtgggcggatcacctgaggtcaggagttcatgaccagcctgaccaccacggagaaaccccgtctctactaaaaatacaaaattagccgggcatggtggcgcatgcctgtaatcccagctactcaagaggctgaggcaggagaatcacttgaacctgggaggtggaggttgtagtgagccgagatcacgccactgcactccagcctgagcaacaagagcgaaactccatctaaaaaaa

SEQ ID NO: 76793 - DNA, 601 bp, Human
gggaggccgaagtgggcggatcacctgaggtcaggagttcatgaccagcctgaccaccacggagaaaccccgtctctactaaaaatacaaaattagccgggcatggtggcgcatgcctgtaatcccagctactcaagaggctgaggcaggagaatcacttgaacctgggaggtggaggttgtagtgagccgagatcacgccactgcactccagcctgagcaacaagagcgaaactccatctaaaaaaagaaaaattacatagtttgatggagagacagacaaagtaacaggtattcacaaygtattgtgatcaggattgggactgggatgcacaaggggctctgggagtcccagtgaggtactcgattcagcctgcaggagtctggagacatctaaattgagctgtaatggatgcaagtggaaaaaagggggaaggagagggatgaggtgagcaagagtgttccaggcagaaggaatcatgcatacaaaggccccccaacacagcaggttccgggaaagtagaataagagaggccacggtgttgagtgtgaatgggatgttgagagataaggctagagatgctttgttaagggtcctgtga

SEQ ID NO: 76794 - DNA, 601 bp, Human
tgagcaacaagagcgaaactccatctaaaaaaagaaaaattacatagtttgatggagagacagacaaagtaacaggtattcacaacgtattgtgatcaggattgggactgggatgcacaaggggctctgggagtcccagtgaggtactcgattcagcctgcaggagtctggagacatctaaattgagctgtaatggatgcaagtggaaaaaagggggaaggagagggatgaggtgagcaagagtgttccaggcagaaggaatcatgcatacaaaggccccccaacacagcaggttccgggraagtagaataagagaggccacggtgttgagtgtgaatgggatgttgagagataaggctagagatgctttgttaagggtcctgtgagcagggtaaagagtttggattcatcccaagggctctggggagctaaagaggaatgtaggcaggcagagtgcatggtcagatgctggctggaggcagggtgactggaagcagaccgtccacatctcaaccttggtctcccggcaggtgggttggctatgagttccccggctaccgtgggcgccagtacgtgtttgagcggggcgagtaccgccact

SEQ ID NO: 76795 - DNA, 601 bp, Human
acaagagcgaaactccatctaaaaaaagaaaaattacatagtttgatggagagacagacaaagtaacaggtattcacaacgtattgtgatcaggattgggactgggatgcacaaggggctctgggagtcccagtgaggtactcgattcagcctgcaggagtctggagacatctaaattgagctgtaatggatgcaagtggaaaaaagggggaaggagagggatgaggtgagcaagagtgttccaggcagaaggaatcatgcatacaaaggccccccaacacagcaggttccgggaaagtaraataagagaggccacggtgttgagtgtgaatgggatgttgagagataaggctagagatgctttgttaagggtcctgtgagcagggtaaagagtttggattcatcccaagggctctggggagctaaagaggaatgtaggcaggcagagtgcatggtcagatgctggctggaggcagggtgactggaagcagaccgtccacatctcaaccttggtctcccggcaggtgggttggctatgagttccccggctaccgtgggcgccagtacgtgtttgagcggggcgagtaccgccactggaatg

SEQ ID NO: 76796 - DNA, 601 bp, Human
gggatgaggtgagcaagagtgttccaggcagaaggaatcatgcatacaaaggccccccaacacagcaggttccgggaaagtagaataagagaggccacggtgttgagtgtgaatgggatgttgagagataaggctagagatgctttgttaagggtcctgtgagcagggtaaagagtttggattcatcccaagggctctggggagctaaagaggaatgtaggcaggcagagtgcatggtcagatgctggctggaggcagggtgactggaagcagaccgtccacatctcaaccttggtctccyggcaggtgggttggctatgagttccccggctaccgtgggcgccagtacgtgtttgagcggggcgagtaccgccactggaatgagtgggacgccagccagccgcagctgcagtctgtgcgccgcatccgtgaccagaagtggcacaagcggggccgcttccccagcagctgaaaggcacccagacttcaaggacccagacccaccctggggggctgcaagggcaagaagaggaggctccagggttggggcgagggccgacctgtccacccttccctggaatctgctcaataaagcctgggg

SEQ ID NO: 76797 - DNA, 601 bp, Human; identical to SEQ ID NO: 18293

SEQ ID NO: 76798 - DNA, 601 bp, Human; identical to SEQ ID NO: 18294

SEQ ID NO: 76799 - DNA, 601 bp, Human
tggcaatggcagctttcctggcttggcatttttcgttgtagtatttattcagatggtagaccagcttggcctgggccgcaatcatgttggggcagagatccggattgtacaccggagtctcgcagtaagctgtgggatccaatgcggctgctagagctggagccaacttcggtggagaaacgggccgcaacactcagaaatggatcaaaaatgcctttcggaagtgctgcagcgttggtttccctgctgctgctgctgctgctgctgctgctgctgctgctgctgctgctgctgctgctgtttttcccttccttttatctttgagcccagccgttcttaaagtgaaagactgtcctcccccctctgcttgtctctcttcctcttttaaagaatccttgtgtgagagaaccgcatggagagatcaccttctcaggaataaaaaacaaaagttgcgctgagacccagcaaagctcttccagtagtcaaaataagcacccctttccgtatttatttgcgctttcccgtaatcattgtgtgtgcagcactgttaatcaaatggaggaaaagtgtgctgagtgtgtgtccggggtgagtgtgcgtg

SEQ ID NO: 76800 - DNA, 601 bp, Human
ttaatgcgtcagctgcttagctgagcaagagcgatctatcactcttcattactgtcaaaaagccaaactctaggacaactagacaggaggaggtcagttccaactcaaataaatcatcccacattacacaagttcgggaaagtttccccccacttcctaaaaatatatatgtctcattgtagagcgcaggatcccctttcctctccatcaaacccactcctgaacccacaggggcagggacaaggcaaccaagcatctctccctctcctccttctctcccagcccactctcccctcccccsacagccactctcggggcagcccggagaaggaagagggtcccagagacctggggccaagtctttggactgacctttgtggctgaggcaagcagggccggtggctgcggcggtggcggcggcggcggcggccggcagaagtgcggttttcttggccgccttcttctccttcatccaggggtactcgggcggctgcagggcgccggcgggcaccgggctgccgcggctgcccgcggggctcggcttggggcggccgccagcgccgtggcgagggtgactgccggggttcaggctgggaatggt

SEQ ID NO: 76801 - DNA, 601 bp, Human
ctcaatgtcctgggctcaagtgatcctcccaactcagcctccagaatagctacaatgacaagcatgcactaccatgcctggataatttctttttctttttcttttgtagagacggggtcttgctatgttgcccaggctggtctcaaactcctgggctcaagcaatcctctagtctcgacttccccaaatgctaggattacagctgtgagccacaccacacctggccgacatgcagtttttaataaaacatcttaaaatgctaagtgctaactgccatcaataggatactgtcacataatatttttaaaggcgtaattataaatactataaaatcacagtctactatttcagaaaatcagagtctacttactatttgtatgtctcagaacggatatactcaaaaacatgggacacgccaagctggaactggtctgcaatgggggtcacccagggattgttctctgctttgaatacctgcttctggccagttaaatccaagtttcctggggggggggaaaaaaaaagtgaaggtcacttcatccaatacagatcaggtctaagaagtccttctcagtaatcacagcctaagtaccctaaatca

SEQ ID NO: 76802 - DNA, 601 bp, Human
aaaactaaaaattgttaaccagaataataaacagagaatttcctctaattccagatggctaggagtttgttcatgcatttttctgtatactatcatatacagaatgacttttttcaagataccatacaaaccaagctctaaatagcttcctgtttactaagaaaaaattagagccccatctaaaactcacgatagcaatgattaacaatttacaaagaagaagataaacaatcatctgctaatttgtgactatattttcacacattttcataattaactaatttctaagggtgagctacaytcgtatttttttaaaaaaaattgaatctgtaataactgtacatatctatatggcttatgaaacaattaatacacatcctatacctatctcattttatccttaaggtaagtctttagacttatactgtaagtgtcatagtattgtctaaagtaatctaaaccacgctttacattgcttttatataggaggatacggtatcattttggcaattttagtgtatttcattttaaggccattgttcttttttcttttttttgggatggaatattgctctgtcgcccaggctggagtgcagtggca

SEQ ID NO: 76803 - DNA, 601 bp, Human
atccagaaactcacaatttaatcttttaaaattaaaagcactttcatatgcaatgtattctcatcctctataaattataaagtgatctatggaaaactaaaaattgttaaccagaataataaacagagaatttcctctaattccagatggctaggagtttgttcatgcatttttctgtatactatcatatacagaatgacttttttcaagataccatacaaaccaagctctaaatagcttcctgtttactaagaaaaaattagagccccatctaaaactcacgatagcaatgattaacaayttacaaagaagaagataaacaatcatctgctaatttgtgactatattttcacacattttcataattaactaatttctaagggtgagctacattcgtatttttttaaaaaaaattgaatctgtaataactgtacatatctatatggcttatgaaacaattaatacacatcctatacctatctcattttatccttaaggtaagtctttagacttatactgtaagtgtcatagtattgtctaaagtaatctaaaccacgctttacattgcttttatataggaggatacggtatcattttggca

SEQ ID NO: 76804 - DNA, 601 bp, Human
tgttatagatacctctcatttatccagaatcctaaccacattcaaatcagttaaaatagtctgtaacagtgcagaatggtgattaattgcctaataattactttgaggtaatacaaaatccagaaactcacaatttaatcttttaaaattaaaagcactttcatatgcaatgtattctcatcctctataaattataaagtgatctatggaaaactaaaaattgttaaccagaataataaacagagaatttcctctaattccagatggctaggagtttgttcatgcatttttctgtatactrtcatatacagaatgacttttttcaagataccatacaaaccaagctctaaatagcttcctgtttactaagaaaaaattagagccccatctaaaactcacgatagcaatgattaacaatttacaaagaagaagataaacaatcatctgctaatttgtgactatattttcacacattttcataattaactaatttctaagggtgagctacattcgtatttttttaaaaaaaattgaatctgtaataactgtacatatctatatggcttatgaaacaattaatacacatcctatacctatctca

SEQ ID NO: 76805 - DNA, 601 bp, Human
tcctcatggtgaatcaccccacaattcaccccaaagtgctgggatcataggcgtgagccaccgcacccagcctactgaaactttttaatgttgacttaactgcataaaaggtaatccaaggctccatgaggaaatgaaacagaaaaagttagcagacacattgcttagactacgccaaccccccaaaataggatgctaataacagacataaaaacagatataccaattatgttatagatacctctcatttatccagaatcctaaccacattcaaatcagttaaaatagtctgtaacagtgyagaatggtgattaattgcctaataattactttgaggtaatacaaaatccagaaactcacaatttaatcttttaaaattaaaagcactttcatatgcaatgtattctcatcctctataaattataaagtgatctatggaaaactaaaaattgttaaccagaataataaacagagaatttcctctaattccagatggctaggagtttgttcatgcatttttctgtatactatcatatacagaatgacttttttcaagataccatacaaaccaagctctaaatagcttcctgtttactaagaa

SEQ ID NO: 76806 - DNA, 601 bp, Human
agcatcctgtgagtgatgccatgctggaaatgaggctttaggactgccatgcttggcaaattgcagttttcatgatgacgcctgtttgccaaatacctctttcaagggaagcatttccagcctaacatttgtcaaacctcttttgttaacttgttgacaagagttaacttgtcagcttttaaaatggcttgcagttggtatccacgttccttgatggaaatgtgcaaagtgtgagttaccccctttcacaaagaatcttgtcaagggtgctgacttcaacttgactgcctctcctgggggaaaaaaatctaccttctggaaacttaagtgatgagtattccatcataattctgcttcaaagaaataaaagaggtcgaagagacaaccaccatcaaataaagagttaacaggtaattgtataactcagcgacagtttaaaaacacagtggagcatgtaggatgtaagcttcaacgacccaaccaagctcataatttcatgttaaccggcaactcagtgacatcagccaacaagttcccctgtggaaggcacgaaagatgaagagacagcagcttccacctgagacatgatgaaggggccgtg

SEQ ID NO: 76807 - DNA, 601 bp, Human
gaatgtaacctgacacattatgggttttttggagtatggatggagtctagctgatatttattttccttctgtcaagtgagacaaattatctatattctatttaccttaaattgatactgtaatgtatcatgctccactttaggagctgtataaggcatgccaaatgcaggcttgatagtcaacaatcaagtgagggggatggagaagggaacaggggaaagaggggactggaataggaggagagagacacacacagagagagactgagatagttttactctttaaagtcctacggaaaagscttttgtagtgcaaggttcaggataaatctctcttctccctttgatgttgcagctgtagtttttttcccctatgcccctctaatagttatccacaactcttcaaagataagtacactagtcattgaataaaatgcaaattgcattgagtaaaaaaggcaaggagcatagggttttttctcactggtcaaacctgagcctaccaggtcccagtcagagctcccaggcaagcacagagtgctggaggattaaccacattagaggaccagagggaagtagtgaagaaagcaacgtggatatgg

SEQ ID NO: 76808 - DNA, 601 bp, Human
cacacgcctgtaatcccagctactcgggaggctgaggcaggagcatcttttgaacctgggaggcggaggttgcagtgagccaagactgtgccactacactccagcctgggcgacagagtgagaccctgtatcaaaaataaataaataaaaataaaaattagctaggcatggtggtacatactgtaaccccagctgtttgggaggctgaggcatgagaatcgcttgaatccaggaggcggaggttgcggtgagattgcacccctgcactccagcctgggtaacagagcgagactctgtctcaaaaaaaaaaaaaaaaagaaagaaaaaaaagtgtaaagctgttagtgttaaaagacaaacattagtgcccaagaaaatcaggaggtaacagacttcaaaaggttttgtagttatgtcttcccgatgtcactgttattgttccataattaaatggtattctacctagacatcaggtgacctaaggctttctactactgagtggcccacacttctttttttcttttttaaagtataaaacctagaaggaggtcgctgtttctttttcttttcaggcaggtattgctctgtggacagtaacaag

SEQ ID NO: 76809 - DNA, 601 bp, Human
acaaagctagcaaaaggtaagggtagggcttgaacccaggcagcctgtttccagggccaggcttacacccactggtctacaggtggaagagaacctagcatgtctcctagggcaagcttattctccaaggctacacctgctcctcattaaaaggcacttcatagtttttgtacatttccttagagggtattcagaagtcctttgaccccattgaaatgcttcttcagggtccataagtcccgctgggagaagcgttcatctccggtacctggtaggactcagagaccagaagcgctgtgacactgtggttctgacaattgctgtggagtccctgtttctcttttgtatagcatgcagccacacttattctcaaaagcaggacatttgctccaacatgaacagagcagctacaaatttttctttttactggtgccatacataattaaaatgaaaccatgttatttccacattttaggagaaagaaacaaaataccaattttctcctcaacacttaattaacaatgggaatttgactgggagaatttttcttagcaatataggaaattaattccatctgtgagaaaatttaagctcaaatgga

SEQ ID NO: 76810 - DNA, 601 bp, Human
aaaaggtaaatccatacctgccatatgacccacgcattccactcctaggtgtttacccaagagaaacaatagcacatgttcaacaaaagacttttacacaaaagctcacagcagctttatttctaatagcccctaactggaaataagcctaacgtccaccagcaggcaaaaggataaacaaactgaggtatatccacacaatggactacaaatcagcaatgaaaagatatcaactactgatgcatggaacaagaatgaatgactctcaaaatacttatgctgaatgaaaggagccagttgtttttttttaaatagagtacacattatatgtctatatttatcgaacactctacaaaatgcaaacatacagtcagaaagtaggtcagtggttgcctggggatgggggaaatgaagggagaggcacaaatgagaaatatggtttatacatgggcataaaaaaacccttggggatgaggaatttgttcactgtcttaagttgattgttttacagatgtatatatttatcaaatgcatcaaactgtacaccctaattgtagtctgttgtatgccaattgttgtcaaataaagatgttaaaagaaa

SEQ ID NO: 76811 - DNA, 601 bp, Human
gagtctttgtaagtttctgttaagaggaacatttatacaaatgttagaattctgctatcagatcttatttttcccaaaacaaatgctagaccagagctgtgcacagtgtgacctacaaacgtgcaactcctaatatgttacagaagaaaaaaaattcagggcattaaaataatgcgctcacgatcatgtgaccacccagaatgtagaactgtcattcaaacccaggcctgcctcactctaaaaggcccatgtgatttctgttgtattgtcttcttgaaattaacattttctgttttttttccccccccaaagcaccatactgctttttaaccatttttcattaattccccttttggaatttctaccagctgctgatctttcaccgtgtttggctacttacccaccccagggaaagccaagccaatgtcttctttccacatcatcaaagagaaacctccctcttcctaacagtgacactcatctacaaaagctgccatttcttcatcttcttttttttgtttgttttatgtgtgtgtgttgttcccctccctgtgtctatgtattctcattgttcggctcccacttacaaatgagaacatgt

SEQ ID NO: 76812 - DNA, 601 bp, Human
agacaacactaaaatgcttcttattggaaagcacctttaaatgacctctttagagtctaaaggttgtgctaaactgtaaaatagattgccagcatcacctggaaatgaggaagagagatgctaggaagataataaacaaaacaaaacgaaaaactggaaaattctcatagaaaaagaaagcaaactttttcctcttcaagaagcatgtcatcagtaaaaggaggctgattgagaaagactgtagctcagaagctacaggaggggcgctgataacaagagatgattcacctgccccaaagcaaaaaaaaaaaaaaaaaaaacccgagaatctggagaaatgagccattcttaagtggaaaaaaacatttcccaaactttccaggatgatcggaatgttccatacctaaactggtatactggttatacacgtttgtcaaaactcagggaactatattatatacacacaaacacacacacacacacggtctgtacaaatgtatgtaaattacacttcaattaaaaaagaactcataaacatggcaaatgtataagtttatttgaatgtattagatacaaaactaaaaatcttattttatttatt

SEQ ID NO: 76813 - DNA, 601 bp, Human
gctttcttctgaatgaagtgtctttgaatcacttttgtcttccatctcacaaagaatgatcattttggggaaactaaggcagttcaaaggcagctcaatcaaccaaagtcagataacctgatttctcaaatgctaatgtgctgactctgggcagagagcttattgcttttctccttcacattgcctacgaagataggtcaaagtttgctacgagcctccacatttgagagagaggaggagaagctgtagtctacagttagccaagtctatggcttgtttgaaagggcaggaaggggacaayagtgaagaagggagatgaacagatggctaaagtaaacaatgggaattcattttttttctaaaatcaaatgggaaattcaattattcactattctacttgaaagcactgctttccagaaaattaaatgtacctggactatattcagaagatttagaacaaagagctgccagctttcacagtttattgttgaaaaccaagatactttaaataaataaataaataaataaataaataaataaatagctttgctttactattaagaacaggaaaccgtgggctgtaaaatgttaaacagtttac

SEQ ID NO: 76814 - DNA, 601 bp, Human
tcttgaactcctgggctcaagccatcctcctgcctccacttcctaaagtgctgggattacaggcactagcctccacacctagcgttacgtgctttcttctgaatgaagtgtctttgaatcacttttgtcttccatctcacaaagaatgatcattttggggaaactaaggcagttcaaaggcagctcaatcaaccaaagtcagataacctgatttctcaaatgctaatgtgctgactctgggcagagagcttattgcttttctccttcacattgcctacgaagataggtcaaagtttgctaygagcctccacatttgagagagaggaggagaagctgtagtctacagttagccaagtctatggcttgtttgaaagggcaggaaggggacaacagtgaagaagggagatgaacagatggctaaagtaaacaatgggaattcattttttttctaaaatcaaatgggaaattcaattattcactattctacttgaaagcactgctttccagaaaattaaatgtacctggactatattcagaagatttagaacaaagagctgccagctttcacagtttattgttgaaaaccaagatactttaaata

SEQ ID NO: 76815 - DNA, 601 bp, Human
cagccttgacctgctgggtttaagcaatcctcctacctcagcctcccaagtagctgagactacagtcatgagccattgtgcctggctaatttaaaaaaaaaaaaaatttttttttttttttaagagactaggtctcactatgttgcctaggctggtcttgaactcctgggctcaagccatcctcctgcctccacttcctaaagtgctgggattacaggcactagcctccacacctagcgttacgtgctttcttctgaatgaagtgtctttgaatcacttttgtcttccatctcacaaagamtgatcattttggggaaactaaggcagttcaaaggcagctcaatcaaccaaagtcagataacctgatttctcaaatgctaatgtgctgactctgggcagagagcttattgcttttctccttcacattgcctacgaagataggtcaaagtttgctacgagcctccacatttgagagagaggaggagaagctgtagtctacagttagccaagtctatggcttgtttgaaagggcaggaaggggacaacagtgaagaagggagatgaacagatggctaaagtaaacaatgggaattcatttttt

SEQ ID NO: 76816 - DNA, 601 bp, Human
acacccacgcgcaccgccgtgtaacagtggccaggctccccgcgtcccgctggtgacctgcccaccgtccctgtccacgccccgcccttccagctgaggacaggctggcgcctccacccaccctcctgcctcacccctgcggagagcaccgtggcggggcgacaactgcgcacgcaggaacgggggtctcctctcctgctggtccctgccggcgtgcctctagggacgggcgacgctgctgtgtgtggtctcagagcctctgcttccttaggttacaaaacaaaacagggagagaaaaacmaaaaaaaaaaaaagaagtttgaaaagttgggaaacactgggtaaacttatttttaaacagtgtattagtcagcttttcaaataatatggtcagtatctttttcttcaacccttggacaaccccctatttaagacaatgagtccaggccaggcacggtggctcacacctgtaatcccagcactttgggaggccaaggaaggccaactgcttgagcccaggagttggagaccaccccaggcaacatagcaaaatcttgtctctaccaaaaagataaaaatacaaacaattagccaggtatgg

SEQ ID NO: 76817 - DNA, 601 bp, Human
gcccggctgtatttttagtaaagacggggtttcaccatgtttgccaggatggtcttgatctcttgacatcgtgatctgcccgccccggcctcccaaagttctaggattataggtgtgagccaccacgcctggctttatttatttatttatttatttttgagacagggtcttgctttgttgcccaggttggtgtggtatagtcatggctcactgaagccttgaccacctgggctcaagtgatccttccgcctcagtttcctgagtagctggaactacaggcacacgccaccacacctagctwatttttgtagagatagggttttaccacatcaaactcctgaactcaggcaatctgctcaccttggcctcccaaaatgctaggattacaggtataagccactgcacctggcctacaaaaattaaaaaaaaaaaaaaagaaaaaatagcgcagtgtggtggtgcaagcctacagtctcagctacctgagaggttgaggtgggaggatggcttgagcccaggaagtcgaggatgcagtgagctatgatcatgccactgcactgggtgacaaagcaagaccctgtctcaaagagaaattttcttt

SEQ ID NO: 76818 - DNA, 601 bp, Human
ttgaactcttgaccttgtgatccaccctcctcagcctcccaaagtgctgggattacaggcgttaagccaccgtgcccggctgtatttttagtaaagacggggtttcaccatgtttgccaggatggtcttgatctcttgacatcgtgatctgcccgccccggcctcccaaagttctaggattataggtgtgagccaccacgcctggctttatttatttatttatttatttttgagacagggtcttgctttgttgcccaggttggtgtggtatagtcatggctcactgaagccttgaccaccygggctcaagtgatccttccgcctcagtttcctgagtagctggaactacaggcacacgccaccacacctagctaatttttgtagagatagggttttaccacatcaaactcctgaactcaggcaatctgctcaccttggcctcccaaaatgctaggattacaggtataagccactgcacctggcctacaaaaattaaaaaaaaaaaaaaagaaaaaatagcgcagtgtggtggtgcaagcctacagtctcagctacctgagaggttgaggtgggaggatggcttgagcccaggaagtcgagg

SEQ ID NO: 76819 - DNA, 601 bp, Human
ttattttttttgagactgagtcttgctctgtcaccaggttggagtgcaatgacgtgatctcggctcaccgcaacctccgcctcctgggttcaagctattctcctgcctcagcatcctgagtagctgggactacaggcacacgccatcacgcccagctaatttttgtaatttttttgttttttgagacagagtcttgctctgtctcccaggctaaaatgcagtggcgtgatctctgctcactgctacctccccctcccaggtcaagtgattctcctgcctcagcctcctgagtagctgggattacaggtgcttgccgccacgcctggctaatttttatatttttagtagagacgggatttcaccatcttggccaagctggtcttgaactcttgaccttgtgatccaccctcctcagcctcccaaagtgctgggattacaggcgttaagccaccgtgcccggctgtatttttagtaaagacggggtttcaccatgtttgccaggatggtcttgatctcttgacatcgtgatctgcccgccccggcctcccaaagttctaggattataggtgtgagccaccacgcctggctttatttatttatt

SEQ ID NO: 76820 - DNA, 601 bp, Human
cgtcccgcatcccagcagccgcggcttcagtggccctggctacatcacaaatagtgtcctcccaagggacgcctccatcagccctgaattctcagagtgactctgcctgcagagagtcctaccttcctgctttgacaagaggctgccctctttctccaaagcctggaggtacagctgcaggagctgcttggactgacgcacttcctctctttggtcaagcacctgttggagtgtgtgctgcagccgctggacggtggcacaactctgacgtagttcctgagccaggtctgagcagggagcrtcaacaagcatctaacaaacaaacacagacgcttagaaatctacagggactttctgactttcttttttttttttgagacggagtctgctctgttgcccaggctggagtgcgatggtgtgatctcggctcactgcaacctccgcctcctgggttcaagcaattttcctgcctcagcctccctagtagctgggattacaggcatgtgctaccaagcccagctaatttttgtatttttagtagagacggggttttgtcatgttggccaggctggtcttgaactcctgacctcaggtgatccac

SEQ ID NO: 76821 - DNA, 601 bp, Human
gcaagctccgcctcccggattcacgccattctcctgcctcagccccctgagtagctgggactacaggtgcccacgaccacgcctggctaatttttttgtattttttttagtagagacggggtttcaccgtgttcgccaggatggtctcgatctcctgaccttgtgatccgcccaccttggcctcccaaagtgctgggattacaggcgtgagccaccgcgcccagcctgccatgggcttttttaagacggagtttcactcttgtcgcccaggctggagtgcagtggcgcgatcttagctcaygcaacctccacctcctgggttcaagtgattctcttgcttcagcctcccaccaccatgccaggctaatttttgtatttttagtagagatggggtttcgccatgttggtcaggctggtctcgaactcctgacctcaggtgatccacctgcctcggcctcccaaagtactggcattaacaggcgtaagccactgtgcccggacaagcatgggccttttcttacaacaccaacaggaagaagtccttggaaagtttacttggagcaactctaaggtcctccaccttcaggaaatttagccaagc

SEQ ID NO: 76822 - DNA, 601 bp, Human
atctcggctccctgcaagctccgcctcccggattcacgccattctcctgcctcagccccctgagtagctgggactacaggtgcccacgaccacgcctggctaatttttttgtattttttttagtagagacggggtttcaccgtgttcgccaggatggtctcgatctcctgaccttgtgatccgcccaccttggcctcccaaagtgctgggattacaggcgtgagccaccgcgcccagcctgccatgggcttttttaagacggagtttcactcttgtcgcccaggctggagtgcagtggcgygatcttagctcacgcaacctccacctcctgggttcaagtgattctcttgcttcagcctcccaccaccatgccaggctaatttttgtatttttagtagagatggggtttcgccatgttggtcaggctggtctcgaactcctgacctcaggtgatccacctgcctcggcctcccaaagtactggcattaacaggcgtaagccactgtgcccggacaagcatgggccttttcttacaacaccaacaggaagaagtccttggaaagtttacttggagcaactctaaggtcctccaccttcagga

SEQ ID NO: 76823 - DNA, 601 bp, Human
gtttcctttaccattaattgccacgggctttttgttttttgagacggagtctcgctctgtcacccaggctggagtgcagtgacactatctcggctccctgcaagctccgcctcccggattcacgccattctcctgcctcagccccctgagtagctgggactacaggtgcccacgaccacgcctggctaatttttttgtattttttttagtagagacggggtttcaccgtgttcgccaggatggtctcgatctcctgaccttgtgatccgcccaccttggcctcccaaagtgctgggattayaggcgtgagccaccgcgcccagcctgccatgggcttttttaagacggagtttcactcttgtcgcccaggctggagtgcagtggcgcgatcttagctcacgcaacctccacctcctgggttcaagtgattctcttgcttcagcctcccaccaccatgccaggctaatttttgtatttttagtagagatggggtttcgccatgttggtcaggctggtctcgaactcctgacctcaggtgatccacctgcctcggcctcccaaagtactggcattaacaggcgtaagccactgtgcccggaca

SEQ ID NO: 76824 - DNA, 601 bp, Human
tgactctcttttggggagtgcaatgaggcagtatccgtttatgttacctctttacactgaaatgccgggtttcctttaccattaattgccacgggctttttgttttttgagacggagtctcgctctgtcacccaggctggagtgcagtgacactatctcggctccctgcaagctccgcctcccggattcacgccattctcctgcctcagccccctgagtagctgggactacaggtgcccacgaccacgcctggctaatttttttgtattttttttagtagagacggggtttcaccgtgttmgccaggatggtctcgatctcctgaccttgtgatccgcccaccttggcctcccaaagtgctgggattacaggcgtgagccaccgcgcccagcctgccatgggcttttttaagacggagtttcactcttgtcgcccaggctggagtgcagtggcgcgatcttagctcacgcaacctccacctcctgggttcaagtgattctcttgcttcagcctcccaccaccatgccaggctaatttttgtatttttagtagagatggggtttcgccatgttggtcaggctggtctcgaactcctgacctc

SEQ ID NO: 76825 - DNA, 601 bp, Human; identical to SEQ ID NO: 24646

SEQ ID NO: 76826 - DNA, 601 bp, Human; identical to SEQ ID NO: 24647

SEQ ID NO: 76827 - DNA, 601 bp, Human
aaggaagggtaatcgttaaaatgatgggaaaagctactgaattggccatcaactgaattcttgaaggagaaagaggagaaagggaatatgtgattttcggccaaaaagtcaggaactattttataaaggtgtcttgaattccaagcaataaaaacaactcagttttgacataatgaaaaaaatcattttacatttctcaaggtaaatatttgccagtgtatatgtggaagacatttcactccaaggagaaaaaaataattatttttgaatttcctccaaatgcagaattttccccaggttyatccaccaatccataggtattatgtttaaaacggcacagtcctgcatttaccaagcctgtaattgaaaagtgatttcattattaagctgtggtttattccaagccttctggataatcttgatgagtattgcacttgttgcttaactgtggagattttgtaataaaagtttaatgagttacttattattagaatgtttatagccattattttaaggtgaacaataatgacgtaaagttcgtacgcatttggtttaaaacgtattcaactcacatatcagttaatgctacagtgatttttaa

SEQ ID NO: 76828 - DNA, 601 bp, Human
tgtttgctgaacatggattttctctgtatttatttgggaggaggcctaagaggtttttttttctccttcatcatttttttcaaaaatgaaggcatatcaaaaagagaggtcacactagttaatcacaattatctctaactaaataggaggaaaaccagctagagttgagaaaaagatgacatggggacaaataaaagtcatccggcaggggttgggtgagatgcctttgagaaagtgcctttgctaatcatgattgggttttgtattaactaggtaagattaaaagagaaaaaaaaaaaamcctaagaagaatcaagagctcaactgctcctctgtggaaaacaagtttgccaaaattacaaaaagtcatttctttggtttttttataatacctaaagagcagacaagccacattctcaaaaggaagggtaatcgttaaaatgatgggaaaagctactgaattggccatcaactgaattcttgaaggagaaagaggagaaagggaatatgtgattttcggccaaaaagtcaggaactattttataaaggtgtcttgaattccaagcaataaaaacaactcagttttgacataatgaaaaaa

SEQ ID NO: 76829 - DNA, 601 bp, Human
ctgagtttccattaggggaacatttaatgcagaatctgatgcatagtagtccctcaataattgtttgctgaacatggattttctctgtatttatttgggaggaggcctaagaggtttttttttctccttcatcatttttttcaaaaatgaaggcatatcaaaaagagaggtcacactagttaatcacaattatctctaactaaataggaggaaaaccagctagagttgagaaaaagatgacatggggacaaataaaagtcatccggcaggggttgggtgagatgcctttgagaaagtgccyttgctaatcatgattgggttttgtattaactaggtaagattaaaagagaaaaaaaaaaaaacctaagaagaatcaagagctcaactgctcctctgtggaaaacaagtttgccaaaattacaaaaagtcatttctttggtttttttataatacctaaagagcagacaagccacattctcaaaaggaagggtaatcgttaaaatgatgggaaaagctactgaattggccatcaactgaattcttgaaggagaaagaggagaaagggaatatgtgattttcggccaaaaagtcaggaactatt

SEQ ID NO: 76830 - DNA, 601 bp, Human
gtctctgtttgcagataacatgattgtatatttagaaaattccatcgtctaagcccaaaaactccttaaggtgaaaagcaacttcagcaaagtctcaggatacaacatcaatgtgcaaaaatcacaagcattcctatacaccaataatagacaaacagagagccaaatcatgagtggactcccatttacaattgctacaaagagaataaaatacctagaaatactacttaaaagggaagtgaaggacctcttcaaggagaactacaaaccactgctcaagaaaataagagaggacacaaacaatggaaaaaaattccatgctaatggataggaagaatcaatatcatgaaattggccatactgctcaaagtaatttatagattcaatgttatcccatccagctaccattgactttcttcacagaattagaaaaaactactttaaatttcatgtggaaccaaaaagagcccatatagccaagacaatgctaagcaaaaagaacaaagctggaggtgtcacgctgcctgacttcaaactatactataaggctacagtaaccaaaacagcatggtactggtgccaaaacggataaagtagacca

SEQ ID NO: 76831 - DNA, 601 bp, Human
ttctagccagggcaatcaggcaagagaaagaaataaagagtattcaaataagaagagaggaagttgaatggtctctgtttgcagataacatgattgtatatttagaaaattccatcgtctaagcccaaaaactccttaaggtgaaaagcaacttcagcaaagtctcaggatacaacatcaatgtgcaaaaatcacaagcattcctatacaccaataatagacaaacagagagccaaatcatgagtggactcccatttacaattgctacaaagagaataaaatacctagaaatactacttamaagggaagtgaaggacctcttcaaggagaactacaaaccactgctcaagaaaataagagaggacacaaaaaatggaaaaaaattccatgctaatggataggaagaatcaatatcatgaaattggccatactgctcaaagtaatttatagattcaatgttatcccatccagctaccattgactttcttcacagaattagaaaaaactactttaaatttcatgtggaaccaaaaagagcccatatagccaagacaatgctaagcaaaaagaacaaagctggaggtgtcacgctgcctgactt

SEQ ID NO: 76832 - DNA, 601 bp, Human
aattttctttgaagagactaccacatttctctactcaattctgattatataacggctaatgacgtggggcagttttttcttaagtttttatttttaatttttgtagatacatagtaggcaaatatattcatgagatattttgatagaagcatgcaatgcataataatcacatcatggaaaatggggtatcatgaggcagttattattgacccattgaccaaataaaaagcagggaccattcaattggagtagtttccctagaatcacacagttagtgacagaagcaagactggattatacwtgtctgaattccagattctagatttgtccatggactacttcagctctcattccttgcctcctctttcagagtcacataatcctatattcatccatccattctttcatttatccattcattcactcatttatttattgaacaattatttgttgaatgtctgtgttatagactgaatgtgtgtgtcctcctaaaatccatatgttgaagccctaacccccattagggctatttttggaaatagggccattaggatgtaattaaggttaaataagttcacaagagagggtcaccaatccaata

SEQ ID NO: 76833 - DNA, 601 bp, Human
agaagtcacatgcattgtgaggtggcaattgctgccaaactctaatattatttttaaagtttctcttggttggataaatactggtttgagagaaaatcatacaaatgatgtttctggtatctatagcttatttttaccagaccatatattttggtctataaattatattttcaaaagtatcttatttctctaacatataaacaaaggattttccaaagtaccttacttgggaaatatattcaattttttattcttaaataaagttcagaaagatggcccctatttataatgttatctttgrcctttctcttttaaaaattttctttgaagagactaccacatttctctactcaattctgattatataacggctaatgacgtggggcagttttttcttaagtttttatttttaatttttgtagatacatagtaggcaaatatattcatgagatattttgatagaagcatgcaatgcataataatcacatcatggaaaatggggtatcatgaggcagttattattgacccattgaccaaataaaaagcagggaccattcaattggagtagtttccctagaatcacacagttagtgacagaagc

SEQ ID NO: 76834 - DNA, 601 bp, Human
gcatgatttcacttatatgtggaatctaaagtaaaaaatgataggaacagagagtagaatggttgttcccaagaactaggaggtaggggaaatggggagatgttggttaaagggtacaaactggcacttgtaagatgaataaattctggagacctaatatacagcattgtgtctatagttaataataatgtattgtatacatgaaatttgctaagggagtagatcttaagtattttcactacacacacacacacacacactcacacacacataactacatgaggtgatgggtatcttaatyagcttgattgtggtaatcattttacaatgtatatgtatatcaaaacatcacgttgtacaccttgaatgtatacaattattatttgccaattatacctcaataaagccaaaaaataaaaaataaaacaaacacaaaaaatctgttgcatatgtctaaaatctcaaattatttcattcttcttcattatcaagcacacattatttgtcagcctcctgatgctgaccaccgttgttaggtatcttagaagtgcaatgttgctgttgttgccattttaatgaatattcctgtcttagttaacat

SEQ ID NO: 76835 - DNA, 601 bp, Human
aggtcctcctttattagccaaatccagtcgctgggtaacccagagaatagaaaaagactatattgaataagtgtctctgtatgactgaaaaaacagaaatgcagagtgctggattatgaggagagtgagaattttgagaggagagagtctgaaagcagcacctgctggatgtgtgagatactgaaagactaagaaagtgaattgcagaaatatacagggatagtggatttaagttttgcataacattagtcatggaattcccctgtgatgtttctagaaaagatgtgatttggtttttaattttttttttgtgggggtaggcagaagttgatggaccttaaacaattttttttgtagttactgccaaggtgtaactataaggcacccagatttatatgcttacctaaagaaagcatcaggtatcaaatacagtactggtcgattccaaaatgataaatatttaaaagcaagaaggcatgtgtatttgcctgtgtgtgtcgtaggggatggtatacaagattgtgcagtgtgggttctagaaacattgtttctgtatcaggtgacattctatggctgacttcctaggattagattaagaagt

SEQ ID NO: 76836 - DNA, 601 bp, Human
actacctcaaactaggaaaaaaaaaacttgagttcaaagccaggtaacctgctcctacccgtacagtacattcacataaggagactcatactcatctgaaaaaatgcttcatgttcatctgtgattagtttatcctaattcattagtcagagtctttcccttaggtgaggcttccaggaaaacagggattcaggccagtagtgttgcgagaccaacaagaaatacctttttttgagggcagctggcctctgtgccagggtggagattctatgctggcatcacacacctgctgaattcttaycacaagaatctaaacaacgaaaaaagaaaaaacaaatcatgcacacctgtggctgccaaccagtgaggtttcattgccatgccatgcacacctgggaagcctgtgaggtcagctgcagtgtcagaggaaaacaacactctcagccagttggtaggaggcacaaagcatccatctcccatgggtctgtgacatgaactgactggccaatagccatagaaagtacatacacacacatcttctatgaaaggaaaaccctaagtgtaggcatggcaagaataaaagagatttcagagcagaggc

SEQ ID NO: 76837 - DNA, 601 bp, Human
aacttacaggaaaagtctgataatatattaaacttgtttattacagcttcatataattttaaataatactactttttcctttgacaagtgcaataaactctactggtatagacataggttgattatcacgagtcaactgtgtgcttaaagaaacatgcccaaacaatcagcttttgacggctgcatctcccgttatttacactcaccatcatggtaataactcaccatttctatattaataaggcagtgaaatttattatgatggcattgaaaagttattaagtactgcatcccaagtgayaaagtaccacagcactgtcactatccaaaagcagttgcccattcatcacctgcctttccagatggtcctgcatctttatcgctcccaggttggtgacatcacctgttcacccactcaaaattgatgatgaaagcaaacagatctatcttacttacatttaccaaatcaatttaatttttacaggccatggcttggtgacatattgactgttttccttaatggcatctaccgtatttaatgcaaggatgtcatctttgattcctggcttgcataatgtgtcatttcataataaatgttttc

SEQ ID NO: 76838 - DNA, 601 bp, Human
aacgtgtgacatggcctgtactcagcaacttttgagcttgttaatgaaatgttctaaggttcctgccttagctctttatttgcaaaagggtttcattccacagagttccaatgattgaaaagtacaaataaaaataccctttaaaacacatagaaagaagtcgactgttttgttaatagttaagaaaggacattattactgcataaggacattattttacatgaaaagacattatcaaaaatgatttactgcctcatgtttggaaacttacaggaaaagtctgataatatattaaacttgyttattacagcttcatataattttaaataatactactttttcctttgacaagtgcaataaactctactggtatagacataggttgattatcacgagtcaactgtgtgcttaaagaaacatgcccaaacaatcagcttttgacggctgcatctcccgttatttacactcaccatcatggtaataactcaccatttctatattaataaggcagtgaaatttattatgatggcattgaaaagttattaagtactgcatcccaagtgacaaagtaccacagcactgtcactatccaaaagcagtt

SEQ ID NO: 76839 - DNA, 601 bp, Human
aagagcacccttgactttggaaggatgatggtgatgatgattattaaaatcagtttgctttgaggtgctcactacagtttaccaagccctgctctaagctcttcacaatactttacaatgaaatattcatatttaatattcacaaaaattctatgaggtagatcctattgttaataccatttaaaagatgaggaaattgaggcaagaagtggttaagtacttgcttaaggtcacaaagctagtcagtggtagagaatttgaacacagtccatgaatctctagaactcctgctcttggtccrtgtgttatactgcctcttttgctgttgttgacaaaagtccactacagccatgctacatttgagaggatcaaatgcaatattgaggctgaactaaagtcataccccgagaaagaatgcagttcatacctatatcttttcaaagatggcgaggaatagaattatctctctaaacaatttactttcctcttaaaacaaagctttggtcttaagccaccttctctgctaacatataaaatgcagagagagatgcacctatcaaaggtgctttgatttcagatatataaaacacaactagacact

SEQ ID NO: 76840 - DNA, 601 bp, Human
gttagggatgaaggagaacgctttatgaaggtttaaatgtacagctcttacctctctcaaccctgctccaccgcactacaagaacataaattaattagacacgaagccaaaacccctagtcctcctcctgtgcactgtttagggacacttactaaagtcttcagcaaaagaaccatttaaacatgaatcaatgtttcaaatatgttaggtctagtgaaggccacttcccagtggtattcagaaaggggacaatatttaattcaaggtgtggtggctctgccaacctcaagagctctaaccyaaaagaatgaattccacaatccttccttcacaaggataaaaagagcacccttgactttggaaggatgatggtgatgatgattattaaaatcagtttgctttgaggtgctcactacagtttaccaagccctgctctaagctcttcacaatactttacaatgaaatattcatatttaatattcacaaaaattctatgaggtagatcctattgttaataccatttaaaagatgaggaaattgaggcaagaagtggttaagtacttgcttaaggtcacaaagctagtcagtggtagagaatttg

SEQ ID NO: 76841 - DNA, 601 bp, Human
tgtttataagagatagctaatgctaaaattgcctccaactcagttatctggaaagaaagaaaatcataggataatgagtcgggaattaagaagaaagcactttaaaacacaaaattaagtgaatcaactacttcatcaattttggaaaataatgttaatactatttttgcttagaaataaaatcatttataccaaaaatcattaattattaataacaattaaaatggagaactcactctaattgagactgaggaatttaaattctgactatcttggagccccacataaaaatgtttccaartggaggacaataaaaaaagatcggttttatacaagttgccatatttttgccttcatctcctgatgctactccaagttaaccctaaataagtaatgtaaatagctaagtaaaattcagaatcttttccaaaaggcagtagtgttataacatcaaccaaaccagctggtatgtagccaaaacattagagagggaaataattttaaaattaaaataaaatactatcttctaatcatgaagataaccttatttttttcttaggtatcttttaagaacttgcatttccacaagccaattactgtc

SEQ ID NO: 76842 - DNA, 601 bp, Human
tgaaacttgttggggggaaaagtatggccttaagagttagtggtagcagaaaaaccaaaccaacaattttattccaccactaaaatttttaatgtctaatttcatatcctattcattcagggagtgaaataatcataaacatcatagtaaagcttagaagtgacaatcataataaacagtaaagacaaaccaacttcattttgtccaataggcatttgagcccatactcagagcattctgcaataggactcaggaccaaatcatttcaccaacatttttcttgcaacgaagctattcaacrcagaaaagaattagggaaatagatgacctaagaagagatgacaatttcttgattaaaaatgtccctctcaagtacacaatcttatctctctctgctctctttggtggcccatttgagctgaatgagggttagagctttgctgtctggaccaaaactatgctgatgtgacttagagcctctccccaaaagggaagttacattgttgatttatcccacgaggctacaatttattttcataaaaataaaaatcaccaaaacaagttgctaaaacactgcttttttccttctcattgaataatt

SEQ ID NO: 76843 - DNA, 601 bp, Human
taattactattattatttatttcataagagaagtaaacattttatatgtagacttccttgccagacagctaatgtaaaaatgaatatttcaattctgagtcaaagaaaagattaataacttctacacatttattgccatagaccttttatttgcaatcatttcaaaaaacagactgtctttaaaacattttagtcaaataattatgaagaacagaacaaatgccttagaatgactgcatcttcagcagcatgatacattactatttcggtctacctccccctgccctcatgtcatatttgrgtacttttatttttcaaatattgagttgttttactgcctgcacagttaaggctatgattggttgttaaccacttctctaaatacttcaggagactgagaaccagagtggaactgcatttttttacatcaatataaagtcatgttcacccccattcccctccctctcatcctcccctttcccccctcccccagtgtttttctccctcacttcttagacgcatttggtaacaatcaggcttttattttaaggagccctaagataaggtatctgtgagctccacacttggagtaattgatcac

SEQ ID NO: 76844 - DNA, 601 bp, Human
tggatgttctgtaaccttttctcagagacccatttcttctactttttctcctgtctttagcaggtttttgttttggctgatgacaatgcgtaatagcctgataagttgattttgtgagtcctttttctcatctcttgagaagacactaactcgttgggacttcagagggctcgcagaggcaggagacaacaattagtttgttgaagatgtcagaaagtagcttcagagttttgccaggagaaatccttactgacagatcagtgctgacaatgttggcagctgcttgaaaagtgcagtgagyggctccagcatcttagggtccaaggaagaaggccactgctgcacattaactctgtactctggctctgtcttcagagtaggaattcctcctgactcgccagaatcaaaaaggaatgttgtatttttttaaaaaagaaaaaaagtctaagaactggagtctacaaaacattttgttaaatagcttcgttaatagctaaacaaatagaaaattgtcagtgttgctgttaatttaaatttaaatcactgcctaaataagtctttataactgttttcaaaaccttttatgtactgtacaatttta

SEQ ID NO: 76845 - DNA, 601 bp, Human
taggtctcatagcacctccgccttacagagtgtaataattatcaccctgtatcgtaactgcctgtttgcttgtaggtctccctgccctagactgtcaactctggagagctggggctgtgtcttggtccccactgtgccccaaatatctggaatggtaggcacctcacagaaacccactgaattgaaatggtgtgaactggggctatcagaaaactggagtaatttaggccaaagaaacctttctatagataacacttttttctgaattataggtatttaggaaatgtatttatgttagggttgtgtgtgtgtgtgtgtgtgtgtgtgtgtgttgggaagcatagaagctgcaagaaaaggagagtaaagggagagagggtgagaaatggatctcattcctctatgcaaggttgcacttcttcacaagaatttcattctgctgttatactacacacaatcttgtagaattcctgcctccttcattagactataaacccctagaaggtagagattatgttattttttgtctttgctgtttatcgttactcatagtgtcttagcagatcgggaggaagagagtgataggaaaagggggcttggg

SEQ ID NO: 76846 - DNA, 601 bp, Human
ctaggtctcatagcacctccgccttacagagtgtaataattatcaccctgtatcgtaactgcctgtttgcttgtaggtctccctgccctagactgtcaactctggagagctggggctgtgtcttggtccccactgtgccccaaatatctggaatggtaggcacctcacagaaacccactgaattgaaatggtgtgaactggggctatcagaaaactggagtaatttaggccaaagaaacctttctatagataacacttttttctgaattataggtatttaggaaatgtatttatgttaggtgtgtgtgtgtgtgtgtgtgtgtgtgtgtgtgttgggaagcatagaagctgcaagaaaaggagagtaaagggagagagggtgagaaatggatctcattcctctatgcaaggttgcacttcttcacaagaatttcattctgctgttatactacacacaatcttgtagaattcctgcctccttcattagactataaacccctagaaggtagagattatgttattttttgtctttgctgtttatcgttactcatagtgtcttagcagatcgggaggaagagagtgataggaaaagggggcttgg

SEQ ID NO: 76847 - DNA, 601 bp, Human
tcaaagggctttccagatacatctctctttttattttaatcttttaaaagcatgtttagattatattcatttgattttagtggagcttttctctaaaataaattgcctatacatgcacacactaacacatgtggaattccttttctgtaatcctcaaagaggcttttgattcttcttctgattctccaaaaaagagtcagtgagcaagtgagatgcgtactgggatttggatggctccagagtcactgcatacatttacatagaaaccagatggctgtggaaaatgtttcttttttatttaaaaaaaaaaaaaaaaaaggattattgaggtgtttctacagactcttatcctaaaatagataaaaagtgcaaatcaaaggcaaactaaagggaagtggcatccaaaatactgcagaagctcatcacagtttaaccacatatccctcagggggaaactcttaagaaagtcacattactaggacataggtaggaccttgtcctagagagtctggggctttcattattcagggaaaaggagggaagaaggaaaggggaaatcttggccaagaaagttgaaagtccttgcccttcgaaggcttat

SEQ ID NO: 76848 - DNA, 601 bp, Human
actgagaagctcataaaaggccggccacagtggctcatgcctgtaatcccagaactttgggaggccgagtcaggcatatcacctgaggtcaggagttcaagaccagcctggccaacatggcaaaaccccatctctaataaaaatacaaaaattagccagccatgttggcatacacctgtaatcccagctacgtgggaggctgaggcaggagaatcacttgaacccggggggggcagagtttgcagtgagctgagattgcaccactacactccagcctgcatgacagagcaagactccggtraaaaaaaaaaaaaaaaaaaaaaaaaaaagcagcagcaacagctcatacaatgatgaaacacattttaggaaaaaaagaaatggttttccagggaaaacatgtaatatcctgggaccaatctgttagaccttagacatgcagagtcatcatatgcactcacacatatgcttcacaactgttactgaaaccaggagagttatcctccctaggatctaccttgacccagaaggaaccagcttgaggaggtcagaaaccagtgctgagtaaagggccatcacttctttacccctccttccccca

SEQ ID NO: 76849 - DNA, 601 bp, Human
aaaaagaaaaaaaaaattataaagacagcaaatgccaatgagtacctactaaaggtaaatgataccaattcatccactgagaagctcataaaaggccggccacagtggctcatgcctgtaatcccagaactttgggaggccgagtcaggcatatcacctgaggtcaggagttcaagaccagcctggccaacatggcaaaaccccatctctaataaaaatacaaaaattagccagccatgttggcatacacctgtaatcccagctacgtgggaggctgaggcaggagaatcacttgaacccggggggggcagagtttgcagtgagctgagattgcaccactacactccagcctgcatgacagagcaagactccggtaaaaaaaaaaaaaaaaaaaaaaaaaaaaagcagcagcaacagctcatacaatgatgaaacacattttaggaaaaaaagaaatggttttccagggaaaacatgtaatatcctgggaccaatctgttagaccttagacatgcagagtcatcatatgcactcacacatatgcttcacaactgttactgaaaccaggagagttatcctccctaggatctaccttgaccca

SEQ ID NO: 76850 - DNA, 601 bp, Human
taataaagtttcctctttgaggagtgaaggactatacagttaattcttcctggagtgttcaccactgtaaaaagaaaaaaaaaattataaagacagcaaatgccaatgagtacctactaaaggtaaatgataccaattcatccactgagaagctcataaaaggccggccacagtggctcatgcctgtaatcccagaactttgggaggccgagtcaggcatatcacctgaggtcaggagttcaagaccagcctggccaacatggcaaaaccccatctctaataaaaatacaaaaattagccrgccatgttggcatacacctgtaatcccagctacgtgggaggctgaggcaggagaatcacttgaacccggggggggcagagtttgcagtgagctgagattgcaccactacactccagcctgcatgacagagcaagactccggtaaaaaaaaaaaaaaaaaaaaaaaaaaaaagcagcagcaacagctcatacaatgatgaaacacattttaggaaaaaaagaaatggttttccagggaaaacatgtaatatcctgggaccaatctgttagaccttagacatgcagagtcatcatatgcact

SEQ ID NO: 76851 - DNA, 601 bp, Human
atgaacattcatatctaagacactggaaggatgtacagtctatgctcaagaagtaaaacttattggacaaaaaatataaactactacattaaaagtaaattgtgaaatgctaaatggataggaaaagtgctgttagaatacaaagagtgggccgggtgaggtggctcactcctgtaatcccagcactttgggaggccaaggcaggtggatcacgaggtccggagattgagaccatcctggctaacacagtgaaacccagtctctactataaatcccaaaattagctgggcatggtggcacrcgcctttactcacagctacttgggaggctgaggcaggagaatcacttgagcccgggaaggtggaggttgcagtgagctgagattgcaacactgcactccagcctgggtgacagagcgagactccgtctcaaaaaaaaaaaagagtttaaatctggtttaactggttcaatctgatcagaaaatgtatctcagaaaagaaggtagctaaacaaagccttgaagagttgggcagtgactcttcagggagatggaatgtggacctatgtggttttgtggagggagggtgggacaagcgtggtc

SEQ ID NO: 76852 - DNA, 601 bp, Human
ggcaatcacaatacttggtaaattagatcaaaaagggcatgattccagagataagaaatggacttaactatttcccagcgtgagggaccttacaaagagtttattcaacagttttcttcacttattacggtcctcagagcaattaagtccagggataagggtttcagtggtatcagcaatattactggcttagagttgttatacgagttgtatttgttttatagaaactccttgccaattcttacattaaagttaaacaaatcactgaaatgataacactcaaaacgaattgaatgatacyaaaaagtttcaaaactctgagttttcagaaaggttaaatagctttaaaaatgtggctggaggtttttttctttaatatgacaatcattatatgatactcaagttatggttaatatccttgaaaaaaaaatccttttgtcaactggtggtctgtggcttgagacttcactgaaaggtttcacttgaaaaggctatgaaaacatcagccactgatccagaagttctcaacagctcagagatgtaaggtcattcataattgtctccatccttctttcctctctccagagtataattacttcaa

SEQ ID NO: 76853 - DNA, 601 bp, Human
tgtgctcatgagttgagaatcaaagtacacagaccgagaccttttctagagatgtttggcctccttctttagcagcaaagaggatgggaaagagacaaattcaaccatcttactggtgactggaagaaaagttattaaaaagttaacagctttgtgtctttgcatgttaggtctttggacagcattttctgggagtgtatgtaacaagaataataaattcatggccatatactaccacagttccctccagcctcaatagtaatcagtaccatgggatctcaacacattgtcactgaacccraagagcgccagattaaaaccagtttgcaattcctgtattcctttgtaataacaaaggaatcaaatatcatctagcgatggcatatatctattccatgaatgttaccagttaaccaaaattatacaacattggtgtaatgtcaccaatgtaatgacatagatatatttcattgctagatgctatataaaggcatagccccataacataaaaaaaattgcctaacacaggtaaagtcaaatatgagcctaaatatttaacaataaagttatttgttctttggtcaataattattttaccaac

SEQ ID NO: 76854 - DNA, 601 bp, Human
agaaataagaagagaatgaagagaggacaataaaagatgcccaagaatgaaagtgggaaagagaagaaaagggaaaagaaagaagagaataaaacagagacagaaggggaactagggaagagtaaatggggagaaaaaaaagcaagcattggccgcagaaactgatagagaggaaaaggcaaaaagaagaatataggaaagggatattaattttagggcaacgatattcttacttaaaaagtgctaagggaagtttagaaatttctatgaggaagctggaggattctggaatatttatagytatcccttattctcctgaatatttatgaatatttatgaagatcaacaacaggcacatttgttaagtaactactatgtggaaaacactgtgcagggccctgtgtagttcccatgccttcaattcctcttaacagctactattatcctcactttacagatggggaaattgaggccctgagtaactttccaagacacagagtgagtgagattgttgatcctcagacccagtgccacccacgctgcttttgcaatccagatatgcctgcagaatagggtgggttctgagccagctgacagggct

SEQ ID NO: 76855 - DNA, 601 bp, Human
gacccagtcccatcttatttctgacttctcatactgtatgatctgctgtacacaattagctacactttgctagaacatccagagcttcctccttccttgtcttcttcacaaggtcagctccattcagccatttctcttctttggccattaattccacaattacttcactgaccacttcctacgatggatcaagaatgaattgaccatatggcatagtaactgtcttcctccaaaattgctgcacaatgcctggcacatacttagcacttctttatagatgaacaaataaatgaactcaaasatcagtcatccatgatcatttatctctaaagatggaatgagttaagaggaaaggggatttatagcacgtgcatagttcacagtctctgcttagtccatgttctgctccaatgtaacaccatcaatgtcacctgctaactaaaattagtgtttaattagttaaaataactttccaatttttacactgattttcattgtcttagtaattctcacaactaccttttgatagaaaagtatgagaagaagaaataagaagagaatgaagagaggacaataaaagatgcccaagaatgaaagtggg

SEQ ID NO: 76856 - DNA, 601 bp, Human
agacaaccagtgaaataagaagagaatcaaaagtaaatggtttgcaagaactcaagcaactagagtttttcaaaaaagaaagaaagaaagaaatgaataactgagtcaaagtgtaaaagtaaatagtatagaatgaggcctgaggattggccattggatttggcaacatgacagtaactgatggccctaaaaagagaatctctttgatgatgtgagatgaggttgggaaaaaaagagaaagtgtaaattgcagtgttttgctctaaagaggaggagaaaaataatgcaatagctggagtgstaagtagggtctagtgagatttgtttttgaggatggaagatagcacagtgtgttcatacactaatggaaatatctagcgggagagaaaatcagatgatactacagagagagggcagaatagctgaaggatgtctgcaggaggtgagagagaatgggatcccatgtacatggaaggaaattcaccttacactagagcaaggacaccaaggacagagtgacagaaggaaaggcagaataagaggggacagatacaggaggcttggttgatttggtgatgtggcatgtagatattttcatctt

SEQ ID NO: 76857 - DNA, 601 bp, Human
agcaagttgagacaaccagtgaaataagaagagaatcaaaagtaaatggtttgcaagaactcaagcaactagagtttttcaaaaaagaaagaaagaaagaaatgaataactgagtcaaagtgtaaaagtaaatagtatagaatgaggcctgaggattggccattggatttggcaacatgacagtaactgatggccctaaaaagagaatctctttgatgatgtgagatgaggttgggaaaaaaagagaaagtgtaaattgcagtgttttgctctaaagaggaggagaaaaataatgcaatarctggagtggtaagtagggtctagtgagatttgtttttgaggatggaagatagcacagtgtgttcatacactaatggaaatatctagcgggagagaaaatcagatgatactacagagagagggcagaatagctgaaggatgtctgcaggaggtgagagagaatgggatcccatgtacatggaaggaaattcaccttacactagagcaaggacaccaaggacagagtgacagaaggaaaggcagaataagaggggacagatacaggaggcttggttgatttggtgatgtggcatgtagatat

SEQ ID NO: 76858 - DNA, 601 bp, Human
acagaatgagaagaggcaagaatgactgcaatttttttttttttttttttttgagttggagcctcactctgtcgcccaggctggagtgcagtggcgcgatctcggctcactgcaagctccgcctccagggttcacgccattctcctgcctcagcctcccgagtagctgggaccacaggtgcccgccaccatgcccggctaattttttgtatttttaatagagacggggtttcaccgtgttagacaggattagccaggatggtctcgatctcctgacctcgtgatccgcccgcctcggcctsccaaagtgccgggattacaggcgtgagccgccgtgcctggccaactccaatttttttttacctgagcacctaatagaataaggaggacactaggaggagcaggtctggggagagaggaaaaaccaaaagttcagttcttgacatgttaatattgagatgcctgttagtcatccatgtggggatgtcagctggtagttggatctccaaacgtggaattaaagggagagatctgggatagagatataaatttaggagtcatccaagtagggctggcatttgaaactgcgacattggaaagaa

SEQ ID NO: 76859 - DNA, 601 bp, Human
gggactatttggagtgtttgagaagcaaggtggccactgtggtgattacacaggagtaggtggtaggagatgaggtcagagaggagctgggcccagaccacgcggggctttgtgagcacggtaggaactttgcatttgactctgagttgggacgccactagagagtctggaactaacttatgtttttaatcagtcaccttggttgcaatgtggagaacagattatggcacaacaaagggtgaagcaaggagaccaaccaagtatagtatacactgccttcatttggcaagagatgatggtratgttgaccagggtagtgcgattgacaagaagcagatgacaactatatttttaataaataaattgatgtgatttgatgattaatttgatgtagatgtgacagaatgagaagaggcaagaatgactgcaatttttttttttttttttttttgagttggagcctcactctgtcgcccaggctggagtgcagtggcgcgatctcggctcactgcaagctccgcctccagggttcacgccattctcctgcctcagcctcccgagtagctgggaccacaggtgcccgccaccatgcccggctaat

SEQ ID NO: 76860 - DNA, 601 bp, Human
caatgttcacattttaaaaaataataacccaaaggcctagatgtagggactatttggagtgtttgagaagcaaggtggccactgtggtgattacacaggagtaggtggtaggagatgaggtcagagaggagctgggcccagaccacgcggggctttgtgagcacggtaggaactttgcatttgactctgagttgggacgccactagagagtctggaactaacttatgtttttaatcagtcaccttggttgcaatgtggagaacagattatggcacaacaaagggtgaagcaaggagaccarccaagtatagtatacactgccttcatttggcaagagatgatggtgatgttgaccagggtagtgcgattgacaagaagcagatgacaactatatttttaataaataaattgatgtgatttgatgattaatttgatgtagatgtgacagaatgagaagaggcaagaatgactgcaatttttttttttttttttttttgagttggagcctcactctgtcgcccaggctggagtgcagtggcgcgatctcggctcactgcaagctccgcctccagggttcacgccattctcctgcctcagcctc

SEQ ID NO: 76861 - DNA, 601 bp, Human
ctcatgaccttcttcatgaattctgcaggtggccagaaatgaggaggaaaaagcctgtgattcaaaaaaaagttgataccgtggtttaagatgcaatgttcacattttaaaaaataataacccaaaggcctagatgtagggactatttggagtgtttgagaagcaaggtggccactgtggtgattacacaggagtaggtggtaggagatgaggtcagagaggagctgggcccagaccacgcggggctttgtgagcacggtaggaactttgcatttgactctgagttgggacgccactagasagtctggaactaacttatgtttttaatcagtcaccttggttgcaatgtggagaacagattatggcacaacaaagggtgaagcaaggagaccaaccaagtatagtatacactgccttcatttggcaagagatgatggtgatgttgaccagggtagtgcgattgacaagaagcagatgacaactatatttttaataaataaattgatgtgatttgatgattaatttgatgtagatgtgacagaatgagaagaggcaagaatgactgcaatttttttttttttttttttttgagttggagcct

SEQ ID NO: 76862 - DNA, 601 bp, Human
atactttactaaaagacaagctcatgaccttcttcatgaattctgcaggtggccagaaatgaggaggaaaaagcctgtgattcaaaaaaaagttgataccgtggtttaagatgcaatgttcacattttaaaaaataataacccaaaggcctagatgtagggactatttggagtgtttgagaagcaaggtggccactgtggtgattacacaggagtaggtggtaggagatgaggtcagagaggagctgggcccagaccacgcggggctttgtgagcacggtaggaactttgcatttgactcygagttgggacgccactagagagtctggaactaacttatgtttttaatcagtcaccttggttgcaatgtggagaacagattatggcacaacaaagggtgaagcaaggagaccaaccaagtatagtatacactgccttcatttggcaagagatgatggtgatgttgaccagggtagtgcgattgacaagaagcagatgacaactatatttttaataaataaattgatgtgatttgatgattaatttgatgtagatgtgacagaatgagaagaggcaagaatgactgcaattttttttttttt

SEQ ID NO: 76863 - DNA, 601 bp, Human
acttttgtttttcaaaaattacctttctctaaatttttaaaatgggaactggacaaggatggagagcaatatcctcttagaaatactttactaaaagacaagctcatgaccttcttcatgaattctgcaggtggccagaaatgaggaggaaaaagcctgtgattcaaaaaaaagttgataccgtggtttaagatgcaatgttcacattttaaaaaataataacccaaaggcctagatgtagggactatttggagtgtttgagaagcaaggtggccactgtggtgattacacaggagtaggyggtaggagatgaggtcagagaggagctgggcccagaccacgcggggctttgtgagcacggtaggaactttgcatttgactctgagttgggacgccactagagagtctggaactaacttatgtttttaatcagtcaccttggttgcaatgtggagaacagattatggcacaacaaagggtgaagcaaggagaccaaccaagtatagtatacactgccttcatttggcaagagatgatggtgatgttgaccagggtagtgcgattgacaagaagcagatgacaactatatttttaataaata

SEQ ID NO: 76864 - DNA, 601 bp, Human
cagcactaaggcaaactcatgtcgccaccttgagcctcagtttcctcacctgtaaagcgagagtgtgggctggatgatgtctgcagaccctgtcaggatgtgtgatgctatgaagtgccttagaagcagctattgtgatcaccacgggcaaaaccaaacattccagcacagcacacatcaggaccggggaagaggccatttaaatgcaggacaagtgtggccttggacccttttcccattttctgttcattgacagactgttaatacccagtgttccttaactctctgtaactactaaaartaaccaaagcacacaattcccttgagccattttgcaattttttccaataacattgtgtctttataagattaaagacattttttcccaattagaaaaaatccataattctttttcacatttcacatattcgtacacattcaacatccagtccataaacatgcgctgagcacctattatatgtgattcatgtgttaggcctgaggtataaagtaaaaacacacagtctctgccttcttcagatcacttatattcaattgatcttatgaaatcgctgatactcagtcctttatgactcacaaa

SEQ ID NO: 76865 - DNA, 601 bp, Human
gcactaactggagagtcaggaacttgagtcttgcttcccgttgtgctaccacatgacagcactaaggcaaactcatgtcgccaccttgagcctcagtttcctcacctgtaaagcgagagtgtgggctggatgatgtctgcagaccctgtcaggatgtgtgatgctatgaagtgccttagaagcagctattgtgatcaccacgggcaaaaccaaacattccagcacagcacacatcaggaccggggaagaggccatttaaatgcaggacaagtgtggccttggacccttttcccattttctrttcattgacagactgttaatacccagtgttccttaactctctgtaactactaaaagtaaccaaagcacacaattcccttgagccattttgcaattttttccaataacattgtgtctttataagattaaagacattttttcccaattagaaaaaatccataattctttttcacatttcacatattcgtacacattcaacatccagtccataaacatgcgctgagcacctattatatgtgattcatgtgttaggcctgaggtataaagtaaaaacacacagtctctgccttcttcagatcac

SEQ ID NO: 76866 - DNA, 601 bp, Human
cctcatctcaaaagaataaataaataaaaataaatgcagcatcatgttaagatacatccttacttataagtgtaaatggcctcctgttaaatttttaaaatttaaagctattaataggtaacacattcaaatgtttctaaataaacaaatagtataaaaagataaacagtgaaaagcctccctaccatccttgtttcccatctacctagttccctcccactcctatagggaaccactgctcctagtttctgatgctccatagcaatttgaatacgacccaaacatcttatcctggccactraggctacctgggccagatcctgctacttctccactctcatttcctttcactcttctccctactcatggtgttctactcctctcgctttctttggtctcatgaattaaccaaattatttcctgattcaagtatttacccacactatttactttagttaggttactcttcccctttcttctatattctcctggtcccctccctcactgccatttcacagcaaggtagattctccttcactacttatttagcaaactgattacaagttgtaattatacgtaaatgtgttgacttgttccctaa

SEQ ID NO: 76867 - DNA, 601 bp, Human
ttttttctatcataatgcagaaaataagcactagcagtgttgatagcctatggcttttcacttagaatcaacaatagtggcatgtcctatgattttactttttcaacaccatccccaaacaaagcaatgaaatgtaagatgatgtgaatgagaccctgaaatttaaggaggcagaataatggtttgcaggtgtgaacattattcatattttaaactaaattaaaattttccccattactctaggaaaatcaaataatgtaattaccaagaggtaagatgcttctgatatgtaaaagatatrctaattttgatgacagttttcagtcatgttaatcaagtaaagtatatttataggatttatattactgagaataataccaaggtgaaacttacaaactaatccttcatttatagcctattctgtaaaatttataaaccccaaatacaggatccttttatgtccatttccttcaagtataaatcaatatgatgggggcaacacaaaggaggggggcttagcactgacatcagtgcagcttgtttaaatacccagatgatgtttagaagactgtacttattctaggagatgtcaaagaggggt

SEQ ID NO: 76868 - DNA, 601 bp, Human
aaatgaaagcaatacaagctttgcaaagggatttcgaactataataggggaaacttagaaacgaatccagataccaccatggatataagattctgggaactacttatcttggagagatctttaatctgaaatcactgcaagtttcatgaatatttaaggagcaaagactcagagaagacagttaaagggaaaattgctgttggctgatttttaacaaatagatccttcctagaactcctagttctcactaggaattgcctcagagacaatttccacctatagtcattactcaaggattagrgcccaagacaccacactcaggaggcccgtttattgcagacagatggttcaaaaagcagctctcccagcatgaagactgtaaacccgccgcccaaaccgaggccaagaggaggggctgggttccccacccagtgcacacccacgccagagctcctcaagattttccttcccgcccaggctgtggttgctcttccttcctcacctgattctaccaggatcaaaatgttcttggaataaaattaagtaaagattaggcctggagtataagattaggtcacccgatttgggtttgagtcgccat

SEQ ID NO: 76869 - DNA, 601 bp, Human
taaaacagaatggaaatcgatataaaaatacttcttaatatacaccatattaaatgttatcaatatgaagacacatatggttctctctttacatacaaagatacatatgtattaaatgttatatattaaatgagatatgtatattaaatgttatcaatatgaagatgcagagagaaatgtgtctttatattgataacatttcatatataatataatataaaccatattttgacatctattaatatttccatctatttatatatacatatctccttatactataattctagtatttaattarattatattagtatttaattcaaatcaaagattgaatttggccctagggtactgtaatgatttgaagatacttagaatagaatgtgtcacatggattccatctccattctaagaatcaaattcaatcacaagaagacttgggacatgaaataatctgaatttatttattcattcaacaaactcttagtaaagacaccagtttagagacattgcagctgcactgaggaggaaacactacactcccctgtacgcacggggaagtgattttacctgcaggatgaccgaatgtgtggtttcagga

SEQ ID NO: 76870 - DNA, 601 bp, Human
atttacggagtggattagctttatggtatctgtatttatatgccttctactttacaaagaataaaacagaatggaaatcgatataaaaatacttcttaatatacaccatattaaatgttatcaatatgaagacacatatggttctctctttacatacaaagatacatatgtattaaatgttatatattaaatgagatatgtatattaaatgttatcaatatgaagatgcagagagaaatgtgtctttatattgataacatttcatatataatataatataaaccatattttgacatctatkaatatttccatctatttatatatacatatctccttatactataattctagtatttaattaaattatattagtatttaattcaaatcaaagattgaatttggccctagggtactgtaatgatttgaagatacttagaatagaatgtgtcacatggattccatctccattctaagaatcaaattcaatcacaagaagacttgggacatgaaataatctgaatttatttattcattcaacaaactcttagtaaagacaccagtttagagacattgcagctgcactgaggaggaaacactacac

SEQ ID NO: 76871 - DNA, 601 bp, Human
gggctcatgctggtaatcccagcatttttttgggaggccgaggcaggtggatcacttgaggtcaggagtttgagagcagcctggccaacatggtgaaaccctgtctctactaaaaattcgaaaattagctgggcatggtggagtgcatctgtaatcccagctactcgggccagagaatcatttgaacccaggaggcagggtagcagtgagctgagatcgcacaaccacaccccagcctgggtgacagagtgagatgccatctcaaaataaaataaaataaagataatcataaacataaatraaaagattgaactgatagatgatgaagcaagatctattcactgtgcaaggatgaaaggcccctacagaatcccttcctgaaactcaggattgattgtttcaaccctgtgatattctgctttctgaacaagatgccagaattctactgtgagctctgtgcaggctaatttaggagatgcaagatatctgttatctcccagtgatctctctgagccacaaggtcagattcaactgaatattaaggagggccctgaaaaggctcacagggccactttgagaaccataagggtgaagtgcatga

SEQ ID NO: 76872 - DNA, 601 bp, Human
gcccaggaggttgatgctacagtgagctgagattgtaacactgcatttcagcctgggtgacaatgagatcctgtctcaaaaaaaaattttttttaaaaaaagacttaattgaaccgtaaatatggaagtggtaaaaggaatgcatttgcagagaaaatatcaaaactttagtcacctgggtttttgttgttgttttgcacattatttccttgggactatattgccaacctccaagctttctatgaattcacaaaacctacatcctcctctctactgaaacaaagaagaggagaaagaatamcaatgttaagcactgaatattcgataaacctaaggaacttaccattaccatatttttttcttggtcaaatatctattatctctaaaagtaaacccaaattccagcacttaattaggttcctgggggaggatatagaattgtttaaaatagagtataagcctatttgtctgtattgtctcatccagaaaggaaatgagatcaaccagataaccttcttggattccttcaagtgttgactccacagtaccttattttcaaggtcaagcaagtaagcaatatgcacaggagtagcccatgaag

SEQ ID NO: 76873 - DNA, 601 bp, Human
ttttagattatgaggatactttcaaactacatcaggcagcattatagagtaagagagaaaatgggtatgtatattatatctgcctcaatgtgtttctctggtcttcatccttagtattacaggtgaagggtattcaagggtattcaagaatagttcattttcttcttgactccgtaagcacaggaggagctcaaacatactacctccctgaaaacaaaaaagggataagaaacactttcttacttaagaaagaaaaacttaagagagaaaaaacaaagtcgaatgagcataaactgtctcrtcaggttctaattcttctgtttctatgcagaagtttttttcagataaatcttaatgtagcctaaaacgaaagaattgtgctctatgaagcagaggactctgaaaagggaaccaaagatgaattttagtccagctccatcactctcccagttgagcacagagccagtcccctaacctccctataccagggactttggacatagtcttttattatttccacattgcctaatgggggtcctttcttcatgatcatgcatgtcctttacaaatgaagcttcctttgaagacaggcaagagatca

SEQ ID NO: 76874 - DNA, 601 bp, Human
cacacacacacacacaagtgctgtcataattttctaggagtaccaggatttcactccatgaggctacttcccctcttttagattatgaggatactttcaaactacatcaggcagcattatagagtaagagagaaaatgggtatgtatattatatctgcctcaatgtgtttctctggtcttcatccttagtattacaggtgaagggtattcaagggtattcaagaatagttcattttcttcttgactccgtaagcacaggaggagctcaaacatactacctccctgaaaacaaaaaagggakaagaaacactttcttacttaagaaagaaaaacttaagagagaaaaaacaaagtcgaatgagcataaactgtctcatcaggttctaattcttctgtttctatgcagaagtttttttcagataaatcttaatgtagcctaaaacgaaagaattgtgctctatgaagcagaggactctgaaaagggaaccaaagatgaattttagtccagctccatcactctcccagttgagcacagagccagtcccctaacctccctataccagggactttggacatagtcttttattatttccacattgcc

SEQ ID NO: 76875 - DNA, 601 bp, Human
cataagaagatctggtgcagcattgtttatagaaacaaaaaacaatgtaatcaccttaaatatccaaaaactagagattaaccaaactaaatgtaatttaaaacaatgtagcaagcctatattaaataatttgaagtttctaaagtgcatagcaagtgcgtagcacagagtgagcattatataaagtatctactattattataaggcacaacatatttaatgaaaaacacaaactgcaaaaagacatacaacatgagctaatttatgttacacacacacacacacacacacacacacacacacacaagtgctgtcataattttctaggagtaccaggatttcactccatgaggctacttcccctcttttagattatgaggatactttcaaactacatcaggcagcattatagagtaagagagaaaatgggtatgtatattatatctgcctcaatgtgtttctctggtcttcatccttagtattacaggtgaagggtattcaagggtattcaagaatagttcattttcttcttgactccgtaagcacaggaggagctcaaacatactacctccctgaaaacaaaaaagggataagaaacact

SEQ ID NO: 76876 - DNA, 601 bp, Human
ccctagaaccacaactcaatctatgtctgctccctctcctcaaaggcaaccactgttatcaggtgatgtgtactagatcttctttatgcctttgcaaccattcacccttatccaagaaggtacgcataagaagatctggtgcagcattgtttatagaaacaaaaaacaatgtaatcaccttaaatatccaaaaactagagattaaccaaactaaatgtaatttaaaacaatgtagcaagcctatattaaataatttgaagtttctaaagtgcatagcaagtgcgtagcacagagtgagcaytatataaagtatctactattattataaggcacaacatatttaatgaaaaacacaaactgcaaaaagacatacaacatgagctaatttatgttacacacacacacacacacacacacacacacacacacaagtgctgtcataattttctaggagtaccaggatttcactccatgaggctacttcccctcttttagattatgaggatactttcaaactacatcaggcagcattatagagtaagagagaaaatgggtatgtatattatatctgcctcaatgtgtttctctggtcttcatcctt

SEQ ID NO: 76877 - DNA, 601 bp, Human
aaatgtctcagggtaacatttttagttctgcaacagtgcagctaacattccgagaccagccatcgtgcaactgcccataaaaaaattaacaccatcaaggccatttttctgtgcttaagctcataccaatgaaaactaccctataggcataaacttgatatttctgttcaccacacattaacccagcgttcctcagagtgtgacacccaggtgacttctgtgatgcaaatttctaaaaatctggctggaaacctgcatgatcgaataccccactcatgacagggttcaaccattgatcttygcttattttacccagcttgcacttagtcttggaagattaaccctttggcagggtgaattcacactgttaaacgcaaaggagtctctcctgagactcatgaaagtgccttagttcccagagtaggacccagagactactggagatctaacatgattcatgggagtcaaagagaagtggctaacatgggagttggggagagacataggctctggaaggaattgaatcacagattcctggagctacagaaaaccttagcagtcaccttagccctctcagtgcaccacacaactggttagtgag

SEQ ID NO: 76878 - DNA, 601 bp, Human
aggacaatgtatagtagttataaactcactgatcccggtaagaaagggacagtgttctggcctatatgtctggtatcagaatctggataataagtgatacatttttaaatgatgggttggtatctagccaagtggctaggttaaatttatgaaaactacaatagaggacaggaatgcacattcaaataagtgaaaaataaatcctaaatacgtgaaaaaattgctcactttcatggattattgaagtaggaatttaaggttccagattatatctatatctgtatctatctatctatctatmtatacttatatgcaatttataatatttatgtatttaattataattccacaacttatatattaaacatatttatgttaaatattaaactcagtgcaggtaaaatacacttatatcctaaagctttgaaaactgttataaccctttcagaaagcaagaacagaaattttataatatgtatacaaatattaaagtgtttacaatcttgataattctactgctggaaatttactttaaatacatatcaacaataggtaaagctacattcagtagggtttttgttgttgtcatggtggtgttaaa

SEQ ID NO: 76879 - DNA, 601 bp, Human
gattgaagttgaatagtgtcatcataaggttcttttcaagctagagatttggaatgaaggagtgtgtgacatcagagagctgggaacccataggccactggccagccttgagcacaatggaacactaaaagcgggagaataaaacaataagttaataacgcatactaagtcacatgctttaggagaaatctaatgcaagaggatgtgttctacccccagtacttcctatgttttctcatgcaggtggcatatcagattctaattctctataatcctttcccttcgctaggacctctgtccmttctgcagtactagtgtggtagtcagtggacaaggaggtacgaggcagcagtactgtgctattaagccattctttactcaggggacagagtaacattaatggatttccagatgtgggaggcttctagcattattgcttcttgaaatctctttgatgtcttcagagttctctactctgaatcctgtcaagaacaaaatctatacacacagggtgttatttatgaggcaacatggctgccagtcagacatcaaggaggatttttactttgataatttcctactctaaataattattttacat

SEQ ID NO: 76880 - DNA, 601 bp, Human
atatggtaaataatggcattgttgagttattcattctaaatcacttctccaccagtgagtaattactaaggatgatcttgtccacataggtcatgttgtggctaatatatagaaccttcttcatagggctctgcactgataagatgtggcaggcaggcatgatggaatgcagacagaggaccgaccttgctgtgtgggcagacagagatgggctccaaagaaactccattacttgaaaatcaatatatttgcaatatccttctctatagcaagaaagtgcaacaattatttgctaaagtaygtactgcgattattgtctctaatttgtagttctaaatatccatttttaaaatagtgagagagtttagtatttgacatagaagtcatcattggaagattgaagttgaatagtgtcatcataaggttcttttcaagctagagatttggaatgaaggagtgtgtgacatcagagagctgggaacccataggccactggccagccttgagcacaatggaacactaaaagcgggagaataaaacaataagttaataacgcatactaagtcacatgctttaggagaaatctaatgcaagaggatgt

SEQ ID NO: 76881 - DNA, 601 bp, Human
ctaacaaccaaaatgggaaaataaacactgctgctactttcttttccataaattggtggtggtggtttattgttgatgttgttgttgatctttgtttttgccttggctgatgggaggctgagagacagattctatactttcttctagctttcatcaaaattgattgaatatactgttttctcccttcttttacttctcagtatttatcttattgtacatgtctttgtttttattgtatcggtattttagttgcaagatgcctcaagtgctttgtggaagtagcagtgttataaatcaattwaaaaaaagcgaagtatcaagtgcagatattgcatttctgagactatctagtccatatggagccacagaatgctagaaggaagggagccttagaattcttctaatccaacacccttgttaatcaggtaagaaagcagatacagagaagttgacatacctaggaaataaataatcaggggccatttctcttgtaccctctcatccttccaactatgagacatatctccgcttcaaatacactgtccaaattaccacatactatactgtcttaatttatttattttatacaagtttctgaagc

SEQ ID NO: 76882 - DNA, 601 bp, Human
atgtagggaaaatatgagcacaaatcctaaactgtcaatgaaatatttattaaataaaattacttctggtttattttaatatttcaaattatatagtatgttggtagaaagataacaaatgaaaattatttttgtattccacaaggaaaaaaaaaacccactatggcccagagcagtagtgaaagtaaatgtagaaataagaaaaacaatgatgctaattagtagatagaataggaatatgatcacttccatacagagtagattcagatgacaggtattctaggttcaggatgtatgtccytagaatcaaaacctgaaatctaagtggactctgccaaatgttatgacatactacttaacttccaaattcctgggggaaaattgaacctaacaaccaaaatgggaaaataaacactgctgctactttcttttccataaattggtggtggtggtttattgttgatgttgttgttgatctttgtttttgccttggctgatgggaggctgagagacagattctatactttcttctagctttcatcaaaattgattgaatatactgttttctcccttcttttacttctcagtatttatcttattg

SEQ ID NO: 76883 - DNA, 601 bp, Human
tctgacccagtttcctcccctgcaaaatgggttcttatgaaggattaatgagttaatgcatataaagtgcttagagtagtgactgacacagagcaacgatttaaatgttaactattatgactgaaagtaggtacaaaatgggggaaatgttcattaatctctaattttaatttcttattagtgggtattaataggttcgtgtccctttatttttagataatattggactccctgacatttggtccactaaaagctttagttatattggtgccaaaattggctagacttactcatcatattytaaaatttacctttttaaaaaaatatacccagtaaccagagttctaaagaacttacattaaaactaacaaataaaactcatctgttgtaatatgttcattttcattaaaaagacatcagtctgctttgtgcttgcattagaaatagaacttaatctctgacaggcgtttctcattttccagttattctctaaggagcatatgttggcaagcatgcaatgattttttttttttttttggctctgcactgtggttgcaaatggtgtcattgttcttggttaaatctgcgaaaagtaagccta

SEQ ID NO: 76884 - DNA, 601 bp, Human
ctccactgccctaacacccatcaagtcacttggaggtatttaaggttaataatatcgactattatctgtgttcagttaaaagtgccttcacattgtattcacatgtttaatctcatgtaactcttaaaataaccaaataaagtggtcatttctagcatttctgttttacagatgagactcaggtcacatgctgaacactgacaatacaacatctatggttttgcatcccaaatctcaggctctcgactctatcatgaatatgtagtcctttaagcttaaatagtgagtttctagagctgaygccatttttaatgaaggactgccctaatgagttttattatatttaacagacaacactatgtggccaaggtggccaagacagaagccaggacaaaaagaaaaagggcccaatttttttttttaagtgtggattgttttctcttggaaaaacaatttgggttgtcctaacagctgccactttacaactgttcatagttaaatcacttcctcctacatgtctgaagataccgacaccggctcaaatcttacgttatacagtatgactggcttgaagatcaggcctaagggcatcatttagtgc

SEQ ID NO: 76885 - DNA, 601 bp, Human
agtacctccactgccctaacacccatcaagtcacttggaggtatttaaggttaataatatcgactattatctgtgttcagttaaaagtgccttcacattgtattcacatgtttaatctcatgtaactcttaaaataaccaaataaagtggtcatttctagcatttctgttttacagatgagactcaggtcacatgctgaacactgacaatacaacatctatggttttgcatcccaaatctcaggctctcgactctatcatgaatatgtagtcctttaagcttaaatagtgagtttctagasctgatgccatttttaatgaaggactgccctaatgagttttattatatttaacagacaacactatgtggccaaggtggccaagacagaagccaggacaaaaagaaaaagggcccaatttttttttttaagtgtggattgttttctcttggaaaaacaatttgggttgtcctaacagctgccactttacaactgttcatagttaaatcacttcctcctacatgtctgaagataccgacaccggctcaaatcttacgttatacagtatgactggcttgaagatcaggcctaagggcatcattt

SEQ ID NO: 76886 - DNA, 601 bp, Human
aataataataatagcctctagggaatgttcaaagatgaggtaatttgcatgtgtcttccagaaaacattaagcatatccttctcctctgccaggataattttgaatttctggcattaaaacttaaattctctaccaaaattgaccaatctcctgttaccactctatatttatgttggtgtaacagtttattctatgcagtattagactgaggctagtcacctatttaatcttcacatttttattcaaggtcttattgaagaaaatccccaaattctgtgaaatttttgcacagtttttagrttctaattcttcctactttggggctatggcaactcagccaaggagggcaaaagtgattgcttctctagagaaaacttggatatataagtttatcacctttttctttcccttttttccatcgggcacataataatttggcctttcctcaaccatcaagtaaaacccgtgagctgtggaggagctgccgtaatggtgtggataaatgcttccacttcgtttagagatgtaacctatatattaactattgatagaagcctatgttgatatctcatttcaagatagcagtgtaacccccaaata

SEQ ID NO: 76887 - DNA, 601 bp, Human
atataaataatgggtagaattactaacctgcagggaatgtcatcctaaatttcctggcgctggctatgtaactgtatgcatgactggtgtatttactggaggcagtatatactgtataatgttccccaaaaactcatgtaactaatgcaatatgataaccactagggtgctactgtgacgtaaaggatatattaccattttttccaattcaaacaagaaaaaaaaaaaaacagtctgccttaatggccctgccctctaaataaatacattgcctgctctactgaacttaaaattcaaggtyatatatgtcatcctgaagtaaaaataattctgtgggatacactttccagcaccaagatattatttgattctttgatcaattatttctaacagtcatttcaaaggtctaaatggccatgacttttactaggagaacgtaaaataaaaatgagccttcaataacacagatttcaagtgggcaaaagatggagttagtccaagaggtaacacatctccttcgggagatgctggatgttggttactatcaacgtgttttaagctggatccagtagatacactcagtcatcagtagaaaaaggtt

SEQ ID NO: 76888 - DNA, 601 bp, Human
tggctcaggggtagtctcggtgatcagcctgtttatatttctgtttccttccaaagtaaataagttaaaggcatgaaatactttgacatcattataagtaagatgctattttagaagtttcaaataacctggtcttcattcattatgacagcacagactttattggtcaagttccttacaatcatcaagtgtttgcatcaaaatcttgcactgttatgacaaccatcttcacatactactgacttctgtattgtggcttaaacataaattctcactttctgaagacatccagctggaaagkccacttcaactgccaagacgatgttccacaatttccacatctgctttagcaactctgtcacaggctcattactaattttttaatccatttttaaagatcattttgttaagtatacacccaagatagatttttatttatgaatggcttcaagttatagatgaaacatgcctgtactttactcttttcctgcctttctcaatgatttgacattatgactaaatttaagtgttctcaaaaaaaatttgaaagataattaacctattttaaatattcattctctggtttttctagaattctgtc

SEQ ID NO: 76889 - DNA, 601 bp, Human
ttgcatagacttttgtaattgacagaagtatactgcttataggaggaagagaaaagagagttgatatccaccaagtatccatgacaccgagccggtacagtaccatatttcactaatataccaattttgtgagctgagtagtatccattttataaatcaggagcctatgcagtccttcctagtcatatgccatctctaaactggttaaaaaacaatacaaaacaaaacctggagacttcatttttttctctgtgcttgtgttagccttcctaggcactagacacagggaccctctcatagygaggaacataggtaaacgtagattattggataaaagaaaacgtgtggctcaggggtagtctcggtgatcagcctgtttatatttctgtttccttccaaagtaaataagttaaaggcatgaaatactttgacatcattataagtaagatgctattttagaagtttcaaataacctggtcttcattcattatgacagcacagactttattggtcaagttccttacaatcatcaagtgtttgcatcaaaatcttgcactgttatgacaaccatcttcacatactactgacttctgtattgtgg

SEQ ID NO: 76890 - DNA, 601 bp, Human
aaggaaaaagatatttctttcaattttcatgaagaaatgagaaaaaatctggaaaacattccaaaaatcttagaattttagggcaataatcaaagttagaagtggacagagaactaatcaatggtacaaacagaagggcaggatgatagatatagaagtggtgttggagtttatctggttctagcaacagcaaaaacaggatccatgaaggctcttcttctgcttaatgcatagcttgaactgctgctagccgaccatggagcatggccaccacttccaaaatattctaaaggatcagagrtctaccaaaggaaaggatgcacaaacactgaaacctgtttgacattcccaataatccaattccttcaggtttagataatttgcccaaagttactcagttactatctcttcacattgcttgcatagacttttgtaattgacagaagtatactgcttataggaggaagagaaaagagagttgatatccaccaagtatccatgacaccgagccggtacagtaccatatttcactaatataccaattttgtgagctgagtagtatccattttataaatcaggagcctatgcagtccttcctagt

SEQ ID NO: 76891 - DNA, 601 bp, Human
caaaagttcatgtcatcttgaagcttacattctagtgatttttactatcttaacaaaccattttctcagggggaaaaaccacagtttctgtacattttatgtttcttgtaacaggaatgcacgttgaattataatttcctaaactttcatgttaaatatttgacattgttttcaacaagttctgttcatgacaaatgagataatattactctcagataacccctaaaataaggtataaaaaggaaaaagatatttctttcaattttcatgaagaaatgagaaaaaatctggaaaacattcyaaaaatcttagaattttagggcaataatcaaagttagaagtggacagagaactaatcaatggtacaaacagaagggcaggatgatagatatagaagtggtgttggagtttatctggttctagcaacagcaaaaacaggatccatgaaggctcttcttctgcttaatgcatagcttgaactgctgctagccgaccatggagcatggccaccacttccaaaatattctaaaggatcagagatctaccaaaggaaaggatgcacaaacactgaaacctgtttgacattcccaataatccaatt

SEQ ID NO: 76892 - DNA, 601 bp, Human
atgaatacaataggttaatccaacaccaaaagattgaatttggttggaaatagcaacaatgctcactatatttttacaatatgcctttctgaatctgtctgcacctagacagtgactgacataatttaaatctaatgtaatgaacttcactaatgctgaccaacaaagggatcaagaaatatctctagcgtgtaactaaaggaattctcagcaaacccatttgtaaaacaagccactgctgtttagttctttttttttttttcttgagctattcgacttcttttcctaaaagttgttttgratacacagcaatagaaaacatattaattaccatgaccttagagttatatatttatcagtaaggagcacatgtatttatgtattatatatttattctgaaaataagatgcaagcttcagaatgaaaagtataagatacatgcttctgaataagacacatgtatcagaataaatacatacttatgagatacatctatatatacttcatatgattttttgaatgtatatatttgcagaacacttttttccccagaaagaaaaggaaaacaatgataatttttataatggcttaacacaatttc

SEQ ID NO: 76893 - DNA, 601 bp, Human
aatttaggagagatggctctgggcaagatgatataagagttcattttaaaactctgtctattaaaatgttttgtaaaatatcaatacatgcagcaactttaatgtaaagttatttatttatatatactagcctagatatctttgacaaataagagtataaatcaaacaaaaattcttcacaaaatgagctttaaatttgagatgggggagaagatatgcatttagataagcataataaaagataaaaatcctcagcatccaaaaagaagaacagaaagtgtgttctggtaggttagaaaayggagatttatgggatatgaccaagtacatattcatattaataaagttctatgataatatagtaaaatagttaactatagtagcattcaaatattttattttatatataacaaatatttataaaaataatttatacttatataaatattgtatctatatatttaaatgtgacatctattgaattaaaaatgcaatcaagtcttaggctaattgtttcattagtaaaagtctacacttttactgggaaatctgacacaccaaacctgttagaatatggaactacaagtttatgcggtcaggc

SEQ ID NO: 76894 - DNA, 601 bp, Human
aaatttaggagagatggctctgggcaagatgatataagagttcattttaaaactctgtctattaaaatgttttgtaaaatatcaatacatgcagcaactttaatgtaaagttatttatttatatatactagcctagatatctttgacaaataagagtataaatcaaacaaaaattcttcacaaaatgagctttaaatttgagatgggggagaagatatgcatttagataagcataataaaagataaaaatcctcagcatccaaaaagaagaacagaaagtgtgttctggtaggttagaaamcggagatttatgggatatgaccaagtacatattcatattaataaagttctatgataatatagtaaaatagttaactatagtagcattcaaatattttattttatatataacaaatatttataaaaataatttatacttatataaatattgtatctatatatttaaatgtgacatctattgaattaaaaatgcaatcaagtcttaggctaattgtttcattagtaaaagtctacacttttactgggaaatctgacacaccaaacctgttagaatatggaactacaagtttatgcggtcagg

SEQ ID NO: 76895 - DNA, 601 bp, Human
ctatacccattgtatagtttttagatgtacatttattttattgaggttatggtgttggaaatttatataaactgtttttgatcagaggtggatagaaggtcatttcaatcgaatcaaatgtaaaattacactatcataaatgtacaaaaaatttaggagagatggctctgggcaagatgatataagagttcattttaaaactctgtctattaaaatgttttgtaaaatatcaatacatgcagcaactttaatgtaaagttatttatttatatatactagcctagatatctttgacaaatargagtataaatcaaacaaaaattcttcacaaaatgagctttaaatttgagatgggggagaagatatgcatttagataagcataataaaagataaaaatcctcagcatccaaaaagaagaacagaaagtgtgttctggtaggttagaaaacggagatttatgggatatgaccaagtacatattcatattaataaagttctatgataatatagtaaaatagttaactatagtagcattcaaatattttattttatatataacaaatatttataaaaataatttatacttatataaatattgta

SEQ ID NO: 76896 - DNA, 601 bp, Human
aaagtcttgctgagagtcgagaagttagcctgatagggtagccagctttttaaaacattgatccttaaaaaatctgtttttaaataaaatttcgtggtaatcaaatgtgatacagtctagattgccttgatatggaattatggaattgttgatgagcaataacattttgggcacaatggcttagaacacagtttaaagccaaatagagttctagcatgccaccccagtattatgggcattttatagttacatcactcattcatggtacaaaaatccaaaaggtggccctcaggggttactrgtaatgaaacaacagagaattaagatgaaccaaccaatttaaatttcacactctcctctgctataattgaaaggaaccgaggttgcagaagctgtttcagaatcttttttaaatacaaggaaacgttgtgagcagacatctcatttttattggtacttacattctgcatatgattaagcacaaacttgcaaagaattaaccactccaccaacccaatggatccgttctcaaacttgcaggaggcgggagtgtttgaaagggaaatgggggctggcgacctgaagcccactcccttgggtc

SEQ ID NO: 76897 - DNA, 601 bp, Human
tgaaggaataaatggaagggaagctaccataactgaaccatttctgattgcatccaaatcatccctagacttgacatctagtgccacaacctagtgctgctgataaatattcaaagaaaaagacagaacaacacacaattctatgatttctggactgctatcaactaaacctacaaatagtgtttgcctaagatctgcaaatcttccttggctcccggtccaaggcagaggtattgttactctaattcaggccagttgcatcctttccactttgaagactgcaaaagtcttgctgagagtygagaagttagcctgatagggtagccagctttttaaaacattgatccttaaaaaatctgtttttaaataaaatttcgtggtaatcaaatgtgatacagtctagattgccttgatatggaattatggaattgttgatgagcaataacattttgggcacaatggcttagaacacagtttaaagccaaatagagttctagcatgccaccccagtattatgggcattttatagttacatcactcattcatggtacaaaaatccaaaaggtggccctcaggggttactagtaatgaaacaacagag

SEQ ID NO: 76898 - DNA, 601 bp, Human
gccctaccttccagcatactctacagtatattgtatttatttacatgtctgatggcccacaaaaccgatttcttaggctaggaattatctaatttatctttgtctaacctagcacctatcatgtgctttgcgtgattgttgaacgagtgggcgaatgaatgaatgaaccaataaacacctaaatggctaccaagtcaaatgaaggaataaatggaagggaagctaccataactgaaccatttctgattgcatccaaatcatccctagacttgacatctagtgccacaacctagtgctgctrataaatattcaaagaaaaagacagaacaacacacaattctatgatttctggactgctatcaactaaacctacaaatagtgtttgcctaagatctgcaaatcttccttggctcccggtccaaggcagaggtattgttactctaattcaggccagttgcatcctttccactttgaagactgcaaaagtcttgctgagagtcgagaagttagcctgatagggtagccagctttttaaaacattgatccttaaaaaatctgtttttaaataaaatttcgtggtaatcaaatgtgatacagtcta

SEQ ID NO: 76899 - DNA, 601 bp, Human
ataacatgttcagggatgcatttctaggcactgttctaggaatacccttttgttgtctgtcaatttgacatctctctattcatctcttctttgagtactattctttgggtactgttatggtacccaagattatgtcctcatatattaaagccctaacacccaatgcctgagaatatgaccatatttggagataggacctacaagtattagttaaaatgagctgttatcgtgggccataatctaatctgattagcgtacttctaagaagagaaatgttggaaacacaaagagacaccagagrcatgcatgctcagaggaaagatcatgtaagtagggcatagtaagtaggtagagatctgcaagccaaggagagaggcctcagaagaaaccaagcctgccaatgccttgatcttagacttctgggccccggaattgtaaggaaatgtatttctgttgcttaagtcactcagtctgtggtactctgttgggacagccctagtaaactattacaagtacgttcatctctccatcccatttataggcagggttccaggctctcaatctcacccaaatgccctaccttccagcatactctacagta

SEQ ID NO: 76900 - DNA, 601 bp, Human
tttttttttttttttttgagacggagtctcactatgtcacccaggctggagtgcggtggcacgatctcagctcactgcaacctctgcctcccaggttcaagctattctcctgcctccgagtagctggcactacaggcgcgtgccaccatgcccagctaatttttgtatttttagtagagacagggttttactctgttgtccaggctggtctggaactcctgacctcatgatccgcccgccttggcctcccaaagtgctggattacaggtgtgagccactgcgcctggcccacatacagttyttatgtatttacctctcctctcatgtatttgttccttatgtctgctgttctttgctttaagcaatatcattctatgaaagacaatggattgggtctttatttgtgtgccagctccagggcctatgaataatattatgaaacatacacccaattctctggcaatagcctattatttaaagagatttttttaaggtatagaccatttttacatattagtaaaatatataatattataccatcacaacatattggtaaataacaattacaaccgtatctttattattaaaccttctgtgttgc

SEQ ID NO: 76901 - DNA, 601 bp, Human
gtcaacacattaaaaaggtggcttagtgcttttcaattgtttactagtgtgctagcaaagtactttactgtgggtggtagaaaattaattagttttaaataatcatttttatagaactaataatttttttaaaaaattcatcagattcaaacaatttctacaacctatcactcagacttttagaccctagtggagaacaaaactgagaggtcttaggagagaatgtttctaatgccctctccaagtaaaaatatgctctgttatagaaatagtattggatttccacacttccctacataawcctcaaattctacgcagtacagagcattgagtcttgcacatttcattatatgcttgaattaatttaccctatatggaatgtgttacctttacaataaaaaagtcgctattcattactgagagtggacagatggaacatgttcaacttaagacatcaataagaagagagggaaaaacttataatctatgtggcacagcctcctccatctggtagttcccagcttgtctgccaagccttttttttccaaataaaagtgagcatttctctttagagttaatgggacattcttagatattgacc

SEQ ID NO: 76902 - DNA, 601 bp, Human
tcattataaaggggaaatataatattattaatagaagtatcaataatgaaatatgcgaaaaacaacagaacagccacgctagggttaaatgttgaaaagccaccatccttgccacaagatagaagaaaaattcaaaccagagacattagctttaaaaaagccaaagctttgaataaagaaatttaaaaacattatcttcatattatatttgacaagctggatttagacatagtcaacacattaaaaaggtggcttagtgcttttcaattgtttactagtgtgctagcaaagtactttactktgggtggtagaaaattaattagttttaaataatcatttttatagaactaataatttttttaaaaaattcatcagattcaaacaatttctacaacctatcactcagacttttagaccctagtggagaacaaaactgagaggtcttaggagagaatgtttctaatgccctctccaagtaaaaatatgctctgttatagaaatagtattggatttccacacttccctacataatcctcaaattctacgcagtacagagcattgagtcttgcacatttcattatatgcttgaattaatttaccc

SEQ ID NO: 76903 - DNA, 601 bp, Human
ttgtattggtcttgacagccactataaagtactcccccaagtgtcagtaacaaagatgatttgtatgtggcttgcagtcttccagtgttctaatagctttctcattccaacccagaaacatggaacacagggcagctggttaaagctgatacaagcatttcttctctcagcaggctattcttgcataaccatttattttgcagagttttaaagtgcctgaaggatttaattatgtacatagacaacccctataaactctattctagggtttttattgacttttgtgctgggcagctcttargcatttcaattaagtgtttttataagaaaaacgacaatattgttaaaaaaaattctttatagatacttccaaacaggttttttcccccgtctgattgaataaactatttaattgaccaaaaaaatccaggttaattcaaagtttggtttttccactttggaaaaaatagagcgtttgagtcccagacaggtttgtgaaaatgaacctgccaatatcagtgaaagaatgggcagagggagaacaggattacttcgaaacatactctgaaacgtcacatggctacctgttactccggagttt

SEQ ID NO: 76904 - DNA, 601 bp, Human
ttgtgattcaggaaaagaggaaaccaggggttacaaaggtggagaggccaagcagaatgaaacagaccccctccatcaagtaaaaaacttggcaggataactagaaacagaccaaccctaaatcttagggttcatgagctcttagaaacataattaactgaaataaaactaatattccagtgttaaatttcaccttaacatacatcagcagttacaataacaccaggtataaagagaatccgaaactattcattttgtttatggaatgtaccttaagctagggggaaacattccttcacayattagtgtaatttctaaaatggagaaaaattatctacacaaaaagaactgtcaagtttaccttactctatcaagaagcattacttttggggaaagtgtactgatcacttatttgaaatttcttgtaattatacagagcaccagatttccaaagcatttgttcttgagaaaggaaccactaatacccaggaaagaaatgttgaacaggaaatgtttgaccaatgttgcatcacaagatatcaaaagaatttcactttggctacttcagcgaatcaagtcaggacatttttaattttcttta

SEQ ID NO: 76905 - DNA, 601 bp, Human
accactgatatattggacatactaacaatataatatattaagaataaaatctaagtaatagctatcaaaaagaaatggcttgaaaagttcacatcaagggaaacctattaactatttagaaatataagttaaaatatattataattgagattcaaataaaaagttctagacttccagatgaaaataatatgagaacttaaaaagatatttattttggggggtgtcctaataaataaactagcaagcttaccattgctgtgtcatatcctacattaatctattaatgtaatccaagaaattrtatttttttctaaataagtaaagaatagaaacctcagttacattttaaaaattacaaggaaattagtaacagaaacagttgtagatgctgtaaaaagcaatatggaaactttgaggcgaaataggacagagtacctaattccattgtgttgatataacaaagcccagacttaaaaataaaaggtttgctggctttacttatgctttagttgtagaagctttttactacaagaattcaactgctgaagttcatttcctgtctttaattctaaacgagcaatttgctgataatttcctgtct

SEQ ID NO: 76906 - DNA, 601 bp, Human
attttgtagataccactgatatattggacatactaacaatataatatattaagaataaaatctaagtaatagctatcaaaaagaaatggcttgaaaagttcacatcaagggaaacctattaactatttagaaatataagttaaaatatattataattgagattcaaataaaaagttctagacttccagatgaaaataatatgagaacttaaaaagatatttattttggggggtgtcctaataaataaactagcaagcttaccattgctgtgtcatatcctacattaatctattaatgtaayccaagaaattgtatttttttctaaataagtaaagaatagaaacctcagttacattttaaaaattacaaggaaattagtaacagaaacagttgtagatgctgtaaaaagcaatatggaaactttgaggcgaaataggacagagtacctaattccattgtgttgatataacaaagcccagacttaaaaataaaaggtttgctggctttacttatgctttagttgtagaagctttttactacaagaattcaactgctgaagttcatttcctgtctttaattctaaacgagcaatttgctgata

SEQ ID NO: 76907 - DNA, 601 bp, Human
aacaaaaatataaaagaaaattaaatacaggaattattttgtagataccactgatatattggacatactaacaatataatatattaagaataaaatctaagtaatagctatcaaaaagaaatggcttgaaaagttcacatcaagggaaacctattaactatttagaaatataagttaaaatatattataattgagattcaaataaaaagttctagacttccagatgaaaataatatgagaacttaaaaagatatttattttggggggtgtcctaataaataaactagcaagcttaccattkctgtgtcatatcctacattaatctattaatgtaatccaagaaattgtatttttttctaaataagtaaagaatagaaacctcagttacattttaaaaattacaaggaaattagtaacagaaacagttgtagatgctgtaaaaagcaatatggaaactttgaggcgaaataggacagagtacctaattccattgtgttgatataacaaagcccagacttaaaaataaaaggtttgctggctttacttatgctttagttgtagaagctttttactacaagaattcaactgctgaagttcattt

SEQ ID NO: 76908 - DNA, 601 bp, Human
gataataatagattaacactatatattttttgaaatgcagaataattcttgctttttatgggttccaaaatacttaaagatatgttacatgtgaactgctataaaagtaaattttaaattaatcacaaaaccctaattttctgacgtcctcaagcaaagttgagtaaattgttcagtttggctaaagcttgaggttctttcttgtttaatccttttttcttaaaggtaatcaaaatagtcagatatggtacaaatcattttgttggaggagaattatgcttgtggtttatttaaataatgyaataccaataaggagaactttaaagaatattagagtatttgaaatatatggagaaataaaaatggcaacaaaaatataaaagaaaattaaatacaggaattattttgtagataccactgatatattggacatactaacaatataatatattaagaataaaatctaagtaatagctatcaaaaagaaatggcttgaaaagttcacatcaagggaaacctattaactatttagaaatataagttaaaatatattataattgagattcaaataaaaagttctagacttccagatgaaaataat

SEQ ID NO: 76909 - DNA, 601 bp, Human
aatatactagctaactttaaagttatatagttcacccattttttagaagtcccatactatttaaccatttaaaatttatcctggatttttctatattggtacttaacttcacaaattttcttactctttactattaagaaattatttttggtgcaggcaggttggctcacacctgtaatcccagcaatttgggaagtccaggcaggtggatcacgaggtaaggagttcaagaccagcctggccagcatggtgaaactccatctctactaaaactacaaaaattagctgggtgtggtggtasgtgcctgtaattccagctagtctggaggctgaggcaggagaatcgcttgaacccagggggcaaaggttggagtgagctgagatcatgccactgcactccagcctgggtgatggagctagactccatctcaaaaaaaaaaaaaaaagaaaaaagaaaaaagaaattattttttctgacaaaatcaaagacatcctcaaaaactctcagattaacaaatgttgataattagcccacaaatgccagctgtagcatgatttaagtcaaacctcatgctaatttgaatatagtcatgtttctttc

SEQ ID NO: 76910 - DNA, 601 bp, Human
atgaatgaaaagactctttgactgtatgtaatagatgcttttctctgtgaataagtaacatatatttatacaataacaagtggcacgttattattaattgtgaattccaaggttaagaacctttgactttgtgtgcatgactattgagacacttcaacgtgctcagacattcaacaaactcaccacttgctttcatctgtactgagtctgtcacttgacttttgacctttcatttggcactgtcctgtcatttctttggtttcacaaattttagcttcttacttgacctctcaactgtgamctttcacttgacctatgatctcataaattctgaaatctcatacatgtaatcgagaaacaaataaacaaaacatctggatgaagctcttcctgaattaagtctgagtagatgaaacatagaaccaaaggcttcagtaagtaatgtaatatccactaggataatatgtaaatagtagaaaataaattttttgggattgactaagatacggcaaattatcaaaagactcagcattagcttctatgaaaatatttctttggtcacattaaaaataacaatatactaagttagtctggttaaaaa

SEQ ID NO: 76911 - DNA, 601 bp, Human
ataaaacttggaaaggatgcccccaccatgatatttcaaaaagcaactctttctcataagtaaactttctcttcgagtgttgcaatagaagtaactaaaaatgacgtggtttttaattaatatttgctaaacatgagtaaatgaatacataaatgaataaggggagaaataaaaccagatagggtatcaatgtgaagtctgtaagagaaaaaatctattctctaatttttaagtaagtttttaacacctcacatgatctgccatgtgtatattgtgtatatttcatgcatctgacaaaaaraaaagcctagttaggatttcccaaatttggatgttttgtatacacctcgaagagccgtcatcaaaaaagggtcaccctgattaatgataatcaatgaatgaaaagactctttgactgtatgtaatagatgcttttctctgtgaataagtaacatatatttatacaataacaagtggcacgttattattaattgtgaattccaaggttaagaacctttgactttgtgtgcatgactattgagacacttcaacgtgctcagacattcaacaaactcaccacttgctttcatctgtactgagt

SEQ ID NO: 76912 - DNA, 601 bp, Human
tgacaaataattactatctcccaaatcataggtcctggaatcaaaccattttgcttaaaaaaaaaaaaaaagggacagacgctccttgacttatatgattcaacttacaacctttttttttactttataatggtccagaaagacacgcattcagtagaaactggatttttttgaattctgatcttttgctgggctagctatatgtggtacagggcagcaccagccagccacagcctccagtcagccacatgatcacaagggcactgatggtctatagtgtactgtgttgccagatgatttkgtccaactgcaggcaaatgtaagtgtcctgagcacatttaaggtaggttaggctaagctaggatattcagtaggtttggtgcagtaaatgcattttttatttatgctttcaacttataaagggcttattggaacataaacccatcttaagtggagaagcatctgtactatccagcacataaaacttggaaaggatgcccccaccatgatatttcaaaaagcaactctttctcataagtaaactttctcttcgagtgttgcaatagaagtaactaaaaatgacgtggtttttaattaatat

SEQ ID NO: 76913 - DNA, 601 bp, Human
cacagtaacatgattttcatgctggaaatgaacctgtgcatgtctcccaatttcctgactatggaggagtaaaatatatgttgctgcttatcagttttttaaatgaattacctttccataaccacttattttacttgaaagtgacacaaagtctataacatagtagatacggttacaatatgcctgttacattttatagtgacagctgtataacttttaaaaagtgaaatgtaaatgtgtcccttcaggtcaacttcttatagaaatgtttatggtataattttattcaaagagaaatatragacagattttttggagtggacacacaattcctaccatggaaagaatagaaacagacctgaaaaggctgaaaaggtgagtttctgcccacccccacagaggtactctgtgccattcaagcgatgaccactgagaacgatagcaagggtcagttggcccctttctctggtgctttctttgattgaaaaaaatcagtattttaggttctatcaagattcttcagtacttttaagttaagcagattgaattgaaccatccatttagtcaattatgtcattgagcaaatgatggaaagagaaag

SEQ ID NO: 76914 - DNA, 601 bp, Human
atataaattcaactcctaataaatactaagcagagtttccttagacccagttgtgcgcagataagcagttccatacacacacaactaattgcagcactctctaaagctcactcgactgtcttttttatttctctgccagtgaaaccagcttttagcaattgggttttgggaaagatgacatcccaaaaaagaaccatagccaaaataaacagggttaagatggagaatactactaaaattattactgtttattccatactacagtactttccattgtaaagagcatgctgcacctaaattygtcacagtaacatgattttcatgctggaaatgaacctgtgcatgtctcccaatttcctgactatggaggagtaaaatatatgttgctgcttatcagttttttaaatgaattacctttccataaccacttattttacttgaaagtgacacaaagtctataacatagtagatacggttacaatatgcctgttacattttatagtgacagctgtataacttttaaaaagtgaaatgtaaatgtgtcccttcaggtcaacttcttatagaaatgtttatggtataattttattcaaagagaaat

SEQ ID NO: 76915 - DNA, 601 bp, Human
cacctacttgcaccagacaccaggctaaatactggggataaggaagtctacaagactcacaagtttcttgactttcaggaacttatattctggcaggacaagaagggagaggcacatcataacaagtaaatgtaaataaactaacaagttacttacaacctatggtgagtgagatgaaggacatttttaaaaaataggatgatgaaattaggagaaaaagaagtaggaaacttcagacagctatagtcagctgtagtcagagaaaacagctgtagtcagagaagtccctactgaggaaatratatttgagccaagacccaaaagatgagaatgagtcttccacacaaaaagctagggagaagcaccccaggaagagaaatctttgaggaacagaatagaaaccagtatgatgaagtcatgaagtgagtgaggggaatatcaggaggtggaagacaaatcatacatggtcccatgaccagaaaaaaaaaaaaagtgaatattatttcttaaagcaagttctcaagattttctaattcattgtttaatgaagtaatatgcaaatgtatctacagatcctatatacttggtccagttaagacag

SEQ ID NO: 76916 - DNA, 601 bp, Human
ttctctcatccttcattcatcataagaagcatgccctctacaaaagattcccaaaatattcttggtggaaataaaatctttgacaattctggatgttattgcatctatagtcttgatctctccaatttcttacaattgtagtctttttctgtttttccttttgttgtgtctattgaataaaattggaagcttctcaaatgtagtgcatgcataaagtaaacatgttgttcattctttcatttattcactttttcattcatgcattcattcacccataaaacatttattcaacacctacttscaccagacaccaggctaaatactggggataaggaagtctacaagactcacaagtttcttgactttcaggaacttatattctggcaggacaagaagggagaggcacatcataacaagtaaatgtaaataaactaacaagttacttacaacctatggtgagtgagatgaaggacatttttaaaaaataggatgatgaaattaggagaaaaagaagtaggaaacttcagacagctatagtcagctgtagtcagagaaaacagctgtagtcagagaagtccctactgaggaaatgatatttgag

SEQ ID NO: 76917 - DNA, 601 bp, Human
aatcatggaataaaatgcttgttttaaaaaggaaacaagattagaaaaatgacaacatttcaagaggcacattcaagatgtgttttcagaagtgggaatcagcacataggaggcaggagggcagcatgaccaaacttgggattttgttgctgtgaaagtgagcccaaaacaaagggtgggtatggagcagtgtccctgatgggaaccattgttttctcatccgaaagtctttctcccacagcccaagaacaattgagacaaatacattcaaaggtcaacagaacagacaatgctgggaacsccagagaacctagtagctagccctgtgctctcatcacaacagacggaaccaacaacagcccaagtagctacaagcaatctgattacaacagccttgcagcgttcctgagcagtttctgtggtttatactgagttcctcctctactgtagtctgtgccgcaaatctaccacagatttggctaaacagatgattttcttaaaaagaattatctctggtggttttgccatattccgggcaatactatactaaacagtcataatggaaatactagcacaagacctgttttttctaagctcagtg

SEQ ID NO: 76918 - DNA, 601 bp, Human
tcagtgggatttgttttctggttatggggacagagatctcatgaacaggctttgaccccaaccatctaccacaaagtagcacatttgagctaaacctttgcctttcctgaatggcaggctggacacaaacttttgcccaagaaatgcgttggaaagggggaatgggtgaaaagtcattgatatagatgcagaactgtgcaaatcatggaataaaatgcttgttttaaaaaggaaacaagattagaaaaatgacaacatttcaagaggcacattcaagatgtgttttcagaagtgggaatcrgcacataggaggcaggagggcagcatgaccaaacttgggattttgttgctgtgaaagtgagcccaaaacaaagggtgggtatggagcagtgtccctgatgggaaccattgttttctcatccgaaagtctttctcccacagcccaagaacaattgagacaaatacattcaaaggtcaacagaacagacaatgctgggaacgccagagaacctagtagctagccctgtgctctcatcacaacagacggaaccaacaacagcccaagtagctacaagcaatctgattacaacagccttgcagc

SEQ ID NO: 76919 - DNA, 601 bp, Human
aagaggtgtctaacttcacccatctttagttttttcattgtgtgaccttaggcaagtcattggctggacaccacagcttccttttgtgaaaaaggaatcttcgggcaatttagtcaaactcactattttataaaatagtcatggtgatggatttctagagaaaggtgagagcaggcccagattgtacacagtactaatattagcaagagctcactaatgggaaaaaggactagatcatttttacagaacaacaaaataaatataaacatcttaccatctgagaaaaagcaaaataaaatayatactttcttcataatattttgattataaaatatacccagagagagagagagcaggtacacatataaataaattctgaatatcataatccttacttttaaaattctgtctcctacctgttgtaattttggtataatatcctatttttcctacaccagaaatttatttgctaaatgccctatagagtaaatgtttctgagaattctgtatagattttcttttctctgtatcagatcataaggattggtaggtatcagtgggatttgttttctggttatggggacagagatctcatgaacag

SEQ ID NO: 76920 - DNA, 601 bp, Human
atatgagaaaatcaagtgacaacttgcccaaggtcctaaaaccaacaccataacacggaattaaaactagatttgtttccctttagacatctatataaaatgtagatgtattctctttgttcaagagattataaacaatgatcaataatggaaaggggaatcaaaggagttcttcaggtttcacttacagaggtcttacataaagtgcttatcaactggaaggaatttaactgactgtgctgaatctcagaacttcattaaaagcagttctatttctcccatgtatggaagaaaattttgyttttgttttttgtatacagggcaatggcaggagaatctctgaaatcatttgatttgagagtagatgttcataggctataaaaggaaatccttgccctatgtttaagaggtgtctaacttcacccatctttagttttttcattgtgtgaccttaggcaagtcattggctggacaccacagcttccttttgtgaaaaaggaatcttcgggcaatttagtcaaactcactattttataaaatagtcatggtgatggatttctagagaaaggtgagagcaggcccagattgtacacagtactaa

SEQ ID NO: 76921 - DNA, 601 bp, Human
ttctttaacttaacaaataatttctgagcacgtccccatcttgcctaacctagatggtcatttatctccttgttctcttcaaagtattctctcaccacccctgcctcacacttcttttttaatgctggtgcaaagaggtaaaataaatattatgggtaaccctggatgcattaaaggtaaccttgaacactactgttagtcttcattatatctaatatcacctgaataaaaaaagaataagagtagaagtggagtgtgagtttccacaggacctatagtccctcagaataagtttttctarctattatagagatgaataaaggaatttataataactgtatatgaagtattttatctatttaaactttgtgaattacgtattatgaatttcataaactgtaacaatacatcttttctggaacttctccacattggttctaggtctggagatgatatttatcaaatatttactatgggcgaaggaagtacagttattctccccgttttatatatgagaaaatcaagtgacaacttgcccaaggtcctaaaaccaacaccataacacggaattaaaactagatttgtttccctttagacatct

SEQ ID NO: 76922 - DNA, 601 bp, Human
tatagaaaagtacagtgctatcctgagtctatcacttcagtggaatatcctttccttcagtcatcatcttcagctacccagtaaacctcacagtaaaaactgagtggccattggggatgggaagaagggaaagaaataattctccagttttcacaaatactgagatagctcattgtttgtagtgtgacttaatttttgaatagttggcctgagtttaaaatgtatggcattcattatccaccagggactgagaagcaaggcaagggggcccgtagagaatcaagaaacctgaaaagccccwtgggctgtaagaccatccagcacttggctaacagtgcaacaatctgttgagtcgagcataaacgaaggatacaaattagatttcccctgaaagccacaagattaaacattagggggcaagttcttggcaaaatgtatgtgtgtattttccaaaaccaatcttttttaaaaaaattcacaaagtctgctaaatacattggtcagatttttctcatacttaaatatttacctaacttaaagaaacgtgattttcaggtatgtcaaagcagagatgatattgataatgctaaccaatttattg

SEQ ID NO: 76923 - DNA, 601 bp, Human
aacaaaggcctggcagtgatagagcatgcaatactggctaagtggatggaaattcaaagcaatggcaagaagaagtcttgattaagctgcagtggtcatccaacacaacgtaaacccaaatgagttgttttggtgtttgaatggcttgagggggatgccatggcttcctagggttctcaaaacgcagccccaacactttcccaggccactgtcacccacatatagaaaagtacagtgctatcctgagtctatcacttcagtggaatatcctttccttcagtcatcatcttcagctacccartaaacctcacagtaaaaactgagtggccattggggatgggaagaagggaaagaaataattctccagttttcacaaatactgagatagctcattgtttgtagtgtgacttaatttttgaatagttggcctgagtttaaaatgtatggcattcattatccaccagggactgagaagcaaggcaagggggcccgtagagaatcaagaaacctgaaaagccccatgggctgtaagaccatccagcacttggctaacagtgcaacaatctgttgagtcgagcataaacgaaggatacaaattaga

SEQ ID NO: 76924 - DNA, 601 bp, Human
actctattattgatagtaatagtactacaatatccaaccacttgatttaacagtatgtacataggaaaaggtattcatgctttactctgaaagtcagaaactccatctcctctgatttggaccgtgagcccctctattcttcctcaagttccaagccactagtagtgactcccatgacctcaggtggaacctcctgtaggttaagtgcctggccaagagaagcagagcaacctggaactcctgccattattaaaccccaaaagctcttcacaagaaaaggaagagtgcttcagaatttttytctgagccactggaatactctagttgactaccgtgccctaggttttttctatgccccactgacgggggtgcctttcatctaggatatggtgtggtatcgatactaaggagtatgatggggagctttctagagggtaagagagaaaataatctgagaggagatagagaacgtcagctcctgctgggcccatttcaagccttccttcccatctgcccttcatcaccaacaatactgttactgtgttctaaaggggccaaggagtatctgtggaagaacaaaggcctggcagtgatagagcat

SEQ ID NO: 76925 - DNA, 601 bp, Human
gctgtcaggccctccccagatgtctgaaacgcagatataaattttcattatccagcagcaaagggccagaggtacaccaaatgaattttttaccaatcaaattatagctcattgccagattaagtgtaaacactaattttgtgaagttttcttctggtcatttatctccaactccacaaagtaaccttgctgaagctggaaagacttctagatcaaattatcattttcataatcttgttgcagacactgcaaaattgaataaaaggaaattccattaataatgaacggtgccttctttcayggaacaattagatttttttcacattttctaaaagaaaatgcaaagtgaggaaatactaagggatcacagaagaaccattctggacctcagtttccccatctataaaatggtgagactggatacagtaatcgctaattctgtggtataagaatgactctaagtatctctgctttcatactggcaaatttcattttcaaagtcctatatttttttttttactatatgttaagttctagggtgcatgtgcacaacatgcaggtttgttacatatgtatacatgtgccatgttggtgtgctgca

SEQ ID NO: 76926 - DNA, 601 bp, Human
aacagtgaagcccacatatggtgccctgactggtcacatgattttttaatatccacatgatggcactaaaatggcctattagatttacagtgtcattaactttccaaaataaaaatgagagtctgctctggcagcggggaaaaaaagtgtgagtgctgttgggttttgggtaaccagtctatgaggaaatgctgacaggggtcagtgtgacatcatctttcattcagccccaaagctgtcaggccctccccagatgtctgaaacgcagatataaattttcattatccagcagcaaagggcyagaggtacaccaaatgaattttttaccaatcaaattatagctcattgccagattaagtgtaaacactaattttgtgaagttttcttctggtcatttatctccaactccacaaagtaaccttgctgaagctggaaagacttctagatcaaattatcattttcataatcttgttgcagacactgcaaaattgaataaaaggaaattccattaataatgaacggtgccttctttcatggaacaattagatttttttcacattttctaaaagaaaatgcaaagtgaggaaatactaagggatca

SEQ ID NO: 76927 - DNA, 601 bp, Human
ggctaacattagataacagtcattaatggttatttttaaatacttcggtaacattttggagtaaactcagaaattatttcaatttccctttacatacttctatctggctacacaattaccctagcatccaaaaataattgtttcctgccttcccaccttcttttgtgaaagagtgtgaattgtgtgcccagttacctttagcccccttggacccatgggctttttgctgtactcaagagcacagcttttggagacgtaaagagatgttaaaaaaaaaaaaaaaagccagtggcagctcctsgaagtcactctggtctggttttgaatgggttgggctaagtgatcactaagaattcatctggctgtcaaatctcacaacttttggctgacgtgtccttcaggaaaagggcagcaagaactggtaaaatagaaaaaaaatcacttaaattgcttgcattcatttattcattatctacgtatccacttcattcactcgtttatgcatcacttgcttctaaatatttttaccctgtccaaaaggcattatgatgatacaaaggtaaatcagacttcagctctgtcaccaggtagtttggccttt

SEQ ID NO: 76928 - DNA, 601 bp, Human
ttgtcctaattttatgaggctaacattagataacagtcattaatggttatttttaaatacttcggtaacattttggagtaaactcagaaattatttcaatttccctttacatacttctatctggctacacaattaccctagcatccaaaaataattgtttcctgccttcccaccttcttttgtgaaagagtgtgaattgtgtgcccagttacctttagcccccttggacccatgggctttttgctgtactcaagagcacagcttttggagacgtaaagagatgttaaaaaaaaaaaaaaaagccagtggcagctcctggaagtcactctggtctggttttgaatgggttgggctaagtgatcactaagaattcatctggctgtcaaatctcacaacttttggctgacgtgtccttcaggaaaagggcagcaagaactggtaaaatagaaaaaaaatcacttaaattgcttgcattcatttattcattatctacgtatccacttcattcactcgtttatgcatcacttgcttctaaatatttttaccctgtccaaaaggcattatgatgatacaaaggtaaatcagacttcagctctgtcac

SEQ ID NO: 76929 - DNA, 601 bp, Human
gtatcatcatcatcttcttcttcaccagaactatcacctttgtcctaattttatgaggctaacattagataacagtcattaatggttatttttaaatacttcggtaacattttggagtaaactcagaaattatttcaatttccctttacatacttctatctggctacacaattaccctagcatccaaaaataattgtttcctgccttcccaccttcttttgtgaaagagtgtgaattgtgtgcccagttacctttagcccccttggacccatgggctttttgctgtactcaagagcacagmttttggagacgtaaagagatgttaaaaaaaaaaaaaaaagccagtggcagctcctggaagtcactctggtctggttttgaatgggttgggctaagtgatcactaagaattcatctggctgtcaaatctcacaacttttggctgacgtgtccttcaggaaaagggcagcaagaactggtaaaatagaaaaaaaatcacttaaattgcttgcattcatttattcattatctacgtatccacttcattcactcgtttatgcatcacttgcttctaaatatttttaccctgtccaaaaggcatt

SEQ ID NO: 76930 - DNA, 601 bp, Human
gggaaaggcactctatacaataatgtttaaagatgtaattctagaatcaggctgtttggatttaaaatccatctatgccttgtattggttgcataaccttaagcaagctacttacactctcttctttttctcatctgtaaaatgggcaaatactggaactatcttgcagtgttgcaaagattaactaaagtaatccttacatagaatttagcatcatttttgaaacaatatgcagtaaacaaatgttaactaatagtatcatcatcatcttcttcttcaccagaactatcacctttgtccyaattttatgaggctaacattagataacagtcattaatggttatttttaaatacttcggtaacattttggagtaaactcagaaattatttcaatttccctttacatacttctatctggctacacaattaccctagcatccaaaaataattgtttcctgccttcccaccttcttttgtgaaagagtgtgaattgtgtgcccagttacctttagcccccttggacccatgggctttttgctgtactcaagagcacagcttttggagacgtaaagagatgttaaaaaaaaaaaaaaaagccagt

SEQ ID NO: 76931 - DNA, 601 bp, Human
agaacacttacttgcttcttttctcaaatattgccttttcagtgagacctcccttacctaaaatttctacctgttcctcccacctgctaacacttcatattcctcttacctgctttattttatctttcttgcatttaattttatttttattattattttttgagatggagtctccctctatcacccagactggagtgcagtagctcgattttggctcactgcaacctccgcctcccaggttctagcgattctcctgccccagccccccaagtagctaggattacaggtgcccaccaccacrcccagctaatttttgtatttttagtagagacgggatttctccatgttggctaggctggtctcaaactcctgacatcaggtgatccacccacctgggtcttccaaaatgctgggattacaggcttaagccaccgtgcctgccaataagctacacttttttcttaacttttttattgtcttttctcaccagtagaagagaaagaccataagggcaggaatttttgtctgtcttgttgactagtgtatttcctgaggctcgaacaatatccggcgcatagttggggcttaaaaatcatttgct

SEQ ID NO: 76932 - DNA, 601 bp, Human
aaagaacacttacttgcttcttttctcaaatattgccttttcagtgagacctcccttacctaaaatttctacctgttcctcccacctgctaacacttcatattcctcttacctgctttattttatctttcttgcatttaattttatttttattattattttttgagatggagtctccctctatcacccagactggagtgcagtagctcgattttggctcactgcaacctccgcctcccaggttctagcgattctcctgccccagccccccaagtagctaggattacaggtgcccaccaccrcgcccagctaatttttgtatttttagtagagacgggatttctccatgttggctaggctggtctcaaactcctgacatcaggtgatccacccacctgggtcttccaaaatgctgggattacaggcttaagccaccgtgcctgccaataagctacacttttttcttaacttttttattgtcttttctcaccagtagaagagaaagaccataagggcaggaatttttgtctgtcttgttgactagtgtatttcctgaggctcgaacaatatccggcgcatagttggggcttaaaaatcatttg

SEQ ID NO: 76933 - DNA, 601 bp, Human
cccaaaatcattcagggaattaaaaagttctctctttacttactcttacagttttattttgacagacaatgttgcaccgtatccaatttaaatttgtgatgacagtggatttgggcgtgcaaatgtgacagagaactttctctttctccccctccttctacaccacacacctacccctacgtatatagctgcgtgtgtgtgtgtgtgctgtctcctgagctatgtcatgatcttggatgtgtgtctgtggggccccagtgttgctgctgtgggctttttgcaacaactataaaattcagcrcattatcctcatctcgctataacagcaaacatcgaagtatcacagaatcaaaggaattagttgaaaataatttcatagacagaggtacttagctttttatagctctggctcaacttgaatatcaatctatattaggtcctttaaaaaaaaatttaataggccaggcgcggtggctcacgcctgtaatcccagcacttcgggaggccgaggagggtggatcacgaggtcaggagatccagaccatcctggctaacatggtgaaaccgcgtatccactaaaaatacaaaaaaattagccagg

SEQ ID NO: 76934 - DNA, 601 bp, Human
ttttattttacaaaataaaatatatatgtaatatatatatatataatccccataatttcaaaatttataaaaatttcagcatagggtagtttttctcactcatctacaaacataatcagaatttacaacatggccttgacaacaattttattatacatcctaaattctcagtgactctaattaaatattttaatagctctatagtgaaattaatgcttagggcagtaatcatttgactactataaatcatgtaaagctaaaagtttagtaatatagcttataggttgataatccagaagakaaatatatttttattttaatgggaagagacatcttactgtgtgcttttaaaataaattaggtttaagaagtctacaaattctgaaaagttacaggaaaaaaaaaggatccattaatcaaaattgtgtgacatgaaaaaatttcatttttcagaatgatctttaagaagataaaactttcaacagggatcacaagagctgggttgtttaatttgcagtagaatttttgaaatctggaggaaggatgacactcaaatcagatgtatgcacttgacttgtcaatgtaatggaaagttacttcg

SEQ ID NO: 76935 - DNA, 601 bp, Human
tcaaaaaactatatatatatttattttacatattttattttacaaaataaaatatatatgtaatatatatatatataatccccataatttcaaaatttataaaaatttcagcatagggtagtttttctcactcatctacaaacataatcagaatttacaacatggccttgacaacaattttattatacatcctaaattctcagtgactctaattaaatattttaatagctctatagtgaaattaatgcttagggcagtaatcatttgactactataaatcatgtaaagctaaaagtttagyaatatagcttataggttgataatccagaagagaaatatatttttattttaatgggaagagacatcttactgtgtgcttttaaaataaattaggtttaagaagtctacaaattctgaaaagttacaggaaaaaaaaaggatccattaatcaaaattgtgtgacatgaaaaaatttcatttttcagaatgatctttaagaagataaaactttcaacagggatcacaagagctgggttgtttaatttgcagtagaatttttgaaatctggaggaaggatgacactcaaatcagatgtatgcac

SEQ ID NO: 76936 - DNA, 601 bp, Human
cagatcactgaggtcaggagtttgagaccagcctggctaacatggcaaaaccccgtcgccactaaaaatacaaacattagctgggcactgtggcacgtacctgtaatcccagatacttgggaggctgaggcagcagaatcacttgaacccaggaggtggagattgcagtgagctgagatcacaccactgcactccaacctgggcaacagagcgagactccatctcaaaaaactatatatatatttattttacatattttattttacaaaataaaatatatatgtaatatatatatatataatccccataatttcaaaatttataaaaatttcagcatagggtagtttttctcactcatctacaaacataatcagaatttacaacatggccttgacaacaattttattatacatcctaaattctcagtgactctaattaaatattttaatagctctatagtgaaattaatgcttagggcagtaatcatttgactactataaatcatgtaaagctaaaagtttagtaatatagcttataggttgataatccagaagagaaatatatttttattttaatgggaagagacatcttactgtgtgct

SEQ ID NO: 76937 - DNA, 601 bp, Human
ggcagatcactgaggtcaggagtttgagaccagcctggctaacatggcaaaaccccgtcgccactaaaaatacaaacattagctgggcactgtggcacgtacctgtaatcccagatacttgggaggctgaggcagcagaatcacttgaacccaggaggtggagattgcagtgagctgagatcacaccactgcactccaacctgggcaacagagcgagactccatctcaaaaaactatatatatatttattttacatattttattttacaaaataaaatatatatgtaatatatatatatataatccccataatttcaaaatttataaaaatttcagcatagggtagtttttctcactcatctacaaacataatcagaatttacaacatggccttgacaacaattttattatacatcctaaattctcagtgactctaattaaatattttaatagctctatagtgaaattaatgcttagggcagtaatcatttgactactataaatcatgtaaagctaaaagtttagtaatatagcttataggttgataatccagaagagaaatatatttttattttaatgggaagagacatcttactgtgtg

SEQ ID NO: 76938 - DNA, 601 bp, Human
attcaagggaaccactttgaagacaaactagggtcgtgcatatggatctctccagaaatgatgtgtcagttccaaggctggcattccgcctcagctggcatctagcagttttcactcttccaggcaatttggcccttgatttcaaacaaatgcatcctgaaggcctaatgccaggaatagtttgatatgatttatgcttcatgttttctcacaacccagaaaattttagacctgaaaggcatattttttcattatttagcatttgccatgagtcgtatgtaagccaaagttattttagtgycaacctttatttttctggacctctgagtagagtcaactcacgagtgtttccacgtcttgtttgttgcacaatagggaagttttctggctgctttcattgatttccaaatcccgaatctttcttttctgatggtatgatggtgaaaataaccttatttggttgccatcatttgatgtcaaaatgacgaccatctaaactactttttttctcactaggtttactcttttaaccaaattcatagcaactctctcttacttatttcaagcctatgggatagaaataagttgtgtcatttctagt

SEQ ID NO: 76939 - DNA, 601 bp, Human
gcttttcttatagggctttgaaaatagaaaggcagttgttagaaaatcagtatcatttattgaaagtagccatgtttgtttaactttattttatattccactctattccttgcacaatattcctcagattaaactcctccaaaagtaaagaacaaaacactaatgtgaaaaaaaaagccttatgaagtattttccaggagactcattgtcttttttttccccctcctctttccttttttttttttttttaaaaaagcagactttcttcaaaagaagcaattttacatggtgtgtaaaaccraccttggacaagaaatggaacacaaagataaatcatttgtggtgaatttaaacatgaatccgtggagctcctccttttctgaaatcctccatttcttttaaaacattctggtaataaattgctgtgagtttttgccatatcctatgtccttactcactgggaacaattgatgcttggaacccattcaacgatggttacatagatttgtgaaaacaggagccggctcagctttcctttaagagttgtttagtgaagttatgctcattgactttttactcttattattaaaattcctcatta

SEQ ID NO: 76940 - DNA, 601 bp, Human
tgcaaaaatcagagcatgtgaagatttagaaaactaaaagcctaaaagcccaggcttttcttatagggctttgaaaatagaaaggcagttgttagaaaatcagtatcatttattgaaagtagccatgtttgtttaactttattttatattccactctattccttgcacaatattcctcagattaaactcctccaaaagtaaagaacaaaacactaatgtgaaaaaaaaagccttatgaagtattttccaggagactcattgtcttttttttccccctcctctttccttttttttttttttttaaaaaagcagactttcttcaaaagaagcaattttacatggtgtgtaaaaccgaccttggacaagaaatggaacacaaagataaatcatttgtggtgaatttaaacatgaatccgtggagctcctccttttctgaaatcctccatttcttttaaaacattctggtaataaattgctgtgagtttttgccatatcctatgtccttactcactgggaacaattgatgcttggaacccattcaacgatggttacatagatttgtgaaaacaggagccggctcagctttcctttaagagttgtt

SEQ ID NO: 76941 - DNA, 601 bp, Human
aactttcttttcttttcctttgattaaaaaaatgtttataccatgtgaaatattcaactttttgctccattttgactccatgttctcaacttttatcctattaaaaaagtgttatgggggcccattttcaaagagggacacacctaaataactccaaacagatgagcctgaaccagttttaaagatcataagagaaagaaatgccataggctttttggtggctttaagtttttctttttaaacaaacctagctggcccttaaacagaaaaaatcggcaaagttatgttttggtactctttraagactgacctgactttatgaatattttaccaataatacaaaattaaatcaatgtatttgcccagagaaaatgaagtttttatttgaaagaaggccctaaaactaaaccagaagtttccgtttattttaccaactgagaccctgacttgagcagtaaacacttcctgctcccatggctgaagggctatatattatctgaaataatttctttagtctgtgactggaggaagaaaagtgacttgcccttatttatcttttttaggggctacatggattttagtgtccttgaaaacaagtgat

SEQ ID NO: 76942 - DNA, 601 bp, Human
taaactaaagagcttctacacagcaaaagaaactgtcatcagagtgaacaggcaacctacagaatgggagaaaatttttgcaatctacccatctgacaaagggctaatatccagaatctacaaggaacttaaacaaatttacgagaaaaaaacaaacaaccccatcaaacagtgggcaaaggatatgaacagacaactcaaaataagacatttatgtggctaacaaacataggaaaaaaagctcaatatcactgatcattaaagaaattcaaatcaaaaccacaatgagatattgtctccygccagtcagaatggcaattattaaaaagtcaagaaacaatagatgctggtgaggctgtggggcaataggaatgcttttacactgttggtgggaatgtaaattagtgtaatcatcgtggaagacagtgtggcgattcctcaagtatctagaaccagaaatagcatttgacccagcaatcccattactggatttatacccaaagaatataaatcattcttctataaagacatatgcacatgtatgtttattgcagcactatttacaatagcaaagtcatggaaccaatccaaatgctcatca

SEQ ID NO: 76943 - DNA, 601 bp, Human
tataacaagatagaaaagtaattattactttacctctttacagataagaaaattagaactcagtgagaggaaggaatttgcctgctctcacacagctggcaacgagtctgagattcatgtctaaatctattccaaagctcttgacctttctattataacacagtcttagtcttctagtcagcaatatatatatatgtgtgtgtgtgtgtgtgtgtatatttatatatgtgtgtaaatatacaatatataatgtatatatacacaatgttatattacattatatatacattatataatatgkattatattatatatataatgtatagcaaaagatttgggtacatttattaaaatttgtggtacaatttgtgtgaaatgccttcactccagttatctgtctataaaacaaaagctcataacagcttctgtttataattcaagcagtcaagttactagtaaaggaaagacacagtgggatttgggtaataaataatgtcaatctaatagcattattatagatatcccaaactagtaatggcagcacttaggacatatttaggcatattttatttaaattaccttatatgttaaagtaaggatc

SEQ ID NO: 76944 - DNA, 601 bp, Human
ggccacaccgtactgtacattccattcccttctgaaaagttaagacaaggctttcctttgacataacaccgggatcccctatatattgtaaatacagtgtactagccagagttatttaaattcttgagacgtcaactctaggatgggtcagaatagaaagagtaagctgccaggaccaagggtatcagcggtaattaaaaaatgggaggattcaggaagaggaagattgacataaacacacattcaaatagaagcttctcatcttaagggagtattttcatgttttggccaaattagatcrcttagaattttagagtgttagaattgaatgaattttagaaatcatttaactcagatattgcaaactggtgtcctgggggccaaattaagccccacaatataaataataatcacatgaacaaaaagttgggattagatgctaataataattgaaaatgttcaccccaaaaaggaaatttctacttctctttaaaaatggaaagacttggtaacacttaacttgcatcttcccttagaaacaacttgctggggctgagtagcgcagccccctttagaacagaagtgagtcccctgcttgcca

SEQ ID NO: 76945 - DNA, 601 bp, Human
tttcctgagtcataatgccaacttggctaaacgatcgtacatttccaatcatgcttaaataaacataaaatttatgtatggatgagaaggacatttcatagataatttttctggcttcagtatcaagcacattcatatttttctcctaaatctgaaaccaaatgtttgctttcctaatatttttccttcctactggatttttctttccttcttctatgtggtcacccacagcctggcctttgtgtattctcccaagaaagaattgtttatttatattagcagtcctttcaggggttccctrtagactctgtttccaatggtatgtggagttactaagcttttattgttgacaagtggtaggtgggatccaagcttttgtggttaaattgtttattgataattacctgttaattaccctgctgcctgactcctgtaatttactataatcattactttcctttttcttgaaaaccatgtgctcaaaaaacaaaaagtgaagacaaaaaatatacttcttaccacctttttaaaaaatggttggttttttaattaaaaccatttagagtcagagtatttttcatcgtataacatttggatttgg

SEQ ID NO: 76946 - DNA, 601 bp, Human
tttaggcatacctccctaaaaaactgtgagttacgttacacatgcacaacaccataactacacccatttctgggtcttattgaaatctgaaaggagaatgatcaataaaattcttataacaatcccaagaagatcttgccaaattgtaccaaagggattagataagttgagaccatagtttcatcctagcgttactctgtcatttcatgaaacatacactgtatatttccatgttttcaaaggttagctgtgagccatggaaactgtatactttaaatatctgagtatatctgtatatctwaatatctgagtgaaaattggtggaaagccatccatttaagaagcatacaactctgcttatgtttttaaagatatttaatatcaagatatagtaaaacgttgtgttctgttttaggcaatgcaaagagttaagtagatttacatgaatggagtgggagctgggggaggacaatgaatgtccttcctcatttcaaaggtcaaagacagcattaattatttttaactaatgtcgtatttaaccacatgcaaacttaaatcagtttgggtctaaccaattcaaagctattctttggttccctgc

SEQ ID NO: 76947 - DNA, 601 bp, Human
ttaattttggaagcaatgaagagcaaaataaagacttatcctacattaagtaggagactgtttatttagaacctgctttgaggttacttctgctctttctcttccgtcagcaccccagcagagctgagtagatttcctgatgatagaggccctctttgttcacagtgaagtggagattggcagaaaaggaaaaatcgtggggaaaaatggtggagaaaaatggaagaggaaacatgttaacttcttttcttttgttttctttcttttcttttctggaaacaagttctcaccctgtcgcccrggctggagtgccatgatgcaatcatggctcattacaatctcaaactcctggcctcaagtgatcctcctgcctaagcctcttgaagtgctgggattacaggtgtgaggcacaaaacctggcttcatttttctttctggtttcaaagcattataatgcaatttaggcatacctccctaaaaaactgtgagttacgttacacatgcacaacaccataactacacccatttctgggtcttattgaaatctgaaaggagaatgatcaataaaattcttataacaatcccaagaagatcttgccaa

SEQ ID NO: 76948 - DNA, 601 bp, Human
ctgcatgagatggcattttatatctatatctcacttgatgctcagacattctatatttcctccccaattctcagctatcatatgtcctgagataatcattttctaagaggaaagaaaaattttaaaacaacaacaatagtaaagacttagtttgaaaagtaaagttgctagaggcacaaaatggtttgtgattaattcataaacacacacacatacacgtctcacattgtaaaatacttcacaattttcataaagctttaacatgaggcatgtgttttattttcatatttgcttagtgcasatattaactacttgtctcactttgaaattacctactgagaagtttattaacaagcatcctaattcagtggtaataagggcaaaacaagaaaaaatgagtagcattcacactttaaataaaaatagagttctaaatggctattattaaaagtcaaaacataaaagatgctggcaaggttgcagagaaaaaagaatgcttatacactgctggtgtgaatccaaattagttcagccattgggaaagcagtgtggcaatttctcaaagaacttgaaacagaactaccatttgacccagcaatcc

SEQ ID NO: 76949 - DNA, 601 bp, Human
acctctgcattgtcaatgttccattataattaaacaagatcctgaataccccaggtgaaatgagcctgctgtccaggtggatcaatgcttggtctaaccagagctgatgcccaacagggcctttccttgcagggccagtgaccgtcatattgagaatgcaagtctgaagactgcagtttgtagaatgtgactaaagcaaaaacctgccgcataaactgtgtttgttctttagacaatttttagaattaactgactctatagtagcttaagaaacagcatacaattttataacggaaaaagktgataattttgactaggctcacaatcatttcttgttaggttgtgagataacttttattaacgccagttaattccttcctcaggcctgtgtcactttataaccctctgcttaagagaaattaattgtatgaattcaggtaagacaagaactaccataatagatgttttcactcttgcctttacttttctctgatataccttaaggtggtcagaggtaaaagctaaagatgcattgtagcctgagggatgattgaatgaaaaaaatgggggatgggaacagaacctactgggatagaccaat

SEQ ID NO: 76950 - DNA, 601 bp, Human
gcaatttaaaggttaaaaaaaagcttgtttgtaaacatcttaataaataacagcaacaacaataacaatcatataggcatgcatgactatattttttcctcctgaacaacatatctcaggaattgttgggcttacacatctggaaagccatatttgtttgtgtattttccatgctgacactgccaagaaactaaatgcagttgagtgttaccgctgaaatcaccaggagtcctagtgccaggctgtgccagaatttgccactccaagttgcagtcagtctttcaacctcagaattaaatasagcatccgccaaagtagtatcagactgaagctgcttaagtggctttgaccattaaaaacatacataattacacttacattctgcgtgcaaatattgtgctatcatttgagagtgcaaataagcagtcagccacaacccagaaagacagtagtctacaagagagatgaaggactatggtagagacgggactgtggatctgtgtcccatctcagccacatacagctatatcattctagcaagttatagaacatctttcaacctcagtttccacatctacataataagaacagtcatacctgc

SEQ ID NO: 76951 - DNA, 601 bp, Human
tctttaagtaaaatttaatgaaaattttattgaataatgactcatatatgcttttcaaagacagtgagaatgtagcttataaaatcagttactgtacctttcaagatgaataagcatgatttggggaacaagtgcaattttctgataaaggaccaacaaggtaccttctctgctatataaaaaaatcttaaaaaatgcttgtttgtcactgcatgttctcactcataggtgggaattgaacaatgaaaacacatggacacaggaaggggaacatcacacaccggggcccgttgtggggtgsggggagtagggaaggatagcattaggagatatacctaatgttaaatgatgggttaatgggtgcagcacaccaacatggcacatgtatacatatgtaacaaacctgcacgttgtgcacatgtaccctaaaacctaaagtataataaaaaataaaataaaatgcaatttaaaggttaaaaaaaagcttgtttgtaaacatcttaataaataacagcaacaacaataacaatcatataggcatgcatgactatattttttcctcctgaacaacatatctcaggaattgttgggcttacacatc

SEQ ID NO: 76952 - DNA, 601 bp, Human
acacaaaaaatatctaaaaaggaaaagcagatgagaataaggcctttcaatattttcatggaaaaacatttaaagaaaaaatattaaataaaaaatatttaattctcaaggatgacatggctaaaaagctaaagctcattttgaatttttggaatgttaatcacctatttcaaaagttttgattttagaaattaaaagtcattgttacaatttaagttatagctatataaaactatggttagtgttagtttaagggttatagttaagtgttacatgtttaagactaaagagaaatgaataytaattgaaattaacctaatccattggcaattcttttattaaataatgttcctttttatgtctcatgttgcactctgaaaataaataacaaagataacaaacttttcctccaaatactaatactgtaatgacaaatgattacaaaatctttaagtaaaatttaatgaaaattttattgaataatgactcatatatgcttttcaaagacagtgagaatgtagcttataaaatcagttactgtacctttcaagatgaataagcatgatttggggaacaagtgcaattttctgataaaggacca

SEQ ID NO: 76953 - DNA, 601 bp, Human
ttacagaataaggaattattagcctaaagacgttttagaactgcacaggggtcttcaatggtattacacaaaaaatatctaaaaaggaaaagcagatgagaataaggcctttcaatattttcatggaaaaacatttaaagaaaaaatattaaataaaaaatatttaattctcaaggatgacatggctaaaaagctaaagctcattttgaatttttggaatgttaatcacctatttcaaaagttttgattttagaaattaaaagtcattgttacaatttaagttatagctatataaaactayggttagtgttagtttaagggttatagttaagtgttacatgtttaagactaaagagaaatgaatattaattgaaattaacctaatccattggcaattcttttattaaataatgttcctttttatgtctcatgttgcactctgaaaataaataacaaagataacaaacttttcctccaaatactaatactgtaatgacaaatgattacaaaatctttaagtaaaatttaatgaaaattttattgaataatgactcatatatgcttttcaaagacagtgagaatgtagcttataaaatcagtt

SEQ ID NO: 76954 - DNA, 601 bp, Human
aataaattttcctatcccaaaatatcttacagaataaggaattattagcctaaagacgttttagaactgcacaggggtcttcaatggtattacacaaaaaatatctaaaaaggaaaagcagatgagaataaggcctttcaatattttcatggaaaaacatttaaagaaaaaatattaaataaaaaatatttaattctcaaggatgacatggctaaaaagctaaagctcattttgaatttttggaatgttaatcacctatttcaaaagttttgattttagaaattaaaagtcattgttacartttaagttatagctatataaaactatggttagtgttagtttaagggttatagttaagtgttacatgtttaagactaaagagaaatgaatattaattgaaattaacctaatccattggcaattcttttattaaataatgttcctttttatgtctcatgttgcactctgaaaataaataacaaagataacaaacttttcctccaaatactaatactgtaatgacaaatgattacaaaatctttaagtaaaatttaatgaaaattttattgaataatgactcatatatgcttttcaaagacag

SEQ ID NO: 76955 - DNA, 601 bp, Human
tatcagaagacattgtcaaatgggccaatggctgtctttcagtcattcctttctgatctttggatttttttttctctaaagttaaaataaataaattttcctatcccaaaatatcttacagaataaggaattattagcctaaagacgttttagaactgcacaggggtcttcaatggtattacacaaaaaatatctaaaaaggaaaagcagatgagaataaggcctttcaatattttcatggaaaaacatttaaagaaaaaatattaaataaaaaatatttaattctcaaggatgacatggytaaaaagctaaagctcattttgaatttttggaatgttaatcacctatttcaaaagttttgattttagaaattaaaagtcattgttacaatttaagttatagctatataaaactatggttagtgttagtttaagggttatagttaagtgttacatgtttaagactaaagagaaatgaatattaattgaaattaacctaatccattggcaattcttttattaaataatgttcctttttatgtctcatgttgcactctgaaaataaataacaaagataacaaacttttcctccaaatactaat

SEQ ID NO: 76956 - DNA, 601 bp, Human
ctttcaaattctatagcagactgtgatataattacccacaaagcttctaacatccaagagtatccatagaaatatagtgttcataagaaggaaaaaaatagttctcaactctgcatttgttgaacatcactggaattcggagtgagctaatatcagaagacattgtcaaatgggccaatggctgtctttcagtcattcctttctgatctttggatttttttttctctaaagttaaaataaataaattttcctatcccaaaatatcttacagaataaggaattattagcctaaagacgtttyagaactgcacaggggtcttcaatggtattacacaaaaaatatctaaaaaggaaaagcagatgagaataaggcctttcaatattttcatggaaaaacatttaaagaaaaaatattaaataaaaaatatttaattctcaaggatgacatggctaaaaagctaaagctcattttgaatttttggaatgttaatcacctatttcaaaagttttgattttagaaattaaaagtcattgttacaatttaagttatagctatataaaactatggttagtgttagtttaagggttatagttaagtgtt

SEQ ID NO: 76957 - DNA, 601 bp, Human
gagctatgtgtctgaattaatttttaaaatttaatagacatgaaaatcctgcacttaggtttaagaaatcaattgtctaaatactgaatggacaaagacttgacttaatcatagttgacagactttcaaattctatagcagactgtgatataattacccacaaagcttctaacatccaagagtatccatagaaatatagtgttcataagaaggaaaaaaatagttctcaactctgcatttgttgaacatcactggaattcggagtgagctaatatcagaagacattgtcaaatgggccaayggctgtctttcagtcattcctttctgatctttggatttttttttctctaaagttaaaataaataaattttcctatcccaaaatatcttacagaataaggaattattagcctaaagacgttttagaactgcacaggggtcttcaatggtattacacaaaaaatatctaaaaaggaaaagcagatgagaataaggcctttcaatattttcatggaaaaacatttaaagaaaaaatattaaataaaaaatatttaattctcaaggatgacatggctaaaaagctaaagctcattttgaatttt

SEQ ID NO: 76958 - DNA, 601 bp, Human
gacctcccctgaattattgttacctacatagttacagtaacttggaaggtgatgtcatgcattcacacaaaacatagaagtgatatcttgttgtttatttttatcattggagcttgttggatgtttgggctcaagaatatgcaaacagggttaattaatggctcaatagcaacctagaaattatcctattccattcagacattttatcagtgacttggatgatgggggcaggggtaatatcgaaatgacacatgcctaagggagggagcagacatggggtaaaagtagagagtctgtaaartaacagaagctagatattaaattatcttaccaggtcagagctatgtgtctgaattaatttttaaaatttaatagacatgaaaatcctgcacttaggtttaagaaatcaattgtctaaatactgaatggacaaagacttgacttaatcatagttgacagactttcaaattctatagcagactgtgatataattacccacaaagcttctaacatccaagagtatccatagaaatatagtgttcataagaaggaaaaaaatagttctcaactctgcatttgttgaacatcactggaattcgga

SEQ ID NO: 76959 - DNA, 601 bp, Human
ttgtttatttgctttcttatttatttctgttgaagattttttctaaaaatactgaattggaataacagagcccatatcttttaggtataaccttgtaaaacacgtttagcaattcaaggcagtgatacacaatatatcaaatgtaacatcattcagacataaccactaatatcttcaatgaaatatatatttaagttttcctctctgagcaagttttcttagcatttcctaaaacctcaaatttttttatttaattttaatgtattttatctaccatgtggacaaaattatggcaaatgtrctatgttctattatcctatgattagcctagtagaaagtattactgaagaatatggacattatgcatggacacttctttttgtttttaaattgccaactgccaaaccagcatttgccatattccttccaatcacataagattaatcaagagagtttaattaaacaagtccaactcaccaaaattaatgatgttcactgaatgaccagattttcattccaattggaagtactttcatacttttacagacagtgtgactatccactttgcaattgcagtgcgacctgtgaaacttgcataaag

SEQ ID NO: 76960 - DNA, 601 bp, Human
aaggaacctaaaaatgaaaaatactatgcataggtttgaggatcacagccaacagtttattataagtctggaatgaagtctcaacttcttcactaagaactcatattctaacttttgtttatttgctttcttatttatttctgttgaagattttttctaaaaatactgaattggaataacagagcccatatcttttaggtataaccttgtaaaacacgtttagcaattcaaggcagtgatacacaatatatcaaatgtaacatcattcagacataaccactaatatcttcaatgaaatatrtatttaagttttcctctctgagcaagttttcttagcatttcctaaaacctcaaatttttttatttaattttaatgtattttatctaccatgtggacaaaattatggcaaatgtgctatgttctattatcctatgattagcctagtagaaagtattactgaagaatatggacattatgcatggacacttctttttgtttttaaattgccaactgccaaaccagcatttgccatattccttccaatcacataagattaatcaagagagtttaattaaacaagtccaactcaccaaaattaat

SEQ ID NO: 76961 - DNA, 601 bp, Human
aaagaaggaggaaatgaaggagagaaagaagaaagacaggaaaaaacagagagaaagaagaaggaaagaaaaagagatagaagaaagaaagaaaagaaagaaagaaagaaagaaagaaagaaagaaagaaagaaagaaagaaagaaagaaagaaagaaagaaagaaagggagggaaggataaatctctttgctgtgtagtaaacagaggagaaacataggtaaaaacactaaaatctgatttggtggaattttgtacactgcagatatatgtcagattgtgaagaaaaagtggaaaaaaakaagcatgtgtatcggagatactgaacagagaatagagtgggtggagtaagcctgtaagtaccatttcaatggcattagccggtttgtgtctctgctgattctacctggtcttagaatggaaaagcttgatttactggactgttaaggaacctaaaaatgaaaaatactatgcataggtttgaggatcacagccaacagtttattataagtctggaatgaagtctcaacttcttcactaagaactcatattctaacttttgtttatttgctttcttatttatttctgttgaagattttttc

SEQ ID NO: 76962 - DNA, 601 bp, Human
atggataaaatatgtttgagtggattttgttctgttgtttttggtagagggaggagaatgtaaggaaagagtgaaggtagggagaaagaagtggaagaaagaaagaacgaaggaaggagggaaggaaagaaggaggaaatgaaggagagaaagaagaaagacaggaaaaaacagagagaaagaagaaggaaagaaaaagagatagaagaaagaaagaaaagaaagaaagaaagaaagaaagaaagaaagaaagaaagaaagaaagaaagaaagaaagaaagaaagaaagaaagggagggaaggataaatctctttgctgtgtagtaaacagaggagaaacataggtaaaaacactaaaatctgatttggtggaattttgtacactgcagatatatgtcagattgtgaagaaaaagtggaaaaaaagaagcatgtgtatcggagatactgaacagagaatagagtgggtggagtaagcctgtaagtaccatttcaatggcattagccggtttgtgtctctgctgattctacctggtcttagaatggaaaagcttgatttactggactgttaaggaacctaaaaatgaaaaatactatgcata

SEQ ID NO: 76963 - DNA, 601 bp, Human
ggtaagatggataaaatatgtttgagtggattttgttctgttgtttttggtagagggaggagaatgtaaggaaagagtgaaggtagggagaaagaagtggaagaaagaaagaacgaaggaaggagggaaggaaagaaggaggaaatgaaggagagaaagaagaaagacaggaaaaaacagagagaaagaagaaggaaagaaaaagagatagaagaaagaaagaaaagaaagaaagaaagaaagaaagaaagaaagaaagaaagaaagaaagaaagaaagaaagaaagaaagaaagaaagggagggaaggataaatctctttgctgtgtagtaaacagaggagaaacataggtaaaaacactaaaatctgatttggtggaattttgtacactgcagatatatgtcagattgtgaagaaaaagtggaaaaaaagaagcatgtgtatcggagatactgaacagagaatagagtgggtggagtaagcctgtaagtaccatttcaatggcattagccggtttgtgtctctgctgattctacctggtcttagaatggaaaagcttgatttactggactgttaaggaacctaaaaatgaaaaatacta

SEQ ID NO: 76964 - DNA, 601 bp, Human
gtctacgttgagacctaaaggaaaagggagaatagatcagataagatggaggaggacaataaaggctgaaggtaagatggataaaatatgtttgagtggattttgttctgttgtttttggtagagggaggagaatgtaaggaaagagtgaaggtagggagaaagaagtggaagaaagaaagaacgaaggaaggagggaaggaaagaaggaggaaatgaaggagagaaagaagaaagacaggaaaaaacagagagaaagaagaaggaaagaaaaagagatagaagaaagaaagaaaagaaagaaagaaagaaagaaagaaagaaagaaagaaagaaagaaagaaagaaagaaagaaagaaagaaagaaagggagggaaggataaatctctttgctgtgtagtaaacagaggagaaacataggtaaaaacactaaaatctgatttggtggaattttgtacactgcagatatatgtcagattgtgaagaaaaagtggaaaaaaagaagcatgtgtatcggagatactgaacagagaatagagtgggtggagtaagcctgtaagtaccatttcaatggcattagccggtttgtgtctctgctgat

SEQ ID NO: 76965 - DNA, 601 bp, Human
acatatctaggcaaggaaagaaaggtactcaaccataatataaatataatctaaatctaaactttcaggactcaaggtattttaaaaatctgggtgaatttttaaggtagcaaaaaataaagtcgggagtcttttccagaggtactcaaaaccagagatggcactgatgaatatctctacacagctacccctcattccaaatcccatttcataactccagaattaagcaaagtctcctattttatgatctatatcagatgataaaggaaactcagtgccactcttgatggacaacttaatrtccatgaacctgctatcaatgtatatcagtttgtgacctcatactgcttagagttgcaaaatatatttacatgaatctgatcatctcaaaaacctcatcacaggccaactggtatccagatcatatagaagaggaaagtaaagttcagagaagtggcttgtccaaagtcacacatttatacatgataaatccaaaatttgaacagacatttttgtctcccaaacaggtgctaattattaatatcttaatcatggtgtctcatccaacttacaaacaaaggtaaagattttaactcagaga

SEQ ID NO: 76966 - DNA, 601 bp, Human
tttcatagtcttcaatggggactactacctggaaaatcatggtagaagtttcaaattcaagagggtgcctttctcacccttcaaagaagttgcagattttaagagtctcttcctggctatgatcaacctctcaccttactgacagagtttcaatttaaccaaacgctattgaaacaaatgactgctacaccatactgtttctcattctttaccaaggagttaagtttcacttagcagaacattcatcaatgagtaagaaaatatacacaaatacaaataaaaatggaaaagccaacacgtyacaattttttgccttatgtaagctaaattttcttccattggaaacagaactacttgtgcaggtggttgctaaatgctaccagctgctctgtggcaatatagtttctgaacagaaccctaaaaagtaggatggagaggggaaaaataaagaaatgggtgtggaataagactctatattaaactaattccctgggtaatacaggagagggggagagcaagttctgtcgtaaacagtaagcagaatttccattcagctggcctacaataaatttatttttccaagaaaatgaaatggaacaag

SEQ ID NO: 76967 - DNA, 601 bp, Human
aaatgccactattgatatttcacccttttgctgaaaaatgttctttggcttcaccattgtagcagcaacagcaggaggaggaggagccagaggtcatatgaactgagcagctcctcctgcctcacaggcactaagctataagctggggtagaaatataagagccactcccaacttcctgccttccaagaaggcagggagaaagcaatctggaggtagaagcaactgatacgttaaggactgtagaagatacatacatacacacacacacacacacacacacacacacacacacacacacayacacacacatatatatatatatacacatacatatttttttcttttttcttttttctctttttttttagtgagacggagtctccctctgttgcccaggctggagtgcagtggtgcgatctcggctcactgcaagctccacctcccgggttcacgccattctcctgcctcagcctcccgaatagctgggactacaggcacccgccaccacacccggctaattttttgtatttttagtagagacgcgatttcaccacattagccaggatggtctcaatctcctgatctcgtgaaccacctgcc

SEQ ID NO: 76968 - DNA, 601 bp, Human
ccagagatgtgtcatagaaatagggttagtgacagtgtgacccagaggtcctggataggaaacttaaactgtagttatacctgcatctatcatgtaaggagacacatgagaagaaacaactgtatattgaggaaaagcaggattatggagtcaggcgaacttggattcaaaccaactccctgcttctgtgaccctggaacattaattaagctatttaagcctcagctttctcatctgtgcaatggggctaataatgtcttttttgcaggttattatgagaattaaatgataaaacacatayagaattcttgctcagaagaggaccttagaaaactatttttctatatctggagatgaaaaatacaaatcaaagctaaataacaagatgaaggataggaagaggaattatcttgctaggtgctacagctacttgaactgagtctaaatattcacagagctgagatgtttacgattaattacctctgaaagtaactagttgaaaggcgtttggcagggtgtaatataaaatagagctgccaaggctaacagctattattaaatgtctgcatattttaacaactgtgcttggcacttttattct

SEQ ID NO: 76969 - DNA, 601 bp, Human
gtaccagagatgtgtcatagaaatagggttagtgacagtgtgacccagaggtcctggataggaaacttaaactgtagttatacctgcatctatcatgtaaggagacacatgagaagaaacaactgtatattgaggaaaagcaggattatggagtcaggcgaacttggattcaaaccaactccctgcttctgtgaccctggaacattaattaagctatttaagcctcagctttctcatctgtgcaatggggctaataatgtcttttttgcaggttattatgagaattaaatgataaaacacwtacagaattcttgctcagaagaggaccttagaaaactatttttctatatctggagatgaaaaatacaaatcaaagctaaataacaagatgaaggataggaagaggaattatcttgctaggtgctacagctacttgaactgagtctaaatattcacagagctgagatgtttacgattaattacctctgaaagtaactagttgaaaggcgtttggcagggtgtaatataaaatagagctgccaaggctaacagctattattaaatgtctgcatattttaacaactgtgcttggcacttttat

SEQ ID NO: 76970 - DNA, 601 bp, Human
aacaattaaacaagaatgtaacaatagggccatctcaatatcatgccactaaaagtttttaaaaggacagaattactccacagtaaactgacaaatatctacacttggcacctcttacaagctaataaagatgtagactggcaactgtgataaacaaagcccttcatgaataccttgcttcttttttcctcaaaaagtttttcaaattcagctcgttaaaaggacatattatatttccttcagtccagcagccggtctctctttttaagctgtcaactaagcagtcataagctcacattgatagtatgttatctgctgagtcccctcccccaggactccccatcagtcctagacctgtagctcagcataaaccaagcagtgtgacttgttctctattaaaatgactcattggtaatgtagtcaaccttaatctacaatgcagatgaagaaaaaagacaattttcagccaatttgttgatttactttcggaattcctttttaattttactagtttttccgttgtctggcatttacaatatagtcacaaactaaaaaggcaattattttcctctctttcctatctataataccttaaagttca

SEQ ID NO: 76971 - DNA, 601 bp, Human
atatatagctatgtgtcacccatgcctttctttgtaatttatgtttaaacaaattttaaagaccacaagtaggcctttgctctatgaaataagccatgagatattaatgcaaaagctattgtgctgagagctaagaaaccctacacttccactctcaatgctagtgtgttaaaagagattttagtaatggcaaagccagtcaacagggaataattaaactcaagttgtctaagatttgctgtgatgtgtggaatgatagtttccaacccagctgctgcggaatgtttgcctaagaagaaaatgcagttgactaggggctacagttcagatgaaatgcaatgaaaaagctcgttgacctctaaaacaataggtggggcctactcgaataataaaatcaacacaaagtcaacaattaaacaagaatgtaacaatagggccatctcaatatcatgccactaaaagtttttaaaaggacagaattactccacagtaaactgacaaatatctacacttggcacctcttacaagctaataaagatgtagactggcaactgtgataaacaaagcccttcatgaataccttgcttcttttttcctcaaa

SEQ ID NO: 76972 - DNA, 601 bp, Human
ttttttaagaaatattcactctttacaaagtatctaaggctactcatgtgctttcttttctctatatatagctatgtgtcacccatgcctttctttgtaatttatgtttaaacaaattttaaagaccacaagtaggcctttgctctatgaaataagccatgagatattaatgcaaaagctattgtgctgagagctaagaaaccctacacttccactctcaatgctagtgtgttaaaagagattttagtaatggcaaagccagtcaacagggaataattaaactcaagttgtctaagatttkctgtgatgtgtggaatgatagtttccaacccagctgctgcggaatgtttgcctaagaagaaagtgcagttgactaggggctacagttcagatgaaatgcaatgaaaaagctcgttgacctctaaaacaataggtggggcctactcgaataataaaatcaacacaaagtcaacaattaaacaagaatgtaacaatagggccatctcaatatcatgccactaaaagtttttaaaaggacagaattactccacagtaaactgacaaatatctacacttggcacctcttacaagctaataaaga

SEQ ID NO: 76973 - DNA, 601 bp, Human
cctaggatatgttacgctagatatccaacatccaatgttttattgtttttctcataactctaaagactacaaaccttcttgaaaacaattacataactgtctcttttgtgaggtggctaatctttagtaacactgaacacttttggctgtacgaagttttcacagaacattcagattaagcactattaatcatgaaattacagtttgttaagtaaaatgaaaagttcaatttttaatatactacgcccacaatatttatttaacagagtaataaaacataaatgctttctgaaaactaggraaaacaaaagtgtggttaaaaatccctttaacattcacttgaaaggcaaaaaaattattttttaagaaatattcactctttacaaagtatctaaggctactcatgtgctttcttttctctatatatagctatgtgtcacccatgcctttctttgtaatttatgtttaaacaaattttaaagaccacaagtaggcctttgctctatgaaataagccatgagatattaatgcaaaagctattgtgctgagagctaagaaaccctacacttccactctcaatgctagtgtgttaaaagagatt

SEQ ID NO: 76974 - DNA, 601 bp, Human
agaatatgaacagacaactcaaaataagacatttatggggccaacaaacatatgaaaaaaagctcaacatcactgatcattagagaaatgcaaatcaaaatcacaatgagataccatctcatgccagtcagaatggcgattatttaaaagtcaagaaacaatagatgctggtgaggctgtggagaaatagaaacgcttttacactgttggtggaaatgtaagtaagtttaaccagtgtggaagacagtatggcaattcctcaaggatctagaaccagaaatatcatttgacccagcaattmccttactgggtatatacccaaaggaatataaatcattctactataaagacatatgcacacgtatgtttattgcagcactatttacaatagcaaagtcatggaatcaacccaaatgcccatcaatgatagactggataaagaaaatgtggtacatatacaccatggaatactatgcagccttaaaaagaaatgagatcatgtcctttgcagggacatggatgaagctggaaaccatcattctcagcaaactaacacacaggaacagaaaatcaaacaccacatgttctcactcataagtgg

SEQ ID NO: 76975 - DNA, 601 bp, Human
aaaaatagcatccacctgaaagtatgttaggagaaagcaacttgttagcataagacgaggtcatttctttcttctcttctgaacctgacacacagcattttaaaattaaacagaagaatattctgcttcctagggatttatgccaccatctaccacattactcaaatgaccactgctactcattacataagagatcaagcacaactttattcatgaaaagcagacatgaagacaacttcttaaaactcaggcttttaaaatcagactctgtctcatctggtacctattgattgccttttttgtcaatcggggtgggtatttacccatctggtatagagaatagatactagagtctgaaattggacagaactgtgttccaatcccacctctgttgctttctgtttctagctctacaattttcaagttacccaactcacaagtctttttcctcatatataacatgagaataacaaaagcccgcacttacaacatatcaggcatgttttcatggctttgcatctattattgcatttaagtcacccaatagtcttaagaaataaatactacaagttgagcattcctaatccaaaaatataaagtc

SEQ ID NO: 76976 - DNA, 601 bp, Human
aaaatcttcccatgattcgatctgaaagaaaaatgtaattcatgtgtaagaactggatggtagatgtttgtatcaagtaatataatcatgctatctccaataaacatggatttaactttttcttgtttttttacagtttattatttattttattcaggatattatctcccaatgttatacaaaatactgacaaatgtcaatgtcttttcttactttccactgtatcacaggttttcacttcatttacttccgcaggtacccttgtatgtgtgtgtgtgtgtgtgtgtgtgtgtgtgtgtggatacatatataaaattaaaggcctatccatataaaaattatcccccaataaacttaatctcagaagaaacaaatcacagctgtaattttacccatacataggaaaaatggaacacaagagattagataaaatagtaattgatattttgactattgcaactttatgaaactgaagattttgaatgataatgactaagaggaaagaataaacctgaggaatggatgtgaagattttgtgtccttaggctaaaggacaattagtcatgtttggatttctaacatggtatcatgaaccctcagt

SEQ ID NO: 76977 - DNA, 601 bp, Human
aaaaatcttcccatgattcgatctgaaagaaaaatgtaattcatgtgtaagaactggatggtagatgtttgtatcaagtaatataatcatgctatctccaataaacatggatttaactttttcttgtttttttacagtttattatttattttattcaggatattatctcccaatgttatacaaaatactgacaaatgtcaatgtcttttcttactttccactgtatcacaggttttcacttcatttacttccgcaggtacccttgtatgtgtgtgtgtgtgtgtgtgtgtgtgtgtgtgtrtatacatatataaaattaaaggcctatccatataaaaattatcccccaataaacttaatctcagaagaaacaaatcacagctgtaattttacccatacataggaaaaatggaacacaagagattagataaaatagtaattgatattttgactattgcaactttatgaaactgaagattttgaatgataatgactaagaggaaagaataaacctgaggaatggatgtgaagattttgtgtccttaggctaaaggacaattagtcatgtttggatttctaacatggtatcatgaaccctcag

SEQ ID NO: 76978 - DNA, 601 bp, Human
gttctatccaaagtagaccataagacagagaaactcctgtgaaatctgtatgaaacaggcaatactgatgtagaaagaactgaggaataaaaagaatagaaattctccctttgttctggatactataaatttttactaagagtgatatatgaaaaaataccaaaaaaaaaaaatcttcccatgattcgatctgaaagaaaaatgtaattcatgtgtaagaactggatggtagatgtttgtatcaagtaatataatcatgctatctccaataaacatggatttaactttttcttgtttttttacagtttattatttattttattcaggatattatctcccaatgttatacaaaatactgacaaatgtcaatgtcttttcttactttccactgtatcacaggttttcacttcatttacttccgcaggtacccttgtatgtgtgtgtgtgtgtgtgtgtgtgtgtgtgtgtgtatacatatataaaattaaaggcctatccatataaaaattatcccccaataaacttaatctcagaagaaacaaatcacagctgtaattttacccatacataggaaaaatggaacacaagagattagataaaa

SEQ ID NO: 76979 - DNA, 601 bp, Human
taccatagctattgtaatcctttaaaaagagtagtaaaaaatgaccttaaaatggtatttagaaatttatccaaaaaatgaaaataattataaatgaaataaataattattggaataaatcatttgataatcatttgtcaagcacttattttatattacttccaaaggaaggcaatgatgaaaatatataataacaaggataagaagctattcctcaactattgtaaaatgggaaagaccacaaagagaaacaggaaaactggcctagaagagcaaactattaaaatacagatgaaggggyagggcaggggaaaacttttggccttacttttctcaagggaagacagagaactgactctaacaaaatagaaagctcccaagagaggaaacatagatactaaaggaatgccaggtcattccagaatgagcaataggaaattaaaccaacattcaatgggttctatccaaagtagaccataagacagagaaactcctgtgaaatctgtatgaaacaggcaatactgatgtagaaagaactgaggaataaaaagaatagaaattctccctttgttctggatactataaatttttactaagagtg

SEQ ID NO: 76980 - DNA, 601 bp, Human
taataggaagatttcaaaggtactcctggaatttcttttttatgtcactgtatgcttataaattattagcattattttaagaatatttctcttctctaagtatacacatgcataatttaatgttatacatactaattttctatcagaaaataccttttgtggcaaagaaacaataatgaaggtttagaagaaaaatatgttgtaagatgctattgtccttttctattagttaggaacatttactgaatatatgagaatgaattgaattgctttggttctcatgaataaacctattaataaraaccagtaactcaaggtaggctgccagattttcatccactctggactctctattaacctttattcttgttaaagacaggacccttggcgttatgtctctcttcatgtcttatccagtgatttgtacatagtaggtatccaatacatatttgagaaaataaattagaaatattgttttatgacagagttataaagctctttaacatttataccatagctattgtaatcctttaaaaagagtagtaaaaaatgaccttaaaatggtatttagaaatttatccaaaaaatgaaaataattata

SEQ ID NO: 76981 - DNA, 601 bp, Human
atagacaatttgattctcaattttgaattctaaattctaaatccactgggcagtgtttcatttatacattacagaacagccttccatatagatatgataaaaccccaaaatggatattctgctttcaatgttgctaaattaataggaagatttcaaaggtactcctggaatttcttttttatgtcactgtatgcttataaattattagcattattttaagaatatttctcttctctaagtatacacatgcataatttaatgttatacatactaattttctatcagaaaataccttttgtgrcaaagaaacaataatgaaggtttagaagaaaaatatgttgtaagatgctattgtccttttctattagttaggaacatttactgaatatatgagaatgaattgaattgctttggttctcatgaataaacctattaataagaaccagtaactcaaggtaggctgccagattttcatccactctggactctctattaacctttattcttgttaaagacaggacccttggcgttatgtctctcttcatgtcttatccagtgatttgtacatagtaggtatccaatacatatttgagaaaataaa

SEQ ID NO: 76982 - DNA, 601 bp, Human
aaaatattgacattttttctcacttattcagtacccatggaaaagaaacctaagtgtcatccaaaactcagtacctcttgtacttaaaaaaaaccttcagaatataattccaaaatgtgaaataatgtgcaccagatagtgagagcaagaagtaacctttagtttccctgaactacttcaacttcctggttaaccatcttatcagaagtttattttaataaacagagagggtcagcaagatactctgttctattcaattctatatgagagcagttctacagttctacttttttttttttttcccatgggaaagaagcaaataccagccagccaaaatacaaaggcctagatgatatcttactactggcctaattaagtaatattttaggaaaattatatttaggcatttatgtagttcctactggaaatgaaatccccagactatcacaaaagctatttcatatacatgcctacaaactctcttttgatcaaaccactctatttttacctctgtggatttagatgtttattttaatcattaaaactgtctgttctaaatcagaccttaaaagtcaaagctagtccaggcgtggtggctcac

SEQ ID NO: 76983 - DNA, 601 bp, Human
tttttttaaaaaagaaaaactgtcttggagagatcattagttcactttgttagattcttggtccttgaaccttatagtcagagggggctataaataaatagtatgttagttttcattgagggaactcttctggttggaaccagacaattggcaaatctcaaaaaaaagttggaatactaggggaaaaatgcaaatttgtatacaaaagtacattatttaacataaagaaaaactcaaagaaaataaaatcaaaacatttataatttagaataggttattatagataaaattatctataaartgatagagaaaatttagataaaaatagaatagattgttatagataaaatatcttcatataatatagataaaatttagacatattattaatagaaaaatatgcaggcaaaaataaaattatatttgctcaggttttggtttccactttttaaaaagttataggtaatgtttcctcttcatctagcactagttcactccataaacacatactaaattaaatttaacagtgtgcattacctgaggaaaatggctttcaaaaagaatttgttttctacgttatcatttagtgtagggaaaataa

SEQ ID NO: 76984 - DNA, 601 bp, Human
ttctaactcctcctccataaaaagtcaatgtcttcttggataattgaaagtatactttacagatatgtgatctatacttctatgaatagacatgtaaccctaatatagaaaaattgattgtgtatgtttgacatatacacatacacagacactcacacacacacacaaacacacacacacagcttcaaaattgcttttaataaaacatactagaatctacacaaatctacatctatactctgaatgacttttgagtacttgtcctttcgggttgcctatttcaattaacagtgttagtatycacccagtgactgactctgattcggtaaaagaatatatctttaaaacattcttctacatccatgagcaatgagagggaatagcagcttgtcacatgtaaacatggcctgggtttaaaaagacgtgaaaacaattgcaattctattgttaaaaaatttgatcattttttagaagaaattttaaaactagttttagacttttcataatcagttttatttagaaatgctttagattgtggagataatgccaatagttttttaccttacagtataatctgttttttgttgtgttttttgtttgt

SEQ ID NO: 76985 - DNA, 601 bp, Human
gtacgagttaaattgcatcttacatttaacaataggtatactgttttatatccaaaagagtaaactaagagttcaaacatttgcatgcactaaatatgcaaactacaaaaataaactgtgttcataaatgtacataattgtgtaaactgcttggcaaaaaaataacaaaaatgttattgtctatttttataattattgattgattgagacaggattgggattacagccgtaagccactgcacttggccctttttttattacgtttcttcaaattaaactacttggttctttataaattatkgtattatgttatcttcatttggctgagagagatgagtttaaagaattgtagctgtgagatcagtaaatttgccagagacaggctggagtccagtggtacaatcatggcatactgatgccttaactttccaggctcaagcaatcctctcacctcagcctcccaagtagccgaaaccacaggtgcatgctaccgtgtctggctaatttttaaaaaaatttttgtagagacggggtctcaccatgttgcctaggttgttatttattgtttgtttcatagtggctttcacttttttctgcatct

SEQ ID NO: 76986 - DNA, 601 bp, Human
tgctcctccttgccttccaccctgttgtgaggcctccctagctatgtggaatggtatgtctaataaacctctttcttttgtaaattgcccagtcttgggtatatctttatcagcggcatgaaaaccgactaatacaacagtcttttaggaaaagatacacgcgaaaaggaattcagtacttaatacagggagagaggcacttcttggaagtaaaattttgatctactaaggttctcaaaagtgaccctacaaaaaaatcatctatcttcatcttacatttttcacttagatttccctaaaracacaaaggtaaaaataaaagaaggcaaaataattttttttgtccccagctatgaatctatgtcataaaatgtatgctaataaaaacaattatatttgattttaacattatgtcattaaaccataattatgtctcatagctcagggaaggtcatttggggttgttagtggtggtttcctcctaaatctagcatatctgtccttgctatttgtttccttatctgattatttacactattttaaacttccttgtacttttatcatcaaaaagcacttgtggtctgcatcctgggtggatgac

SEQ ID NO: 76987 - DNA, 601 bp, Human
tgtacaatatattattgtacaatatattattgtacattttaaaataactaaaataatatattgtacattttgaaataactaaaagagtataactgagttgtttgtaaaacaaaaaaaggctgaatgcttgaagttattgataccctcatttaacctgatgatattattatgcattatatgcctggatcaaaatatctcatgtaccccataaatacatacacctgctatgtacccacaaaaattaaaaattaaaaatgttttaaaaatatacatttcttcagaatgtggtaaaaagaagacraaacattcacagaaaaggaaggacaatatacaagataaaacattagtgtgaatccagaggacctcagtagacgctgttcaattttgggtgcaaaaattggttctgctggctgggagtttatgttgcaaagcaggacaatgagttcaacacgtaaaccaacttagttcaatttgctccacaagtatttatgaggaatcttctatatcctggcacatcatttgacatttagtgtacattgatgattaagtcatggtcaccacctttaagtagctttaaaatccaatgaaaaaaatctattgt

SEQ ID NO: 76988 - DNA, 601 bp, Human
agtgatgattctttttcagggatttagaaaggaattcctaccactgctgcctctccagatagcacaatattgccatacttgccttaccccatgtttccatttctttaccatctctctcctttctctgggcacaaatcctggacagtatcttggactcctctccttcccttgtccccaataaatagtcattggttcagttggtctgttaaactgtttctacagggtgctcattttcccactggcactggtctagtgaaggctattgtccttttaggcctgagtttttgtggcatttttacascaaacattagtcttcctaaaataacaaagttataacaatgctttgctttacctaaaaacaaaaggtaaagagcaaaaaacagaagaaaaaccgcactaacaaaaactccaatggatcccaatttgctagaaaataaagcccctaatccaaaatgcaatctcctcttttacaatttgatgtcaaatttatcgtctttctaggcccatttcctgcttgtttcctctacacaaatctttagcactggttaacaactggaaatatgaatagaagctcttggcccttcaactgtgctgaggtagg

SEQ ID NO: 76989 - DNA, 601 bp, Human
ttctacccactgtgttctctgccagtcagtaagagagagtattctgcagcaaaggtggaataccattgagttccagagccctaaaaacgagggtaggaacacacacacacacatcttggactagttttaggtcaatatttgttaccaaggccaggaaatttattctctacaatgtctcctggtagacagactttaagtaccaagagggcaggaattgggtctatcttttttgcccctgttgcccagagtctaccataatgcatgacatcaagtatttagtagatgtttgttgaaaaaaaaatggatcaggtccttccttgacttccattctcacctagtttgaatgcctaatttggatgcctgttacctctagtctgaattattgcaatgatctcctgccagatcctctgaccaccattcactctcccaccagtttaaagtccttgatgttaatcctctcaaccatctgctgttacttattcccttgctcacagtttttcagtgagttccgattgcctaacaattcagtataaattcattccattttttttgagaattcaatgaggcaatgtaggtaaatcacttagaatcatgaagagga

SEQ ID NO: 76990 - DNA, 601 bp, Human
ctaagatgaagtactttgctgaaacaaccgctctggtgaataaattattatactcaaagttttattttttaaactccagttaaggttgccatatttaaaatattttttgctggactattttgatgtgtttcagtcctaagctatgatgctgagtggttaatgcacagcaacaaatttataccaagtttaaatgaaaatattatgataaaataaaaatgttaataaaatactgtaaaactttggtagcaaaatagagacaatagagaaatatttcccaaaagtagggatgtttaactctttcatgtgtatttattacaagatatattcaagaaataaatgatgaaaaaataaatacaaaaactgagacagtcacaaaaaatgcataacatatcaatctggttgttcagacaactggttgttttatatcactaggaaaaatttactattatctttttattttataaaagataactttgcttacgattatcattagtctcaaaaggtgaaatccctcattctttttaacttcggactaaattagtgaggtagtaagtgcttttggaaaaaacctcaactctataaggaattcatttttcattat

SEQ ID NO: 76991 - DNA, 601 bp, Human
aaccctcctcaggccccttccttccttccccagctgtgtggattgcagaatctttaaaaagcccaaagatttccaataaggccactggctctgccttcattgtgtaactgtttatttaaaataagtcaatatattagttaaagcagtaagaagttagtgctccagtattcaagtgattcccacaagactgtaaactgatgcctcttttaagccttaaacttcatggtcgtcccagaagtaaaagttctgctaatggagaccctatgggcatggtacattccagcacatcattaaaggaaasaaaagcagtccagccaaagccagatgaaatgactgcactgtccacttttaataggcttcctgtggacaaacagcactgtaacactctgcagaggacaatatttaaaaacaagacaacttgctggcagttttcaataccgtaaagttaataaagtatgttcccattcaccctgacattatgtttttagtttatagaggaaggcactttataacctcagtctaaattcccttaattctgcagctttgggtttcttgaggtggctaaatatacactaaactccaagcctaacatctttgtttt

SEQ ID NO: 76992 - DNA, 601 bp, Human
agaggaattttcatctgttaccaaaactttattatttatttatttttcagagacaaggtctcacactctgtcacccaggctggagtgcagtggtggtggtcacggctcactgcagcctcgaactcctgggctcaagcaatcctcccacctcagcctcctgagtagctgggactgcaggtgtgagccattgtgcctaggccgggggtgcactttttttttttaattttatttttgagacagggtctcactctgttgcccactctgaagtgcaatggtgcaatcacagctcactacagcctcraactcctgggctcaagcgatccttttgccttggcctcccaaatagctaggattacaggtgcacgccaccatgcctggctaacttttttaagtttttgtagattttgcaggatctggattatacaaaacatagaaaaaattattattattattttttttgtagagattgggtctccctatgttgcccaggctggtctcaaactcttgggttcaaataatccgcctgactcagcctcccaaagtgctgggattacaggcatgagccactgcacctggcctgcaaagccttatttctttttct

SEQ ID NO: 76993 - DNA, 601 bp, Human
gatcttggctcattgcaacttttgcctcccaggttcaagtgattctcctgcctcagcctcccaagtagctgggattacaggcgcacaccaccatgcccggccaatttttgtaaagccttatttttaagagaagtgagtactcagttatttgtagcattattctttagctcttgttttttttttttttttttttcaagaccgagccttgttctgttaccaggctggagtgcagtggcataatcttggctcactgcaacctctgccttctgggttcaagcgattctcctccctcagcctcccragtagctgggactacaggcatgcaccaccacacctggctaattttttgtatttttagtagagacaggggttccccatgttggccaggatagtctcaatttcttgaccttgtgatctgcctgcctcagcctcccaaagtgctgggattataggcgtgagccaccgcacccagcccagacttgctacttttataggctagaaacggttgaatgtcagcaatgtcatgcttcaactgattatgtcttagtgcataagaaagtttagaagagggaaaaacgactcgcacacctccttgtcgagc

SEQ ID NO: 76994 - DNA, 601 bp, Human
tcccaagtagctgggactacaggcatgcaccaccacacctggctaattttttgtatttttagtagagacaggggttccccatgttggccaggatagtctcaatttcttgaccttgtgatctgcctgcctcagcctcccaaagtgctgggattataggcgtgagccaccgcacccagcccagacttgctacttttataggctagaaacggttgaatgtcagcaatgtcatgcttcaactgattatgtcttagtgcataagaaagtttagaagagggaaaaacgactcgcacacctccttgtygagctaaagccttggggtcaggcatgagccacagagtgccaggcacacagtgaggtgtagaagggcagggaatgtgtattccatccttagtttaggcagatggcaaccaggatggaattcttggcatcccacccagcctcagggcctcacaccagcccatgtggatgacctgagggtcctgtttcccatcccaccccaggcgcccccaggaagcagcggcgggagcgcaccaccttcacccggagccaactggaggagctggaggcactgtttgccaagacccagtacccagacgtctat

SEQ ID NO: 76995 - DNA, 601 bp, Human
aggagctggaggcactgtttgccaagacccagtacccagacgtctatgcccgtgaggaggtggctctgaagatcaatctgcctgagtccagggttcaggtggggtggtgggtccctggacccctcccgacacttcctgtgatctcaggaggcctgcccggaacaaagagtgatgggaggagggagagatcacagagtgacagccaaagttataaaggggacaataatccctctccccaccatcccactgaccgcctcatggctctcattgcccctcgctcctctccagctgcgctggcccwgacctgcctgccaagcaccctcctgccttgggcctttgcactcagtttcctctatctggaatgcttatttccagataaccacacagcaggccccatcgccttgttcgagtctttgcttatccatcagtgagacccacactgaacacagcatttaaaattgcatatgatttacatatggtatctcagagtctgtttatttagactctgtctctcccaactagaatgtcaattccactgatggaccctcagagtagtagaaaatggttaatacatgtttattaactgactgaatagacggat

SEQ ID NO: 76996 - DNA, 601 bp, Human
catcccactgaccgcctcatggctctcattgcccctcgctcctctccagctgcgctggcccagacctgcctgccaagcaccctcctgccttgggcctttgcactcagtttcctctatctggaatgcttatttccagataaccacacagcaggccccatcgccttgttcgagtctttgcttatccatcagtgagacccacactgaacacagcatttaaaattgcatatgatttacatatggtatctcagagtctgtttatttagactctgtctctcccaactagaatgtcaattccactgayggaccctcagagtagtagaaaatggttaatacatgtttattaactgactgaatagacggatggatggatggatgggtgggtggatgcatagatgaatgtatgtatgtgtgactgtaggtgtgcgtgtgcatgtatgactggaagcatggatgagtgtatgtatgtgtatatatgagtgtctgtgtgtatgatgggatggatacatgtatatatgtgtgtttgcatgaacgcacataggtatgattagatagatgatgaatgtatgcatgcatgatatatgtatacgtggtgtatgtgcac

SEQ ID NO: 76997 - DNA, 601 bp, Human
cactgaccgcctcatggctctcattgcccctcgctcctctccagctgcgctggcccagacctgcctgccaagcaccctcctgccttgggcctttgcactcagtttcctctatctggaatgcttatttccagataaccacacagcaggccccatcgccttgttcgagtctttgcttatccatcagtgagacccacactgaacacagcatttaaaattgcatatgatttacatatggtatctcagagtctgtttatttagactctgtctctcccaactagaatgtcaattccactgatggacmctcagagtagtagaaaatggttaatacatgtttattaactgactgaatagacggatggatggatggatgggtgggtggatgcatagatgaatgtatgtatgtgtgactgtaggtgtgcgtgtgcatgtatgactggaagcatggatgagtgtatgtatgtgtatatatgagtgtctgtgtgtatgatgggatggatacatgtatatatgtgtgtttgcatgaacgcacataggtatgattagatagatgatgaatgtatgcatgcatgatatatgtatacgtggtgtatgtgcacatgta

SEQ ID NO: 76998 - DNA, 601 bp, Human
tttattaactgactgaatagacggatggatggatggatgggtgggtggatgcatagatgaatgtatgtatgtgtgactgtaggtgtgcgtgtgcatgtatgactggaagcatggatgagtgtatgtatgtgtatatatgagtgtctgtgtgtatgatgggatggatacatgtatatatgtgtgtttgcatgaacgcacataggtatgattagatagatgatgaatgtatgcatgcatgatatatgtatacgtggtgtatgtgcacatgtatgtatacatgcttgcatgattggatggatgsgtgtatttatttatttgaaatggagtctcgctctgtcgcccaggctggagtgcagtggcatgatcttggctcactgcaacctccgcctcctgggttcaagtgattctcctgcctcagcctcctgtgtagctgggattacaggcgtgtgccaccacaccgggctaatttttgtatttttagtagagatggggtttcaccatgttggccaggctggtctcaaactcctgacctcaggcaatcctactgcctcggccttccagagcgctgggattacaggcgtgagccaccgcgcccggccgg

SEQ ID NO: 76999 - DNA, 601 bp, Human
attaactgactgaatagacggatggatggatggatgggtgggtggatgcatagatgaatgtatgtatgtgtgactgtaggtgtgcgtgtgcatgtatgactggaagcatggatgagtgtatgtatgtgtatatatgagtgtctgtgtgtatgatgggatggatacatgtatatatgtgtgtttgcatgaacgcacataggtatgattagatagatgatgaatgtatgcatgcatgatatatgtatacgtggtgtatgtgcacatgtatgtatacatgcttgcatgattggatggatgcgtrtatttatttatttgaaatggagtctcgctctgtcgcccaggctggagtgcagtggcatgatcttggctcactgcaacctccgcctcctgggttcaagtgattctcctgcctcagcctcctgtgtagctgggattacaggcgtgtgccaccacaccgggctaatttttgtatttttagtagagatggggtttcaccatgttggccaggctggtctcaaactcctgacctcaggcaatcctactgcctcggccttccagagcgctgggattacaggcgtgagccaccgcgcccggccggatg

SEQ ID NO: 77000 - DNA, 601 bp, Human
ataatccttatcagtaggaacaggttctgtatgtgaaattgatttagcataccaacagcctgtgacctgactcctgcattatagtgtgttgggccactaccacgttttgtccacagcttgtatttaacatggagctaagacacgtctcaaaagctacagcttccttttggtgacaattgaggggctctgaaaagagccttttggggttggacagacttcttgggctgataggaatatttatgccctctcccctcggatgcggcgcgcaagctggatgtctttaggcataatagtgacgcgyttggcgtgaatggcgcacaggttggtatcctcaaatagccccaccaggtaggcctcgcaagcctcctgcagcgccatcaccgccgagctctggaagcgcagatcggtcttaaagtcctgtgcgatctcccgtaccaagcgctgaaaaggtagcttccggattagcagctcggtcgacttctggtagcggcggatctcgcgcagggccacggtgccggggcggtagcggtggggcttcttgacgccaccggtggccggagcgctcttgcgagccgccttggtggccagctgcttgcgcggc

SEQ ID NO: 77001 - DNA, 601 bp, Human
aatattttctttctcttttctccagggtagtcttttagatcatttttttttttaagtaaggaggagattgcatatctttgaatgcttgctgcctgagccagattgctgagttttctttcctttgccatctgcttctctttaaaagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatcygcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttc

SEQ ID NO: 77002 - DNA, 601 bp, Human
aaggggcagcccacgggagctcctttgcacacaagccctgctgctcctaaaggctctggacacacaggagacctcccagcctgcttgcggggggggcgggggggacactcgctcctaacaggtcttgtttcaggtcagagataactggattagaaacctgacttgggtccctaattgcagaaagagtgaaggaggacaaagaagaaatggggaaggaaggcacctgagctagcactttcctgtctgaggctagggcgggtatgacgggcaggccaggtgcccacacttggccggctgagasgggtacgaggcaggctgctcagggcagagaagaggaatgcaagatggaatcaggtgtacacctgtgagacggacccccaggtgggcccctccaaggtcaagggaggagatgaggacttgagtgaggctgagccagcttctggagagaggggctaccagacagagagcgagagaggcgctcagacatcagacggacagacagaggctgacggcaggaggctcagagggcccaacgtcagcccgccgggcaggctccccaggcagacagacaggacggggcccaccgcccaaggcccgactc

SEQ ID NO: 77003 - DNA, 601 bp, Human
accaagatccccaaatgattcctgtgcccagtgacgttcgagatgcactccatagcgcattcagaaccattctacaaaccacttttgagctttccactaattgggcagaggctgcacacaccatcattgcaaatcgataggggttttgaagccctgggtgtttcctgtttctggcacagcatggcaactgtcccagcaaggggcagcccacgggagctcctttgcacacaagccctgctgctcctaaaggctctggacacacaggagacctcccagcctgcttgcggggggggcgggggggacactcgctcctaacaggtcttgtttcaggtcagagataactggattagaaacctgacttgggtccctaattgcagaaagagtgaaggaggacaaagaagaaatggggaaggaaggcacctgagctagcactttcctgtctgaggctagggcgggtatgacgggcaggccaggtgcccacacttggccggctgagaggggtacgaggcaggctgctcagggcagagaagaggaatgcaagatggaatcaggtgtacacctgtgagacggacccccaggtgggcccctccaaggtcaaggg

SEQ ID NO: 77004 - DNA, 601 bp, Human
cacatcttaccaagatccccaaatgattcctgtgcccagtgacgttcgagatgcactccatagcgcattcagaaccattctacaaaccacttttgagctttccactaattgggcagaggctgcacacaccatcattgcaaatcgataggggttttgaagccctgggtgtttcctgtttctggcacagcatggcaactgtcccagcaaggggcagcccacgggagctcctttgcacacaagccctgctgctcctaaaggctctggacacacaggagacctcccagcctgcttgcggggggggcgggggggacactcgctcctaacaggtcttgtttcaggtcagagataactggattagaaacctgacttgggtccctaattgcagaaagagtgaaggaggacaaagaagaaatggggaaggaaggcacctgagctagcactttcctgtctgaggctagggcgggtatgacgggcaggccaggtgcccacacttggccggctgagaggggtacgaggcaggctgctcagggcagagaagaggaatgcaagatggaatcaggtgtacacctgtgagacggacccccaggtgggcccctccaag

SEQ ID NO: 77005 - DNA, 601 bp, Human
aggccccaccatcaaaatctcactatccaaggtcccactgtctaaggttacttagacagtgggacacctcaaaacacatcttacatttctcagtctctctaggggtgtgaaaggtactgacacattttttaaacaatatcagacatgacaagcccttttttttctttttttgagacagagtcttactcggtcgccaggctggagtagagtggcacgatctgggctcactgcaacctccgcctcccgggttcaagcaattctcctgcctcagcctcccaagtagctgggattacaggcgccygccaccatgcctggctaatttttgtgtttttagtagagacagggtttcaccatgttggccaggctggtctcaaacacctggactttgagtgatctacccgtctcagcctcccaaagtgctgggattacaggtgtgagccaccacacccagtcgacaagccctctttttaaaatatatccctggtcctcaaaggcagttaaagctgtgagccacctatactagctgtaaattaaagcttaagatttcacctgggtatgtttctaaaataagaatccttaggaatgtattattaagaggggc

SEQ ID NO: 77006 - DNA, 601 bp, Human
cttcaagttgcagactgttctgatctgcacagtttctctcccaagagtggatggagggagccagaagcccagagggaagtctcccagggcacatttgcccaaagcaatgactccttggtatctaagcctgaattcacatcaaaaatgtcgcctggccaacatggctaaaccctgtctctactaaaaatacaaaaattaggccgggcgcagtggctcacacttctaatcccagcactttgggaggccgaggcaggtggatcacttgaggccagttcgaccctggtcaacttggcaaaatccyatctctactaaaaatacaaaaattagccaggtatggtagtgtacgcctgtaatctcagctactcgggaaattgaggcaggagaatcacttgaacccgggaggcagaggttgcagtaagctgagattgcaccactgcacaccagcctgagtgagagtgaggccctgtctcaaaaaaaaaaaaaaaaaaaaaaaccagttaactaatagatgagatttagagtttggtgaattctaattgatttctaaaaaataaaggaagagatgtgtagtgtggccaaaagacctccaatccggggttcc

SEQ ID NO: 77007 - DNA, 601 bp, Human
aggaacctataatcccagctacctggaaggctgaggcaggaaaatcacctgaaccttggaggtggaggttgcagtgaaccgagatcacaccacaccacagccctccagcctgggtgacagagctagactctgtctgaaaaataaagaaatatagccttcaggaaaacaatgatattaataacattggtacccaattagtaaacttaattgatcctcctatgagtctctgaggctgtctccatcttaacaattggagaaacaggttcagtgatgtcacatcaacagcccaatcctcacagaygttgaatggcagggccaggaatctaagcttggctccatctctctccaaaacgtgctctgaatccctgcacattcctgtctgctaaactggtccagatctcctcctcttttctctgcctcagggcaagcgtgccaaaacagacaggcaaaacagcctgcagctggacagcatctcccaacagatcaccctctaacatctcaagttcagcgtttccaaaatgttgggatcatcttccctccttccccagactaaaaaccagctcctccttgtttttgtttttgtgttgttttgttttgtggt

SEQ ID NO: 77008 - DNA, 601 bp, Human
tgaggagttcaagaccagactggccaacatagtgaaaccccgtctctactaaaaatacaaaaattagttgagtgtggtggcaggaacctataatcccagctacctggaaggctgaggcaggaaaatcacctgaaccttggaggtggaggttgcagtgaaccgagatcacaccacaccacagccctccagcctgggtgacagagctagactctgtctgaaaaataaagaaatatagccttcaggaaaacaatgatattaataacattggtacccaattagtaaacttaattgatcctcctaygagtctctgaggctgtctccatcttaacaattggagaaacaggttcagtgatgtcacatcaacagcccaatcctcacagatgttgaatggcagggccaggaatctaagcttggctccatctctctccaaaacgtgctctgaatccctgcacattcctgtctgctaaactggtccagatctcctcctcttttctctgcctcagggcaagcgtgccaaaacagacaggcaaaacagcctgcagctggacagcatctcccaacagatcaccctctaacatctcaagttcagcgtttccaaaat

SEQ ID NO: 77009 - DNA, 601 bp, Human
tgctagtgagagctgctttcaaaggtcacaaatacctgcctctgcttgcattcaccggggcctaaactggtaaacaggatggaacgtggctgtctgcgcttcttttatgcaaacaaacttgcaatttcactccttggtcatgtggagaagagaattcaagaaacataaaataaatctggtaaagtttctaaaagcttaatgccaaaaactgcaaattggaagataagcctaaacgtgtattagctgacgtgtcattctaaaacgaaatctgaagctctttattatttcttctgtcaaacasctgagaggaccccatatataaaagtaactcttctggacataatatgagtctgatgggaggacatttcctgcagccactcttgggtgcaacattgttctaatatgtaacatgctagcctggactctctccctgctgatagcatacaggctactgctaagaaatgaagaacaaaacatgcaaataaaagtttacaaaaaaatgaaaataaaatagaccaggcacggtggctcacacttgtaagcccagcactttgggaggctgaggcgggtggatgacgaagtgaggagttcaagaccagac

SEQ ID NO: 77010 - DNA, 601 bp, Human
tagagtgtaatggtcaaggccccaggctggcactctacaccaccagggttccaatcccagctctgctccatgctcagcagccggggaaagtcacttagcatctgtgacctctggttcatctgcaatatgggaatgtagtgtgtctgcttcatagtctacagagagggggcataactgagttgatacaggtaaagtggtcagaaaagtgcctggtgcataggcaagtgtgcaagaaatattaccgtttccacctctagctcccttggcataacacaaccatgcggagaagcaagaactcagmaccagaaagacctcagttcaaattctgcctttgcttcttactgatgatgtgacatcaagttgtgcaaagcccctgagtggctgtttctggccatgtttgtggggatcatggataatgcgcgcggtgcacctggttcatagtactccccaccaaggcagccacatgacaatagagccccgcaggcatccactaagtaagtgtgggttgatctggggattgggggaaggggaggtatctctaaaccagttttgcaggcaacttcttggaggacagccaataaggaactggcaaaagaagaaa

SEQ ID NO: 77011 - DNA, 601 bp, Human
aggaggccaaacgggctgcatagaaccccagagccccagccgaatcagggcacagtgttgcacaaatgtcagctacttccaggcatgtgtgaatcaataggtggctttcaaaccacggctgaaaattctaggacatgcttttaaattgcactgttccagagacccggatatttggtttccatatatccaagttgaagctgagattttcttgagaatagcaaagagaacaatgatgaggaaacactaatcatgattcacactatatttaaatactttaaaatctcgttctatgttgtatcargtttataaaacaagtatatattacatgcaatctattgggtaatttcaattaaaggctttttgttgttgttttttgtttgttttgagacagagtctcgctccgtcacccaggctggagtgcaatggcgagatcttggcttactgcaacctccccctcccgggttcaagcgattctcctgtctcagcctcccgagtagctgggattacaggcacctgccaccacacctggctaatttttgtatttttagtagagacagggtctcaccatgttgaccaggctggtgtcgaactcctgacccca

SEQ ID NO: 77012 - DNA, 601 bp, Human
ctcatgcctgtgatcccaacattttgggaggccaaggcatgtggatcacttgaggacaggagttcgagaccagcctgccaacatggtcaaagcccacctctactaaaaatacaaaaattagccaggtgtggtggcacatgcctacaatcccagctacttggaaggccgaggcacaagaattgcttgaacccaggaggcaaaggttgcagtgagccgaggtcacaccactgcactctagactgggccacagagactctgtctcaaaaaaaaaaaaaaaaatttatcatagaggggaaaggcmacattgtgaggttttctccaccttttctgtattgggcctaagaggagaaatgtcagagcataaggagcaaagtggcttgaggccttccttgagaagtagcaggcagcaaacaagagaacagggcacctgctgaggccagagcaccactggccgctactgttggcaacagaatttaaatgccccgcacctcacagcaaggaggccaaacgggctgcatagaaccccagagccccagccgaatcagggcacagtgttgcacaaatgtcagctacttccaggcatgtgtgaatcaataggtgg

SEQ ID NO: 77013 - DNA, 601 bp, Human
tgaataaaagttatcacagaggtggccagacacagtggctcatgcctgtgatcccaacattttgggaggccaaggcatgtggatcacttgaggacaggagttcgagaccagcctgccaacatggtcaaagcccacctctactaaaaatacaaaaattagccaggtgtggtggcacatgcctacaatcccagctacttggaaggccgaggcacaagaattgcttgaacccaggaggcaaaggttgcagtgagccgaggtcacaccactgcactctagactgggccacagagactctgtctcaaaaaaaaaaaaaaaaatttatcatagaggggaaaggcaacattgtgaggttttctccaccttttctgtattgggcctaagaggagaaatgtcagagcataaggagcaaagtggcttgaggccttccttgagaagtagcaggcagcaaacaagagaacagggcacctgctgaggccagagcaccactggccgctactgttggcaacagaatttaaatgccccgcacctcacagcaaggaggccaaacgggctgcatagaaccccagagccccagccgaatcagggcacagtgttgcacaaa

SEQ ID NO: 77014 - DNA, 601 bp, Human
caactcaatgttcacgtactttataactttgctaagatatcttgagggaaggcttctcctggttaatcctggcgttaggaaaagcttccagaaaagcacaggaaaaggatcctaaggtagaaacagtgggtcaagagaataaattcccccggctgccagccaactatgctgccatgttgatagcaacaatgtccaggtgtccctcatgtctccaggtctcctctgagccgcagtgagttaagctggccacaccgtgctggtcccaccaccctggcttagtcctgtcagggctgcacagccrtgatgagcagtcaggaccagacgcaggctccatcaagcctcccccgtcacacctcggggaccctaagaagggcttgagatttccccgagtaacacatttacacaggtcaatgaaaagtggcaagcaggcaaggcttccgtgattctgagagaggaaaaagtcctcagaaacaagctcaaggacttaattagctgaagatcacatgcagtttattttctccataagttttcagaagcccccttagaaatactaaatgtctggccaggcacagtggctcacacctgtaatctcagcactttg

SEQ ID NO: 77015 - DNA, 601 bp, Human
tttgaagtgtaagagaacacatgaagatagattactctgggctgctccaactcaatgttcacgtactttataactttgctaagatatcttgagggaaggcttctcctggttaatcctggcgttaggaaaagcttccagaaaagcacaggaaaaggatcctaaggtagaaacagtgggtcaagagaataaattcccccggctgccagccaactatgctgccatgttgatagcaacaatgtccaggtgtccctcatgtctccaggtctcctctgagccgcagtgagttaagctggccacaccrtgctggtcccaccaccctggcttagtcctgtcagggctgcacagccatgatgagcagtcaggaccagacgcaggctccatcaagcctcccccgtcacacctcggggaccctaagaagggcttgagatttccccgagtaacacatttacacaggtcaatgaaaagtggcaagcaggcaaggcttccgtgattctgagagaggaaaaagtcctcagaaacaagctcaaggacttaattagctgaagatcacatgcagtttattttctccataagttttcagaagcccccttagaaatactaa

SEQ ID NO: 77016 - DNA, 601 bp, Human
atggtaggcttgtggggccacacagcactctgcaaggacgcatggcacagggtcctcagcacctgcatggacagggcggcccgcatccaccaagccatgcggggctctcaccacagaactgacggggctgcccgcatccaccaagccatgcaggccctcgccacagaactgacagggctggggccgggcacagtggctcacgcctgtaatcccagcactttgggaggccgaggcgagcggatcacgaggtcaggagatcgagaccatcctggctaacacagtgaaaccccgtctctactamaaatacaaaaaattagccggggacggtggcaggcgcctgtggtcccagctactcgggaggctgaggcaggagaaaggcgtgaacccgggaagtggagcttgcagtgagcccagatggcgcccctgcgctccagcctgggcgacagagcgagactccgtcaaaaagaaagaatgacggagctgcccgcgtccaccaaaccacgcaggaccctcaccacctgcaaggacagggccgcccgcatccaccaaatcacgcaggaccctcagcacctccatggacagggctgcctgcatccaccaa

SEQ ID NO: 77017 - DNA, 601 bp, Human
cagcgtctttcagccactcttggcatcattccctttccagcctgcaaagcacatctcatcccaccagccctcctcctgctgcttctcttttcacccatcactcctatttcatgagtaaaagaccaagatgtctatcgagctttgagctccaccccatgtccctgggctttcgatcctatttccacatgatctttttctgaccccaattgtgaggctggggcttgtgcaggaagaaggcagccaaaatctgggaggccagagggacttggcagggcccaccagctcaaatgcagctccctcrgtgaccccactagcagcagtgctctctcctttccagcctgagagttgcactgtcaaagtcactttatgattatttttatttttatttttatttttatttttggagacagtgtcactctgttgtccaggctggtgtgcagttgcgtgatctcggctcactgcaacctccgcctcccaggttcaagcgattctcgtgcctcaccctcctgagtagctgggactatagccgtatgccaccacatccagctaatttttgtatttttagtacagacagggtttcaccatgttggccaggctggtc

SEQ ID NO: 77018 - DNA, 601 bp, Human
tgcacacttttgtggttaaatcagtgtttcttaactttgttttcattatgattcccctagggagctttttagaacattttttcctcaaccatactcccccatgaaatatttttaatactacagatatagtagatatctgtttattgcagtatgtgtctcagtgctttttacataaaaagtttgcgggtgtttttggttttgcccagaaagaaccagtgttggcccccaaacacacgggttaaacgaatcaatagagagacccagcaagcaaggaagcctgggtcgggggtagcctgagttkcgagccaagccaaggggtttatggctttataactaaaaagaccctaaaagaaacaaagcatcaaccggcccctctgcctcatttcatagaggagaaaactcagacccaagactcctgtggacttctccacacaggcagagggtagaagtgagacgctgcctatgactcccaggcagagggtggaggcgagaccctgcctatgactcccaggccagggctctcttggtgacaccctgggcccctggcaggagtcctagggcatggaagttgcagggatcctggagttttcactatttttaa

SEQ ID NO: 77019 - DNA, 601 bp, Human
ttgaacaatgagaacacatagacacagggaggggaacatcacacactggggcctctcagggagctggggactaggggagggagagcattaggagaaatacctaatgtagatgacagattgatgggtgcagcaaaccaccatggcatgtttatacctatgtaacaaacctacgcattctgcatgtgtatcccagaacttaaagtataataataatttttttaaaaaagggccgggcgtggtggctcacgcctgtaatcccagcactttgggaggctgaggcgggtggatcacgaggtcaggrgatcgagaccatcctggctaacatggtgaaaccccgtctctattaaaaaatacaaaaaagtagccgggtgtggtggtgggtgcctgtagtcccagctacttgggaggctgaggcaggagaatggcgtgaacccaggaggcggagcttgcagtgagccgagatcgtgccactgcatgccagcctgggcgacagagcgagactccgtctcaaaaaaaaaaaaaaaaaaaaaaatacaaaaaattagccgggtgtggtggcgggcgcccgtagtcccagctattcaggatgctgaggcaggag

SEQ ID NO: 77020 - DNA, 601 bp, Human
acagacccacccttttctccggttccactatgatggcgtgtttatcttcttctgacacgagaacacacgtggcaaaggatgactttaacatgttcataaccaggtcgttggagaggacgtccagcttcttaacttgatcacctgtcacgttggtagaaccagcaatgccatagctacagggaacaaaagccacaaaaaataagccatgaccaccagaacatgtagatgagtccataaacccaccaaaagtgagtgttcggtaagatttagaagaaagagttcatgtcctttgcagggacayggatgaagctggaatccatcattctcagcaaactaatacaggaacagaaaaccaaacaccacatgttctcactcataaatgggagttgaacaatgagaacacatagacacagggaggggaacatcacacactggggcctctcagggagctggggactaggggagggagagcattaggagaaatacctaatgtagatgacagattgatgggtgcagcaaaccaccatggcatgtttatacctatgtaacaaacctacgcattctgcatgtgtatcccagaacttaaagtataataataatt

SEQ ID NO: 77021 - DNA, 601 bp, Human; identical to SEQ ID NO: 19375

SEQ ID NO: 77022 - DNA, 601 bp, Human; identical to SEQ ID NO: 19376

SEQ ID NO: 77023 - DNA, 601 bp, Human; identical to SEQ ID NO: 19377

SEQ ID NO: 77024 - DNA, 601 bp, Human; identical to SEQ ID NO: 19378

SEQ ID NO: 77025 - DNA, 601 bp, Human
tcactatacttaccctctactgcctcttttttaaatctcattttctatcataaaaagtaagacatagtaaaaagagtgaaatatccttctcttcccacccatattttaccctatattctctttcaacaatctagtgggtcttcgtcatgcaattagtgctgaaaagctcagaacttgagatacaaatctacttcagtctcacagtttcatgatctccactccggctgctctgccacagtgaaataggactggatgctcaatcttaacttctgtccccaaaccaagtgcttaagatatcacrttttacctttctatagatgccaaaaatggttccaacggacacaaggcaatcgatgttggaagatccatcaaggggatcaaaacagaccacatatttaccctgagcacagaaaaaagaaatacaaccttaaaatgttatagcaagatacactaaaggagtatacattaggggctaagaatgggaatttagaagaaagttcaaaaaatgtgggtcttatttatttgtactgtcatggaaggcatgagatggcatacagaatgcacagatacacacacatacacacaagaccattaaacagag

SEQ ID NO: 77026 - DNA, 601 bp, Human; identical to SEQ ID NO: 19379

SEQ ID NO: 77027 - DNA, 601 bp, Human; identical to SEQ ID NO: 19380

SEQ ID NO: 77028 - DNA, 601 bp, Human
gccaaagtatctcgataacagttgtttaagaggccaaaaagaaaaaccctgacaaatatgttttgatctttagttcagtgtgcatcatataccttagcccctttaacccttccttctactggaagagaattttggaaggaaaaaacttttaattagactgagactttttgagacggagtcttgctgtgttgcccaggttggaatgcagtggcatgcgatcatggctcactgcagcctcgacctgctggggtcaggtgatcctcctacctcagcctcccgagtagctgcgaacacaggcacrcattgccacacctggctaatttttaaattatttgtagagacagggtctccgtatgttatccagtgtagtctgaactcctggactcaagtgaccctcctgccctggcctgaggttaggattacaggtttgagccactgtgcctggccagacggagacttctaagcagaaacatttttggccatcccatctggtcttcttattttgcagatgagaaaactgaggctcaaacaagtaaaaggctatacataggtggttactagtacaggcaagactagaatccaggtcttttacccttagtct

SEQ ID NO: 77029 - DNA, 601 bp, Human
ccacacctggctaatttttaaattatttgtagagacagggtctccgtatgttatccagtgtagtctgaactcctggactcaagtgaccctcctgccctggcctgaggttaggattacaggtttgagccactgtgcctggccagacggagacttctaagcagaaacatttttggccatcccatctggtcttcttattttgcagatgagaaaactgaggctcaaacaagtaaaaggctatacataggtggttactagtacaggcaagactagaatccaggtcttttacccttagtctgatgcrctctccattatgaagaactctgaatttggaatatttctcagaacatgaatcttaattactccctttcacacttcccttcttagcacaatccttgtttcagactcttagatccttcttatggatgaaaggggaacgtagccctcaccagctaggttctccttttccaagagacagagttacccatgcaattcaagagtatttcacaggacagaggttaagaagctactctcgggaatagaaatttgatactgtttagtactcatgattcaaaattttattagattccagcattaataataa

SEQ ID NO: 77030 - DNA, 601 bp, Human
aaagtgctgggattacaggtgtgagccaccatgcccagctgcacaatgcccaattttgccacttctgttcaacataatactggaagtcctagaaagagcaataagacaagagaaagaaatacaaggcatcttaattggaaaagaagttaaactgttcctgtttgcagaagacatatgatgtcagtgtttattgttataaaaacttctgtcttaaaactgcttttgctgtattccataggctttgtatgctgtgtgtttcagttttcatttttttcaataaacttcctaatttgttttttartatcttcattgacctattggttgttcaagagcatgtgtttaacttccatgtttttgtgaattttctgaagatcctcctgttaatgatttctagttttataccattgtggtcagaaaagatatttgatatgatttccatcttcttaaatttgttaagacttattttgtggcttgacatatgatctatccttgagaatgttccatgtgcagcttaaaataatgtattatgccactgttgaatggtatgttctgtgtatgtcttttaggtccatttgttctatagtgtagcttaagtctcatg

SEQ ID NO: 77031 - DNA, 601 bp, Human
accattgtggtcagaaaagatatttgatatgatttccatcttcttaaatttgttaagacttattttgtggcttgacatatgatctatccttgagaatgttccatgtgcagcttaaaataatgtattatgccactgttgaatggtatgttctgtgtatgtcttttaggtccatttgttctatagtgtagcttaagtctcatgtttccttgttggctttctgtctgcatgatctgtgcattgctaattgtgaggtgtgaaaatctcctactgttactgtagtacaacctatctttcagatctrttaatatttgctttatatatttaggtgctttgatgttgggtgcatatatatttacaattattctcttgctaaattgacccctttgttattacataatgaccttctctatcttttttttacagtttttgatttaaaaatctattttattgggggccaggcatagtggctcatgcctgtaatcccagcactttgggaggccgaggcgggcggatcacttgagatcaggagttcaagaccaacctggccaacatggcgaaatcccatctctattaaaaatacaaaaattggaccaggagcggt

SEQ ID NO: 77032 - DNA, 601 bp, Human
gatctgcccgccttggcctcccaaagtgctgggattacaagcgtgagccactgcgcccggccggtcttgaactcttgacctcaggtgatccacccacctcatcttcccaaagtgctgggattacaggtatgagccaatgcgcctggctctctttttttttttgagatggagttttgctctgtcacccaggctggagtgcagtggtgtgatcttggctcagtgcaacctctgcctcctgggttcgagcaattctcctgcctcagcctcctgagtagctgccattacaggtatgcgccaccaygtctggctaatttttagtagagaccgggttttaccatgttggtcaggctggtctggaactccttacctcagatgatccacctgcctcagcctcccaaagtgctgggattgcaggggtgagccaccacgcctggcatataggtttttgctttgtggttaccatgaggcttacagaaaagatcttacagttacaaaaggttattttaaactaataacaacttagccttgatggcctaaaaaatcctttatacttttaccctactctcccattttgaatttttgatgtcacagtttggatctt

SEQ ID NO: 77033 - DNA, 601 bp, Human
caggaggcagaggttgcattgagccaagattgcgccactgtactccagcttgggtggcagaatgagaccctgtctcaaaaaaacaaacaaaaaaaatcaatgtttgaaagtttgtttcaaacgtagttcactttttcaaaggctctttttcaaagagctgattaaaataagtttgacatatgtaagatgggacttcaggactgggtttgggagtgctttattcttgtttataaagtcttagctgatttgtgtgagagcagatggtattttcagtaagctggaactcagcagctgtttcaarccttagaaggagataaatccttgtggctgtgtataggtacttttaaatagaaatagaaaaaacagtttaatagaatatatgttatggattgcctggactctagaccaagttcattttatagatgagcagtagaaatacagatatgaaatggcttttgcaggattttttagctagatgttgagtccagagctggtatcttgatttaagactcttggctgggtatggtagctcatgcctgtaatcccagcactttgggaggccagggtaggtggatcacctgaggtcaggagttggagacca

SEQ ID NO: 77034 - DNA, 601 bp, Human
ttttcagtaagctggaactcagcagctgtttcaagccttagaaggagataaatccttgtggctgtgtataggtacttttaaatagaaatagaaaaaacagtttaatagaatatatgttatggattgcctggactctagaccaagttcattttatagatgagcagtagaaatacagatatgaaatggcttttgcaggattttttagctagatgttgagtccagagctggtatcttgatttaagactcttggctgggtatggtagctcatgcctgtaatcccagcactttgggaggccagggyaggtggatcacctgaggtcaggagttggagaccagcctgaccaacatggagaaaccccgtctctactgaaaatacaaaattagctgggcatggtggcacatgcctgtaatcccagctactcaggagactgaggtaggagaatcgcttgaacctgggagatggaggttgtggtgagccgagatcgcgccattgcacaccagcctgggcaacaagagctaaactccgtctcaaaaaaaaaaaaaagagattcttaaatactgcttctgtatcacactgtatcctacgtatgccttggttgct

SEQ ID NO: 77035 - DNA, 601 bp, Human
tgcctcagcctcccagaattgtggcattacaggcgtaagccactgcacctggccctttactggctatttatatatcttctttggagaaatgtctattcagattctttattcattttttttttgtttttgagacggagtctcgctctcgcccaggctggagtgcaatggcgcggtcttggctcactgcaacctctgcctcctgggttcaagcgattctcctgcctcaacctcccaagtagctgggattacaggtgcccaccaccacgcctggctaatttttgtatttttagtagaaatgggwtttcaccatgttggccaggctggtcttgaactgctgacctcgtgatctgcctgccttggcctcccaaagtgctgggatttacaggcatgagccactgtgcctggcccctttactcatttttatttatttatttatttttgagctggagtcttgcattgtcatccaggccggagtgcagtgtcatgatctcagctcactgcaacctccatctcccaggttcaagtgatcctcccacgttagcctccagagtagttaggattacaggtgtgtgccaccacacccggctgttttctttttttt

SEQ ID NO: 77036 - DNA, 601 bp, Human
atgcttcagatgtacgaagtttgacttgaatttgtttttttcttttttgagacggagtcttgctctgtcacccaggctggagtgcagtgatgtgatcttggctcactgcaacctccgcctcccaaattcaagcgattctcctgcctcagcctcccgagtagaggtgtgtgccaccactctcggctaattttttgtatttttagtagagacgggggtttcaccatgttatccaggatggtctcaatctcctgacctcatgatccacccgccttggcctcccaaagtgctgggattgcaggtrtgagtaaattttgtttttataaattacatttttttctgctatatttcatcaattctaaaacacattgaaatatccgaagtggatatatgtgttgtagtttaattggtagagtgtttaaattttttaaaattatggtatcatgtagttggttatgccatcttagatttgatcaaagacagtatttaaaaaaactgttaagatgcccacattgaggtgaatatataatagatttcaaatactggattctacaaacatactgacgtgttctcatttgttaactgaatactaagcaattgtgat

SEQ ID NO: 77037 - DNA, 329 bp, Human
tctgtactgattccatattttcttaatgatttctttagctgatgaggaagtcttaaaatctaggaaagtgtcccctctgttttttctttttttgttttgtttttgtttttgagacagtctcgctctgtctcccgggcaggggcttgatctcggctcacttcagcctccacctcctgggttcaagcgattctgcagcagccttccaagtagctggttgggattacaggtgtgcaccagcatgcctggcttatttttgtatttttagtagagatggggtttcatcatgttggccaggctgggytttttttttttttttttttttttgagtg

SEQ ID NO: 77038 - DNA, 601 bp, Human
ctgaggcggggccccagattggctggtgcatccagcagggaggcaccaggccaaataaagcatgaccctgagaaaggaagaagctgggaaaggtcattggaaaccttagccctgcacctgctgggccattaacacccccccacccctgtgccaactcagagctgggacctgagagtctctccagccctcacagtcctcagttggtcagtctttgtgatttactgggagcatttagtccatttacatttaatattcttaattactgacatgttcaggtttaaacagatcatcttatttggtrgtttctatttttctacatgtttcttgcctacttttggaatggttgttctcaacttctttcattctgtttgtgttctttcagtgattattctagaaattatgcacacttatctatttttaagaaatttgataggagcaggattataaagcatatgagtacacagaaaagatattatttagggaatgtcctgtgtgacacacagcattgcctttatgaagaagacctttgttagattttgctactagacatatctggttttctccactactgttttgtttttacattatagcttctgtaaat

SEQ ID NO: 77039 - DNA, 601 bp, Human
ttaagaaaatttaaatttctgtaacttggaacctcctggtaggtaggaattatgaatatcattcttcattacaaaatcattaagaatgttcatttatgtatatcaataaatataactttattagagatggggctataaggaattattttgctgtatatcaagcaccaaaatattaaaggaagattctttcttacctcatttatcgtgaaataaagtatttctgactagtcttcttttattatactgatttgcttactagtgtaggtgaaataaagagatttgttttttctaaacatgtatytttcagtcgctgtctcacacacaaactactactcaagaagaaattgtcagatatttcaaaaatactcacccaaatgattaatcagatgaaccccactgaaggcttgaaggcaagtcatcttgacaccttcagtggccctgttctctcccctagattggtcacctcccaggcaccaagggaagaaagtgcctatttagggtttctattgtatatctggctttgtagaatggaatctatgcaattgagagtggaagcctggctctccagaccatggacaagaagcacaagaaccctcaggta

SEQ ID NO: 77040 - DNA, 601 bp, Human; identical to SEQ ID NO: 19395

SEQ ID NO: 77041 - DNA, 601 bp, Human; identical to SEQ ID NO: 19396

SEQ ID NO: 77042 - DNA, 601 bp, Human
catattggccaggctggtcttgaactcctgacctcaggtggttagcccaccttggccccccaaagtgctgggattacaggtgtgcgccaccaaggccagcctaaaatcatttataccgtatttttgctgtatgtttttaggtttagatatatttggatacacaactagttacgttgtgttccagttgcctagagtacacagaacagtaacatgctgtacagatttgtagcctaggagcaacaggctgtaccacacagcccaggtaggtagtaggctatgccatctaggtttatgtaaatayactttatgatgttcccacaacaatgaaatcgcttgatgatgcatttcttgtaacgtatccctgttgttgagcaactcatgactgcacttgaaaacattctgaaaaggttttctttccgacagtcggcgttcggttactcaccttccaacgtgcatgtcattggccacagcctgggtgcccacgctgctggggaggctggaaggagaaccaatgggaccattggacgcatcacaggttggtgaaaacagtgaaagataccaggggggttgaggcaagatgatctcttgaggccagcagttt

SEQ ID NO: 77043 - DNA, 601 bp, Human
aatcacttaagaagctacaaatattacactgatagcatcgtcaaccctgatggctttgctggattcccctgtgcctcttacaacgtcttcactgcagtaagtagactccaccttccgcataaagaattttgtgactgtcacttctcatgactggtgtgctttcctatacatgacatcattcaatgaatgtttatacttttgaacttatacatgcctttaattatatgtatttaaatagtgataaattagagcactttagagaaatgagcttgtacatggaaatgtcctgtttactttcatytgtgttacttttgtatgcattgggtaaatgtccaaacttgttttagaaataaccctaaacagacaaaaaataattagtctatggaaatctgagcaatatctgtaggatgctgatgaacatggaaaaattttcttaaatgctgacctttctaactattaatatataattatagacatgtggacatttctgtgcaatttcataatggccaaaatttttttttgaattttcatcttatttggtattctcttgatatcttggttgaattatttatttaattttactttaagttccaggatacta

SEQ ID NO: 77044 - DNA, 601 bp, Human
tctatagtgacagcagagccgtggttgcctgggaggagtgaatattggagggaatgggaagaagcaattacaaagaggaagaaagaaaattgggggatgatagatatgttaataactttgatgttggtgatggcttcagaggtgtgtgtgtgttgtgtgtgtgtgaaaacgtatcaatttaaatatgtacagtttattccaggtaaattaaagctcaataaagctgttaaaacaaaaatatatatcctatgaggtagatggttttattatccttattttatggataattaattaaggtacygtttctgaatttctatgcaggaagtttgactctacaaaattcttaactactacaaaaaaattcagttcacctttaatcatgtataaatattggtgcctttcttttcttgtgtccctgattgataacagttttaacctttaatttcctatttgtgaggctgccagtcattgaggaagtgagcgtgaagggaaaaaaacattttctgagcactttttttctgttcctggtagtttacatatggtaaggtattttattaaagaaaaatattccaaagcatcctaagtattgttcagcctgttc

SEQ ID NO: 77045 - DNA, 601 bp, Human
ctctggctgggcgtggtgggtcatgcctgtaatcctaacactttgggaggctgaggcaggcggatcacctgaggtcaggagttcgagactagcctgaccaacagggtgaaacccccctctactaaaaaatacaaaaattagcaggccatggtggtgcatgcctgtaatcccagctacttggcaggctgaggcaggagaatcgtttgaacccaggaggcggaggctgcagtgagccaagattatgccattgcactccagtcttggcaacaagaccaacactctgtctcagaaaaaaaaaaawaataataaataataataataaattaaagtcctaaactctagctctatgtagtatgaaataaagggcaaattaaacactgtaaatgaaataacaaagaattgaaacaattaagctgtggcatacctgatgagctgcaggtgtctgcccagggcctgtggggtttcattaatggaacacagtctttcttctggtccagtcctaagattctctcaattgaaaaggagcaagttgagggtttgttttccccgagctgagcgccttcctgaaggctgggagacatcctctcgtggtctgcacaga

SEQ ID NO: 77046 - DNA, 601 bp, Human
tggtggggggtccctccaagacaggtgtatgaagctcaggcatgggctcagaagagggcagaagttggctaagagtgggcagttgagtagaagccgggggagatgagggaggagagagaaaaaaatcctgagtctggggctgtggccctccaaggctttggggagacactggaagaggccaaatggccacctctctgtacgggtttctgaagggcagaaaggagagggggttgggaagcaaagggtatttatcagtgacgcagtgcaaaaggccctctggcttgggaagctgagcagggtrctcagggtgcatggacaggctgtccctccccaccagcctctctctctcttcaggctgtccctgtcacaggtctcatatacgtgccagtgcccccatcctcccctaaggtgtcagcttacatggacactggggccttgcccttcctctgccatggcctgatagccccattgggaactgattttttcttctcttttaagaagccaaagaaactttgctggttctttcatcctttctttctctctattcctctttctactctgtttcctccttctttctttcttttcctgcctcctttcccct

SEQ ID NO: 77047 - DNA, 601 bp, Human
tgcggcggcgccgtgtcaggtagcggttgaagtggaactccttctccagctccagtgtctggtagcgcgtgtaggtctggcggcctcggcgcccatggctcccatacacagcacctacgagcagaaacggccgggcgccggtaagccagggcctggagggttgacccagtcagcccagtgcctcccacaagaggcacccagactagaaaccaccccgcctccactccagcctctcccactatgtctggggcccaaagcatactgaatgggagattatttcataccaagcgagatgttttcsacctataacgacttggggtggacattatcgtttttgaaaaatctgcctcataggaaaaccattacaagcaaaataacagaatgagcattcttaatttgggatgcccaggtcgtgtttttgtggggatgcagggtgtgtgtgtgtgtttgtgtgtgtgtgtgtgtgtgtgtctggggtgggtggtgtggaaccatgtaagtagtgtacacactctgaattcatagtggtctctctgaggatgctactgtgaccagccatgtcggaactcaacacattttttgaagagttaaaaatggtcag

SEQ ID NO: 77048 - DNA, 601 bp, Human
tttccctggcccctctcctgccccctccgccctgccccgggcgccccgatcgggaggcacagccctcccaggctgcccaccgcacagaaacccaggaagcaaggccctttcctgagcgcccaagtggccttcgggtcaccctccctcaaagttccagccccgagagccgcctcccgtttccagcctgcagggttggggagcctgttttctttttcttccctttccttctctctccctcctgcccccaaaattcagaatcctgcaggctctcgcctcgattctttcccccaagccccttttygggggctgtaattagtaacgctgtttccccagcgtagccctcctcataaattatccgccgtgacaagcccgattcacggctgctacagccatcctctacctctctgcgccttgctcggctggcctgacccgggagcgcgtcccaaggcgtggggttccagaggggttttttgcttcctcccccttccaacgtctaaactgtcccagagaacgcccatttcccccactatttgtgagcgcagggtgctcgcaaagaagaggaggaaggaggaaggcaggggagggagaacggcaaggagag

SEQ ID NO: 77049 - DNA, 601 bp, Human
gaatttccttctctcttcctttctagaaagaaaacaatacgatttggaccctgggaacaatctgcccatctgaggctggggccgtgtcccggcggactccggctttccctggcccctctcctgccccctccgccctgccccgggcgccccgatcgggaggcacagccctcccaggctgcccaccgcacagaaacccaggaagcaaggccctttcctgagcgcccaagtggccttcgggtcaccctccctcaaagttccagccccgagagccgcctcccgtttccagcctgcagggttgggragcctgttttctttttcttccctttccttctctctccctcctgcccccaaaattcagaatcctgcaggctctcgcctcgattctttcccccaagcccctttttgggggctgtaattagtaacgctgtttccccagcgtagccctcctcataaattatccgccgtgacaagcccgattcacggctgctacagccatcctctacctctctgcgccttgctcggctggcctgacccgggagcgcgtcccaaggcgtggggttccagaggggttttttgcttcctcccccttccaacgtctaaa

SEQ ID NO: 77050 - DNA, 601 bp, Human; identical to SEQ ID NO: 25545

SEQ ID NO: 77051 - DNA, 601 bp, Human; identical to SEQ ID NO: 25546

SEQ ID NO: 77052 - DNA, 601 bp, Human; identical to SEQ ID NO: 25547

SEQ ID NO: 77053 - DNA, 601 bp, Human; identical to SEQ ID NO: 25548

SEQ ID NO: 77054 - DNA, 601 bp, Human; identical to SEQ ID NO: 25549

SEQ ID NO: 77055 - DNA, 601 bp, Human; identical to SEQ ID NO: 25550

SEQ ID NO: 77056 - DNA, 601 bp, Human; identical to SEQ ID NO: 25551

SEQ ID NO: 77057 - DNA, 601 bp, Human; identical to SEQ ID NO: 25552

SEQ ID NO: 77058 - DNA, 601 bp, Human; identical to SEQ ID NO: 25553

SEQ ID NO: 77059 - DNA, 601 bp, Human; identical to SEQ ID NO: 25554

SEQ ID NO: 77060 - DNA, 601 bp, Human; identical to SEQ ID NO: 25555

SEQ ID NO: 77061 - DNA, 601 bp, Human; identical to SEQ ID NO: 25556

SEQ ID NO: 77062 - DNA, 601 bp, Human; identical to SEQ ID NO: 25557

SEQ ID NO: 77063 - DNA, 601 bp, Human; identical to SEQ ID NO: 25558

SEQ ID NO: 77064 - DNA, 601 bp, Human; identical to SEQ ID NO: 25559

SEQ ID NO: 77065 - DNA, 601 bp, Human; identical to SEQ ID NO: 25560

SEQ ID NO: 77066 - DNA, 601 bp, Human; identical to SEQ ID NO: 25561

SEQ ID NO: 77067 - DNA, 601 bp, Human; identical to SEQ ID NO: 25562

SEQ ID NO: 77068 - DNA, 601 bp, Human
caggacctggttatattttccatcctttacatccttctgtctgttcaaaaaccagtcggggatcttgtactggcgtggattctgcataatggtgaccacacgttccacctcatcctcaatgagctctcccgccctcttggtgaggtcaatgtctgctttcctcaataccacatgagcatatcttcggcccacacccttaatggcagtgatggcaaaggctattttccaccgcccatcgatgttggtgttgagtactcgcaaaatatgctggaacttttcagggatcactagagacatggcrgcagcacaagcggcggcgtgtaggcctcctgtggaagaatcttttcaataattttttaatctcatctaatggttagacaatattcaaaatctcctaattgtccccagaagtctttttagctgtgctttggggtttttttttttttgttctccccccaccccatattatatgcaacccaggactatgcattgtgtctgcttgttgtattccttatgtctctttgaaatagcactagttaagtttaggagatcaggccaatgatcctccagagtgtttttccttctgtcatttgtcactttc

SEQ ID NO: 77069 - DNA, 601 bp, Human
cattaaagacatcctgactgggcacagtggctcatgcctgtaatcccagaactttgggaggccgaggaggccggccaaaatggtgaaacgccgtctctactaaaaatacagaaactagccgggtgtggtggtgcgcacctataatcccagctactcagaagcctgaggcaggagaattacttgaacccgggaggcagaggttgtagtgagccaagatcacaccactgcactgcagcctgggcaacagagtgagactctgtctcaaaaaaaaaaaaaaggtatcatttctctagacctgttstatccaatagggcagccacctgccacacacggcaattaagcacttggaatgtggctagtctgaactgggaagaactgcaaaagtacagtacataccagactttgaagacaggatgaaaaagggaaggtaaaaactattacgttaaaatttttaatagtgatcacgttgaaatgccaatattttggatatattggattaagtaaagtatattataaaaatgaattgtttcattttactttttaaaaatgtgtttaccaggaaactaaattagctgggcaaggtggtaggtgcctgtaatcc

SEQ ID NO: 77070 - DNA, 601 bp, Human
acattaaagacatcctgactgggcacagtggctcatgcctgtaatcccagaactttgggaggccgaggaggccggccaaaatggtgaaacgccgtctctactaaaaatacagaaactagccgggtgtggtggtgcgcacctataatcccagctactcagaagcctgaggcaggagaattacttgaacccgggaggcagaggttgtagtgagccaagatcacaccactgcactgcagcctgggcaacagagtgagactctgtctcaaaaaaaaaaaaaaggtatcatttctctagacctgtkgtatccaatagggcagccacctgccacacacggcaattaagcacttggaatgtggctagtctgaactgggaagaactgcaaaagtacagtacataccagactttgaagacaggatgaaaaagggaaggtaaaaactattacgttaaaatttttaatagtgatcacgttgaaatgccaatattttggatatattggattaagtaaagtatattataaaaatgaattgtttcattttactttttaaaaatgtgtttaccaggaaactaaattagctgggcaaggtggtaggtgcctgtaatc

SEQ ID NO: 77071 - DNA, 601 bp, Human
agggaattggaggtcagaaatgaataaaataccatgccccagtaggctccagtctagggaagtgggcagcaggcagaaaccaagacacagaaagcaacgacacataacagatatgctatgatacaaatggtgccgcaggagctgcacagttcggaggccatttctggccagaggatgggatgcgtgaaatccaggaaggcttccaggaaggagtagctggcactgggatgggcaggaacagcaatgtctctactgatggtttcattggagaaagctggcaaagttgagaagtttggagacyaaccgtgacaaaatttaaacatcaggtatgtgaaggcaagggggaccaactgtgacaaaatgtaaacgtcaagtgtgtgaagtcaaaggggaaccaggaaagtaaaagagtgacaatcagcagtgcttttggcaaaaaggcctctggcagcagtgtagaagagaaacgcagagatcacaggtataagaatgacagtaggagaggggaggagggtacatatttcagaggcatcacaggggggtgtactgataggacgggggcctgcttgtatgaaggtgaaagaggaggagggagagtgtc
